United States Patent 9,487,797 (GENOMIC PLANT SEQUENCES AND USES THEREOF) - sequence listing, part 36

SEQ ID NO: 61601 - DNA, 46672 bp, Oryza sativa
catgcagaaacatgttcttatcatcacagtcgcacatcgcaaaacagatttgtatcaaaaaccataggcaaaatgagatggtggcgctgatttagggggcaaaacaatttatctgtagcaaagatccagtacatttactgacatagctaagtgttagatggtttccatggctttgtacgctggctagtatgccactctagtatcccagtttcttgcaagttcctatcacctcacttcattgatgtggcttagtacacaaaagtatgaactaaatgaaaaacttttcagtgggttcatttttttatagaagtggcagtgtatttttgtagtatcaatccccatcatcaaaagcaatgaacaaattgtgaaagaagtgtttcaaagaacaatgtatttttcattagtgtgtgattgaatcatgtttagggagtttcattgtgtattctataaagaacaaaaagctacagggggatgtaggacagttcattggtaagttaaatgtgattgtacaggatgcctcaactatatattggtgaagaaaaaaattggacgtagccacacagattccatttctatggtatttctctccatggcaacagctgtgatcttggaataacaagtacgctataatagaatttccataaaaaaaaactataggacaactccactccaaatcaataggttggtattggttcattgagtaattgaatagtaaatacagaaaaaattcacatcacatctcagcagttcaaatcaaaattagtttttcttagttgcgtaattactactgtccacaaagttgaagtgcttgaaagcaagctgcaaaggtagaatcagaaacacaaactgagaaaaaacacacaaaatacatctgcatcatacctcctgaaagcaaatatcctccaactttatgcttctcaggcagcacttatcggagagtgtttagcagttttcaatataaagaattcgcctaaaatttgacaggaaagaggtcaaggagacatgaacaatttctggatgaatcatgaactactctggaacaaaaaagtagtttgaccaattgaccattcaactggagtatttgtcaaacagaaaagttttaaaagattaattgggcagagacaccttttgagatcccattcctctgggaaaaaaaaaaccaaactagctggtcattaacacaagcaaccttttactagccaagctgttctagatcacaccatacaccattattcgttccagctagaaagaccaaggattggatgagtaaaagcacaatatgccaatcaaaaccccccacggaaacaaaagaacacctagtgatgaagacattaaactaaaagatggcatcttttcatcggcatatgtttactcttgacactcaacacactactaatctgagcaaaggtactcactggaagcgaaatttagaatgccaataatgttctgaagattgccagtgcaatcgatggataacaagaataacttaataaaatggtaatgatcaggtcgataaaccgtacaagtcaacaatttgacatgagaaatacacctttttcgcatcaaaattctgtcctcgtttttctttaaaaaaaagaaagaaaaaagaaaacgcatcgaccaaattgatccccggccgcggccagatttccctgaacacaatcaatccccaatagcccaaaaaccacatcgcgggatccagacgaaaaccctcgtagcatccaaatcccaaacaactaacgcgaaccaaaatcaaccaaagcaaaacaaacttgcaccaaaatcctcccgccaagatcgtacctctcggaacaacggattggcggcggcggcggacgagccggaggaggatgaggaggaggagatggtgacgacgcagctgggctgggttggcttggctggtacgcgggttgccctgcctctgccaccctttttctctcctctctcgaggagggaaagaaagggaagtcgtgcgcgccgcaactagagaaagaaatcgagaaatacgcgcagacgaaaccgacgggagcggcgcggccgttagcgtccgctgcagtgtttcgccgtcatatgttgcgcgccatcccgtgacgccgtttgtgcttctcttctctgccgctttctcggagaccacggtagaatggttagttttgccctacttttttgagggttgctaccccatgggataccgtggaaatagtacactcacgggataattaaaaaaacaacgacagcataaaggaacaccccacagaacacgtgatttgtctcgatacctagccattgtttgctcggtatcgtcgccggagcagtggctaccttacctcgccggcgtcatcgccgaagtagcagctacctcaccgcccaaaaattctcctcggtatcgcgcgctcgggtgatacctcgccggcatcgtcgcccctgagcacccagagtagcagctacctcacacgcgatacctcgccggcgtcgtcacccctgagcacccagagtagcagctacctcaccgccaaatcctcctggtaccttgggtaaggtaccgaggtggtacctggtacactggtatcggctggcacctggtaccctgggtatcgagctggtacctaggtatcagcgtgataccccaagagagaggaggaggaggaggaggaggaggaggaggagaggaggaggaggaggaggagtcgcggggtcgggaggtcctggtaccctggtatcgactgatacctggtaccctgggtatcgagctggtatctaggtatcagaccttggtacctgggtatcagcgtgataccctaagagagaggaggaggagaaggagtcgtggggccgaggaggtcgagcagcgaggcggcacggcggcggaggaagaggaggcgacagatctggtgcctagtaccatgcctccccagcctcctcagccggctgtggacgacgacgtgctcggcgcacccctgctgccggccatggaggtcttcatcaccgacgctgtagtagatctgcttgctgccggccatggaggatgtcgccgcaaccgcaccccgttccggctccaccgcaccccgctcccgctctccctctcgctcgccgccgagctcctcgccgtcgcggcctccctcacggcggcggccgctggctccggtgagcagtgggcgacggcgatggggagggctgcagtgtcgtgtgatttgggagaggagagtaaggtaggaggagaggattcgaatgattttggggagaggagtgaggtaggaggaggggatcccgtctccacggcaggatgccgtggtgtaggttttctgtacttttttttcttgtttcttttctttcgttttttttttcttttgcacggttcaaaaagctttgtgactgacttcgtgcaggtgtaaaaagatgccagggaatgccagttcaacggcgcgttcctaccagtgagagcaagtgatatactcccagcctatttaaccattcgtcttatttaaaaatttttgtgaaatatgtaaaattatatgtatacataaaagtatatttaacggcgaatcaaattatagggaaaattttaataattagttaagtttttttgaataagacgaacggtcaaacatatttaaaaaagtcaacagcgtcaaatatttagggacggagggagtatattccttcgaatgaacatagtggcggtgacaatgaatatgtcatgttgtcatctcacttttttttaacaaattttgcaaatagccttggtgaaattcttaatattaaaagcaatcaaatataaatggatagtcatatgactcgtatataaaattgaagtagggtgaatattccctatagtagaaagacaggtaatacagtatataaaaaatatgttttatttatattatattatattttcttttatacgtatcaaagcatgtgcatttagctagtcgcaacaaatgaaacaagcagcaacaaggtgaatggagtactgcgtaagtcttgtaaaaattacagtattgagagttgctcaattttttttctcatacattgcaaaattacaagctagtagagactcctacattggattaaacatactatctgggaccaaacaaggagaaaaatactgaaaaagataacgggacgacgggaaaaaaacagtgaggatgaaaagtttttttttttagaaacaggaggaaaggttgatgtgccgaaagcagcagccagtgaattaatcacaacaaaattgtgcgcacatggttagttggcttggattaaattagcatattaatactagtttgattacgattactcaatcaccaggacgcgaaatgattagtccggctccggcaaaagtaccacgtcaaagaatcaaagaaagaaagcataaacttacttaaagagcaagcaagaaagaaaaagaagggaagaacgggtctcgagaattagttcggttgatcaaccattcgatcgtggggtcctggagaccgatgcaattcctccccttttgttcctccgcttcatttattttttctttaattattagttggtgatgaatcattgctcttcagtaatactacgcgtctaaatgtctgacagcacaaaagaagacctgaaaaggccttaatccagaaacaaaaggcttgatcttgggtccctgagtcgctttgcgttggcatgcagattttgttgctgtgcagagaaagatctaatgatagatcatactatcatcatcagtctactcattcgcactctgccacaaatccaagcagcagaaagttcagtccagtaacttgcggactgctgagtggtactgaacactggttagctagaatactctgaatatgtggagtgtaacaatgtaaaataaatctgtaatttgtttcatcgatcagtaatttcagtactgatcgacgaaaagaaaaaggatgttgagacagatcgtgcacatatcaataggaggactggacggttggttggaccatgcatgccggttcaggttctggatggaagtatgaacagctaggcaattcaatgatccagccatggcagcaagctgcaagcagatagacccttctggtctctctgacaatgaacaggcccctctctgacaacgaacaggcccatcgatcgatcgaatgatcgatcagtggtcgatcgatcggccacgcggcagtgtgcatcaaattctcgctttttctgggacaatgcaggccacgatgattgaaagcatgcaggtaagggaagtaggagaagctgactactcccttccttaaaaaaaaaaaacccaacctaaacaatgatgggacgctacatagtacaatgaatctggatatactcatgttcagattcgttatactatgtagtgtctaatcgttgtctaggttaagtttttttttttggaacggagagagtagctgtgacgttgctccagtgtggttgttgggtgatgggttattgattgatgcttgtgattcatggcaatcatcggtgcaaacaatgcgaccaaaccccgtagtagatggggtaggggattgatataagatcgttggatttctagagatcgggatcgaagttttagtgctttctttcctccatgagacgctgaagctggcgagatatgcttaatacctggttgtggagcttctgtctgccgtggtttctcctaaaatcttcagttgctataaactcttgtacatatttttttcacgtaaattttaagaatttgtagttgtaaaattataaaaatgaattagggttttctaagttctccatattctcacttaggctgtgtttggaactccaagttcccaacccctctccctcgttttccgcgcgcacgcttttcaaactgctaaacggtgtattttttgtaaaaagtttctatacaaaagttgcttaaaaaattcaaattaatccattttttaaaaagaaattagccgattcttaattaatcacgcgctaatggaccgttccgttttccgtgcggggagattgggttcccatcccgctatccgaacacagccttagtattcttctgcagcggccgacggcgtgaggcagtccaacttatacggaccgcatggaggccgctgtccagatccggcccagttctggtgggctgtacggagcccgcagtgaatttccatttcgacctaactgaaatggtgagatctgctcggtttaggccggagaattgaaggccagagctggcttccagttgggtggtgaacccagacggctgcattatcgtctgaagagaaccacacgtaggctgtacgtagtgctgtattccaaaaattttcgtttttttaaacgtgtgctagtgaacacattcgccggtatatgaatgccgtgtacgtgtgcggtggtgcgtatgcatctttggtgagaagaaaataataggttgtggttggattaagtttaaatttcaaattgaatgtttggatttgaaacatatcaaaagtttttttttcagtgttagacaactcacaacagaaaacacatgaaagcattcggtagtcggcggctggttgatgcgcgagtccaattcggaaacaaacctttgatcacacctctctagttctacttcgaaattcgaatccgattcaattcaggagacatgccgatctatctactcctgttctttcggagcgacgtcctcaccacgataaatttggccggaatttatcagcgttaggcacggacacagcagtggagtgcgcgaacgccggccgccggttcaatgtcgaagcggcacagatccgatgacgacggcggcgagctcgagtccaggcggccacactcgcgccaccgccgccgccggcgacggcggcatctctacgtcgtgctggacgactggtccaaggggtacagcgtctacaaggtggacgtcgacgggttcgacggcgaccccgacgccgacctggacgacgaggccgtgcgcctccccgagccgccggtgttccggctggagaccgccgactacggccgtttcgggatcttcgtggcggtgggaagcagaatctttgccactcactacagcgaggacacgaacgcgcgcgctcccgtgctcatgttcgacacggtgaccggtggcctcgccgtctgccccggcgtcccggccgagctgtgtaaccagcccatgatcttccccgccggcgacaaggtgtacgccatgggcaggagcaagatcaagatggacgctaggggagagtcgcggaagtacttggaggagctcgcggccgacggcgagggcagctgggcctggagcagcagcgtcgacgaccgcgcgccgccgccgccgttcgacgtcgagcgggcccgatgccacgcggcgcacccggacggccgcaccgtcttcttctccgcccacggcgatggcacctactcgttcgacgccgggacgcgcgggtggacgcgccacggcgagtggatgctgccgttcgacgggcaggcctactacgacggcgagctggacgcgtgggtggggctctggagcggccactcgggccgccgcgggcgcgtctgctcctgcgacgtggtggatccccgcggcggcggcggcggcgagcagccaccgccggcgtggaagctcgccgtgaggagccacccggcgtggcgcgccaggtcgaggttcttgagcgtggcgctggcgcgcatgggcggcggcgagttctgcgtggtggagtggaggtcgcggaggggcgtgagcgaggaggagctccacgagcggtgcctgctgtacgcgaccacgttccggctccggtacgacagggacgggtcgctggaggccacggatcgccgcgcgcgcgccttcaccgcgcgcaagaaatcggacgagttcgaatggtgcgcgtttgggatctgatcgtctatctgaacatcgagcgcgcgcggtgtctgacttgaaatttgcgttgaagatcgtgtttgaatccaaagcacatttttaactctcatataattcattttagacttaatccagaccatggaacaactcaaaacaacgttacctaatgtagtataaaaccttacgtttgacttgttattagctctccgtcccaaaataagtttattaagtttatttttcatgcatcccatacatacaaatagaacacctacaatattataataccactttattaaatcctctttatctactctcaatactccctccgtcccaaaaaaaaagataaaccctaatttccgtgttcaacgtttgaccgtccgtcttatttgaaaaaattatgaaaaaaaataaaaaaaaaacaagtcacgcataaaatattaatcatattttatcatcgaacaacaatgaaaatacgaattataaaaaaaaattcatataagacggacagtcaaagttgaacacagaaacccagggtttgtctttttttgggatggagagagtacataccttactttcacaaacttattttgggaaaaatgggaaaagctaaaaatgaacatgttatgggctagagggagtatttactactccagtacaacattggcagctgataataatatacaacgtcatgatggtctataaagtatataaaccatatgcaccagaaagataataaaaacactagagcaaaaaatcagacattgagatgtcacagtagtgcttacttttgattttcgcaagagtagcataacatatatacatcgtaaaaaggtagggtcggaaagacagaattacagtaaaacctgagtgattcatgtatatcaatgcaataattagagttccatcttacaactactgtccctgaaggcctcaatcgaatggataagaaatcacacttgacatcctcccccagagcacatgagattgcaaatgctaaattttctgctgctgagttataaactgtaatgacatggagtacaatataactcaattgaagatctctctaacgagccaatccaaactgggataagcaaagtagaggatcaaaaaggacggcagtgcaaacaaaactgtaacaaggacatacaatactagaactgctacgcttgcagggacagcatatagaactatcagaaggaaaattatcacgagtggaaacttggctgtcatctgaacaaaagacaacattatcttttggagagatgcactgatgctgtaagtattgaaaacgttgccagcaacactcctttctctgccactggcgctttctgttcgtggagcaggtcttcgatggtgttgactggaacttgggccaccaccagaagggcataaagaatggcgctcttcatgactaggggaatggaactttgctctctcgccattcatgctctcaaccatccatagcagaaaatagttcttgcgtgggaacttgaggtttcccttgtaaactagccggaaagataacaggttacaccatggacatgagatgaagagaggcagttgtataggaagggttgggaacttgacgacagcccattgaagacccaagatgcaattcttgcacattgtatgaccgcaccacaagacatagggaacattctcaacaaggttgaaggattcccaacatattggacattcaaggccttcctctctacttgcacatgaagaaacatcatcatcagagcaatcaggattggattgactgcattttgagggctgtgcttttttccttatgcttccagctatggcgtttgacgcaaaactccacatgttgaatgagagagagctggtacactatatcttgtactcctgagatcctgctttacagaagacaaatcataacatatatgttgctccactaagtctagccactactcctatttatgttgataaaaagaaatccaagtgcaaaatgctctcataaagcaaaagaaatagcagtagataaagtagcatcatctaacttaacagatataaaagccccaaaaaaattctaaacatgttcggtagaagacgcatttccagtcaccaaatcatagaattatttcatattgtatagttttgtgggtagtccagtaatacagtttcatagtgcagtagtgattgcgaaaatggggaaacacagaatgatctgaaaaaaatgtaacaatatctaagcaaatacaaatgtactagcatgtaaggaaatgaagaagatgtcatggatatgttgttagaaaccatcaagtacagatcacatgggctttactgcacaagtgcacaataaattgaagaatcaaatagacaatgcaaaagttcatgcaggctcaaaattttaagctatgaaacgatacccaactgacagtcaacttggagacaaaaccgtttgccttctcctattacttgttcatcatcattttagtatccagagcctaattggtggagtctgagatcgataaatgcatgcctcctcaaacaaatttggttacagtttacagacagcttctagacgaatgggtttcacccagattaatgagcctaacccaatcccccagctaaatacacagcttaaacagtgtctagaactttagataccacaccacaacttcggagaatttcagcggacatgattaaaaatcataagctcttaacaggcctgcaggtgcattaggaaatggccctgatcaagatcccaacctatttgatcacaaaagttccatgggattacagcatatactgacaatactatctgctctattggtggccaccagaaccacatctgctgcctctgcttcaagtctgaaacattgagttgtcctgaactaatcaatgtccggtcatgtgtccctccctaaccagtgcacaacaacagcgcagccgctctcttgagccgcacccagtgacaagtgacaacaagatcacccgcaacatccaaattacaaaccgtatggaaattgtaagttagcgatggtcgaggatgttgtaaattatttccacagcagaaatatgaacatcaatatatccatagaaactcaaatcggcgatgtgtcctagactgtagactcctagttccatatccaagaaagacaccaactcttcaacctcaccaacaacgagcaagcgcctcacgcagactagcaacatgaaattcccgaccagcgtaagcccgcgggaaggaatcggacgcgaatcaggcagttccactcgaggattagggagtagcggcttaccgagaagagcccggatctctagcagcgcaagggcatacgggagcgccccgggagatcgcgtccggttgaaggggagacgctcatcccggcaacgtcctccgcgccgatgggtggggggaagggggctcgccggagtcgggggagcggcggcggaggagaggaaagggaagaagaggtcgtcgagaggaagaagaccacctggttctccttcgatttctcgtgtgtgaaccccccaacctgtggtaaaatctggaccgttcgctcgcctggacggctcggatggagccatctgcgtatctagaaggaattgatcatctcctctaatcaaattttaacaagacctttttattagtggcgcacttgatataatctagaaaaaaaatgatgctggtaaagctggagtgatgtgccatgtaagtgtttgttacaacaacacttcatccaacttgaaattgaactttgcatccacaaaatataaaacggacgttgcatcatatcatttccccttctcccttgacaaaaacgtcgggcaaaaataacgtaaggcttaacgacctgccgttgattttactcgacggctgattgcatcatcttgaggtaccgtggatgagagtagtatgggctatggaaatgcattggttcgccgacaaggatatgtactccctccgtcttaaaataaagcaacatcgtactggataagacacatcctagtataacgaatctgaacagtgatatattcaaatttgttgtactatgatatgtcatatctagtacaagattattatattttaggacgaagagagtatctaacgtatagtatacagagagatcgccgcaccgacagcgaggtgtaaaagatttgcgcgatagaatggcctcgtcttattcctggaacagagacgagagcaacagcaaacggtctgcttaattcccattgcccataaccataagatactcatatcgatcggagtcaccatgtgagattttgggcattcagcgattgcgatttgcagtatacgttttctgcctgaacaaggcaagaggattttgatctctcgaggagatattccatcgttctttacatgtcacttaaatagctattaaaaaattagaaaagatgtattaacatgtgatatatcacaccacaaacatgcaagtaaaaaattcaactcctacatctcgcaacgaaaaaaacaaatttgactccgaatatacattaactagttgcggtttaatttgttttttttcgttacgagatgtagaagttgaatttgaaattgcatgtttgtggagtgttatatcacatcttaatacacattctcattttttttaatttttcttataaccatttgagtgacatgaaaaaaacgaggtgatatcccctcgatggattaaaatagtttcccctcaacacggatgcaaacgcgtactaccaatgaagcaacccaattctgacttcctcgtttacacgcatcaacttaggccctgtttagtcccatgcaaaaatttttcactcagtcacattaaatgtaaataactaattacacagattgtgtgtaaattacgagacgaatcttttaagcctaattgctctatgatttgacaatgtggtggtacagtaaatatttgctaatgatggattaattaaataataaattcgtctcgtaatttatagacggaagttttgctatcaaactacattttaatactttaaatttatgtccgtatatccgatgtgacacgccaaagcttttcactgctgataacacaccccttaggcaaaagaaatgcccgttgcgatcacgatcgaagtatacaacacgtaagcatgatggtatcacgacgactacatgatctgcagcatggctcttcttcctaggattcaggtgttgttactgccgtcttccgacgatggcgagaacacgacggcgaggcagagaggcacgacggcgtaggcggccagcttgagcgcctcctcggtgtccttggagatggcgccgatgcgtgaccagtcgccgctgtacctgcagcaaagccgccccgaaacgggtgagaccgaccagatcgaccaccggtgcaaaacgcaatggaaatccgtcatcagcgcgcgcgcgcgtgcgtgcgactcacccggcgtcgacgaagccgagcgcgaagagagcggcgccggaccgcaggagggcgcccctggtgaccacgccgccgccgccggcggtggcgcctcgctcgtcggtcccggggcccttctttgcgccgcacgggcggaggcgacggcggcctgctccgcgcgagtgcggcggcggcggcgtggacggggacgggacggccttggcgacggcggcggcgggccacgccggcatgctgtgctgtgtgcgcggtggtagttgggtgtttgggtgtttgcttctcgtccacacgtgcgttagcagcagaacgtggagcgctgcacgctctcggggtgcgaggtacggacaaaacttggcactcccgccgatgcaaacggttcctctgctggtactatatatttactatagcaaaatgctactagctatgttacccggggatgcggatagggatacgtgatacgggatacaccattttctcaaaaacaaggatacgggaatacgcttatatatatatgtgtaaattaaaaatacagaaaatgaaatattttttaagggaacaacaataatgtagttttggtgcagcctatatgtcaatctaattcctctgaatctcacttctagatagttcaagttagcaaaacaattaatcttgccgactgacaataatacatggtaaaatcatacatgtatatagcagaaagaatagtgaactgatacatcatgcttatattatcaatttaagtgtaaactgcagtattgcacaagtagcatcaccaactcactaaccagaccataaaatgcagattaaacatcgaaggcctgaaaaggggatttactcacaagagaatgaagagaaaattgttcggtggctatgggttgatgctgctgcgcctgttggctggtggcagaggcgctgctgtagtgttggacacggagctgctgtggcctgtgtggacggccggcggccggcagacctagacccggagcccatgggcagcggaggtgctgccctcggctgcggcgcgcccggtcgaggcgaagctgatgcgcccggacgcggtgtaggaggcgcggcgtgatgcggatgggcgtggtgccgctcccacgtatcacggcgacggcggcggcatgggaagagtgggagcgtgtgaggcggccaagtagtagttggatggctgggttgggtgttcgacgtatcaacgacgtatccataattgttttatttatctgaaaatcgatgagtcgctggatacgtacgggatacgtatcggagcgtatccgatacgtattcgtatccgtcggcgtatcagatactgatacgcgacctgattgccgtataacgctactagtactattccgtgacaatgtatagcacgctttgcagccaaatattgttgacacagtccaagtttaatttcaaagtttttttttaaactttcagcttttccatcacatcacaactttcctaaacacacgaacttccaacttttccgtcacatcgttctaatttcaaccaaactttcaattttaacaactaaacacactcacaatagatcgagtttatgtagctcacatttattcaccgtattgttgaggttacccgtttcttgattatcactgagccgatcgctcatccttgcgttgaaaaaaactgggctgagggcatgttcgtttggacaaatcaaccattctccattagcacacttcccactaaacgatacgttttgtaaaaagaaaaatctatataaagattgtttaaaaaattaagcatatgtatttaaagtttgtaagtaattaatactcgattaattaatgcgttgaagaaccttttatttgttctgagccgttaatggctacagcactatagctaattcaaactcggcctaagtcgataagattggcctaatcctttccgacaacaagcttaaaccttggtggtgttgcaaaagaagtaagtcagtgtttggaattaatgcctaaataaaatcatgcatgagcttggattacagctagaaaaaataagcattttgccttctttttaattacatgatattgtctccttacaattattgctattatattattgcaaattaaaaacatatcaatatcaatatttaatttgtttttgtctttgtttgggttttgggtcaaaatttgaggaccaagtacaaccggtacaggctccgatagagcttcagatgaataggcttgtaaatggtaggatttgtattccttctcaaatatactctttagttgttttaaatatattattgagcatttatttctagggcctatctgcacgacacgtatccttgcaaaatcattcggattttcgaaccgcatggttagcatccaacggttccaagtcattcccactttagaataaaaacctatgaaccctaacttctaacctctccctcccactccctctcgagcatcgccgcttatattatcctaaagcatatcaatccgggccttctctccaaccatcattgctggctaggccagttgagctacctctgtcgatgctagtaatagtaagaagcatcacgtcacttgccatgttgtctcctacaactttcatgagaagctatcatgtcggtatcgtctctcgtatccagtagtccctttttagatcggctttgtagccttcctcatcatttcgttattccaagatgaaagtcccaatcaaaaggttcattgggaattggcgtagatgctaagaaggatggggtatggtgaggatcttcagttgaaaaaagaggttatagacctgaattattattttccaaacgaaatttagaacaaacgcgttgattgtttagtagatttcaattgtattgcatttatagatctattcttagtatactggcaagagttagtagtagatctaagggcacccgcaatggttatctataggctctctataagagatccatgtcagcttattttcctacttggaagatattaaatgaagagagagagagcaaagctatctactaacttagagatagtctatagagaaaaacgaggtaatgcatgagagagctatagatacccatgtagacatactattgaggtggtttactattaatctagtctattgctgagatatacatgttttatagagagcaccttactttatcattgcgggtgctctaagtacacaattttttaggtagcaaaagttgcaccaaagtttactaaaagtaatattggcttaaaaatgggtataacatttttcacctttcaaactatgtcctagcaacttgtctccatataaggtattatataattgtagggcaaacttatcggaaacacacaaatattgttgataggaaaaaactttattaagagtacacttataacgctttctcccattgcctctaggattagttaaagtgaactcctcataactaaactgactcttagtattttcgagttgaattgaaatttcaccatcagccacacctagaatgattgtggaaacatcccaagttgcatcaaccgtaaaccatggtatgaagaaaatccgcatgtagtaattttaaagtacatacccctctgtaaaaggatttaccactgcattaacgtacccaagctaaacaagctacgactaattcgttgtctatatattgtttagtacaatccaactgtattgtatttatagatctattctttatttataaattagcaagagttagtagtagatctaagtacacgggtttttgatagcaaaagccgcacaaagctgacaggaactattgcatatgcctcaactctaaaagtaatatcggcttaaaagggggtgccactatttttcacctttaaaaacatgtgctagcagtttatccataggaagtataccaacatcatggttggacaaacttatgggaaacactcaaatattgctaatagcaagaaattttactgagtgtacactttaacattctctcctctagcatcaaaagcattcatcgtaagaaacaagttattccactggtggagaaattgtctttactcccggtttataaacccccttagtcccggttttccaaccggaactacgaatctgggactaaagatcgctatctttagtcccgggtgaaataaccgggagtaaagatcaatctttagtcccggttggtaataccaacccggactaaagagagggatctttagtcccgtttggtgttaccaaccgggactaaagagaggatagggacagtcccggatggtcccctttttttgttactttttttattttctcccgaatcggatggcatgcacatcccaaatcaaaccccaaatccctaaatcaaagtaacatcctaaatccacatcacaaatctcaaagtcatttatacacaccaatataatacatcacaaatcctaaaaaatttacacacaaatcaaatacaacacagattatacatcttaaatcaatataatgaatcacaaaattatacatctcagtgaatcacaaaatatcaaaaaaaagagagagaaaacaagctgccggatgtgctactactcaagaaatcaatcacaaaatatcaatcccactactgccggctgccgctatcgttactattgcgcgcatgtgcttcccctgcaacgcacgtttgcgccgcacgccgcgcatccgtccgtccaccacgtccgcgcggcgcggcctcctccatctccaggtgagggaggaggaaagggaggggaaggaaggaggaagggaaggatctgtgtaagatccatctccaggtgagggaggaggaaggggaggggaaggaaggaggaaggagaggatctgtgtaagataggagaggggaggagggagagaagagaggaggatcgatctgtgggtgaggtagtggttgcgagtggaggagaggataaggactatggattatatactacgtgtttaatttattaccaaccaggactaaagatctaaatgatctttactcccggactaaacccggactaaagtggtaatctttagtcccggttggtagtatgaaccgggactaaagattctcggccccttgagatgcctctgacaggggatgaaccgggaccaaaaatcatctttaatcccggttggtgtgatcaaaatttttttaaccgggactaaaaatcgtatttagtcccggttttaaatggaaccgggactattgtcgaatttggtcgaccgaccaaagatggtttctccaccagtgttcatatctaaactgaggttttctttcctaaatgaattttctaattcaccgtcaaacacctagaatgaccatggaaacatcccaataaacggggctaagatttacctaatctgacccgaggacaagctcaagccttggtgtttgaaaataagtaggctggactttcaaaatcttttttttaacaaaaaaaatcaagcctgagctcagagtagagctttgttattttgtcttctttttaattacacaatattaccttattattgttattgctatcatattattctagatttaatatatatagatataaatatttaatttgattttgtgtttatttggattttgggtccaaatttgaggcccaggtacgaccattacagacttcggcagggctatatcaattagcttgttaacgatgggattattttattccttccaaaagatatttgtagtcatttgaatatattattgagcatttattgcttgggattatctacacaatatgtatccttacaaagcattgggattttgggacgtgtgattagcatccaaaggttccatgccatttacattaaaaccccaggaaccctaacccttccccttccccctccccctccccctcccccctcctcctctagcgccgccgttgatatcatcctaaagcataccatactagaccttctcttcggatgtggatgttggttaggtccgtcgggctaccttcattgatgctagtaatagtaagaagtgtcacatcacttgccttgtcttctacaacttttgtggaaagctatcatgccgtatttcttgtatctaatgatcttttttgagatccacttcattcccttctcataactacagcttctatgcttctatattgcccgtcacatctgtctcctagatctatcggcaccaaaattgtatcattatttcgttattccaagatcaaagccccaatcaaagggttcattgggatttgccaatgatgctaagaaggatggggtatggtgaggatcttcaatcgaaagcaccggttagatatctgaattactattctccagaacaaaattataacaaatatgttgatcgtttagtatattcctgttgtattgtgtttacagatatgttctttgtttatatatttgcatgagttagtagtagatctaagtacacggattttgggtagcagaacccacataaaatttacaagagctattacgtctttctcaattctaaaagtaatactggcttaaaaggaggcacacaatttttcagcttttaaaccatattcgataaacttgtgggaaacacataaatattgttgataacaagaaattttagtaagggtgcactttaacattttctcctcttacatcaaaagcaatcaacttcaaaagtgagctcctcatagctaaaccgaggtttagggtgtgttcgctattcctagttggtaacttggaacaatactcacagaaaacggagcggttcattagtgcatgattaattaagtattagctatttttttaaaaaaatagattaatttgattttttaagcaactttcttatagatttttttttgcaaaaaaacacaccgtttaacagtttaaaaagcatgcacataaaaaacgagggagagaggtttaaaaaagtgggtgccgaacacacccagtctttgcaagatgaaatgaaaatccgcatcaaaccacttagaatgaccgtagaaacatcccaaagtgtcatcaaccgtaaaccaaggtaggaagaaaattctcactaaagtagtagtattagtaaactacacacccctctcaaagaatttaccactgcgttagcataccgaaactaaccaagctacgaccaattcgagttgtatgcgatcgcaatttctgagaaaatccaaatgctccaaatcacacgcgctgcaaaagcccgcgaccgcatatctcggtggctggtcgagcacgcctgcatcgcatccccattcccccacaccgcggccgctccagcacgccacgtctgaagtgtttcagacgccgcggccaccgtgggatcgaggcatcgacctcctcctcttcgcactgcgctgcactctctctcgcggtcgcggtcccggtccaaaccaacccaaaccaaaaccgaaccaaacaccgacccgcaccgcaccgcaccgcccatttcgctttgcacacctcaaccctcccgtcccctcccctcctctcctctcctctcctccacgccgaccactccccatccccatctctctcccctcaccgccgccgccgccgccgccgccgcagagcaggacgcttcgggtggcgcgggggagggcaaggccgatccgaagctcatcggcgggaggttgcccccccacgcgatttccaccggttccgggggtgggggttcgatccgcgcggagccgacggcgggtgcgggggccgtgccgtgaggtccgccgccgccgccgttcccggggtgtagggtttttgggttcccggcccggcgagcgaagcattggttggcgtggccgcggcgggttgttttgtttttttgctatggggatggtgcccaacgggctcctgcccaatgcgtcggccggggtcacgaggcggctcgacggcgagcggtgggccgccgcggaggtgcggaccgcggagctgatcgcgcgcatccagcccaacgccgactccgagcggcggaggcgcgccgtctacgactacgtgcggcgcctcatcacgaactgcctctcgtgccaggtatagcgatggtgtttgactgctggattgattgttccgagaggtgttacggattattagattgaagggtttctctgcgtggcttcgtgagcagcgagtgagtagagcacagccgttcacctgactcggttgtagtggaatcgaccggattaatgatattggcataagaggcagattgatttctatttctaagtaagttctatttgagcaagggacactggttagtgccctattggatcgttttgtgctttttgttcaaaagtcggaaggtcttgcttccaatagcacttgcatacaagcacatggggggtatcttatcttcatcattgtttgagatatatgcttttttttttctttttgcttcagatcatctgtttatactctttgaaacttgtttacacgccttgagttctcatccagtggagacgatgacaaggattaaactgcattttgggagaggagtatgattttgagatattcgatagtctattgttgaactgtttttcacagtaacatccatttccctgcaacatggaatgcatcagagtagcagttatcatgttaacgaaaagcttgtggaactacaacattgaccttagaggaaggtgatgatatgataaaccggcaaatcttcaagattcaaagtcgtagtcaacccatatgcatatgtgatgagcgacttgattggctgattgaatgaccatttttagtaggtgtgtcgggcgatagcaacgtttaaatagcttcttgtttcttgagaaatggaaagaaacttgttccatcatctttcttccttaagtccaaaagagtattgcacgccttggagctttcgtggtcttaagtttatcatttcaagtgtgatttttttattgattatatacacctgacagaagttatctatttgtgtctctaggttttcacatttggatcggtccctctgaagacttacttacctgatggtgacattgatgtcactgcttttagtgatagtgaagaattgaaggatacttgggctaacttggttcgggatgcattggagcatgaagagaaaagtgaaaatgctgaatttcgtgtaaaagaagttcagtatatacaggcggaggtagaacccttcctctgaatttttagttttggaaaatggctattgatccgtcatgtagcagtcttgattttttttgcagctcagaattattgttgttcctttgggtacatggatgttaaagttactaatgattattttttgcattttctgccacatgaagcaaattagaataagcaaaatatataatacacctatctaaagtgctggctatattatactcttcattttttgctgatggagttttacatgtgcttctgtttctaaaagaagatagcgtggaaacttgaaactgttattttttcagatgccatgaaattttaggcgatccactattgtaggacctgctagcctataatcctgttactgcctggtgtggacattcaagaggattgtttaatgaaagatacttttagcatcctactaagtacagggaaacacattcttttgtttactcatttttgttttcatggtttataatgtgtcaactgtctcactctgttgtcatctctttggtattgttctcatttatttgtgaatcatgtccaggtaaaaattattaagtgtcttgtggacaacattgttgttgacatatcatttaatcaagttggtggattgtgtacactttgtttccttgaagaggtgcgctctcttgttcaaatctagctgaatgtatattgctgtttggttatccttattgcatgtgtttggaataaaaattatttgatttttctgccttacttgcttcaatggatctacattaggttgatgccttgatcagtcagaatcatttattcaagaggagtattatattgataaaggcatggtgtttctatgagagtcgtattcttggagctcaccatggtcttatatctacctatgcattggagaccctggttctgtacatttttcatgtgttcaacaattgttttactggaccactggaggtgactactggttcttgcactttactatcccagcacgagaaacaattcttatttgctacttatgtgtttgtaggtattataccgtttcttagaattcttcagcaactttgactgggagaaattttgtttgagtttgtcgggtcctgttcctataagttcacttccagatatgactggtaatctatatgctgcttactatgacttctatatcaaagttgtttatacgattgttattttacattttttttcaacgttattttgtgcagcggagccaccacggatggatgctgctgaattgttgctgagcaagtccttccttgataaatgcagttatgcatatgcagttacacctcgcatccaggagagccagggtcaacaaccatttgtttcaaagcacttcaacgttattgatcctttacggacaaacaataaccttggaaggagtgtaagtaaaggtaactatcgagcatcaacttacatagtgcttctcttattgaagtgacatgtaccgaacagagttcagtcctggtggttttgtatattactatactatgaatgctaatctatatttttgacaagttaaagatgttttgacttcctaagaattcatatcgcaaacatgctaatggctatttaaatacatggtccttgtaataactgtacttgttttctctttcttttgtggaggttctgttttgctgacataagctgtttgacaataagccaacaaacagttctttctatattaaatacttccagattggatagtgagcacttttctagtaactcatgaaactcatcatttgctggattactgggattcatcttgcgagtataaaaattccttattgttatgaacttgtgatgcatctcttgtcaaatgtacactcttcaatatgttggctttgtggtcattttgatgctgtggtcaatccagcgtcaagtattgaactgtaacgggccatttgactgtatccagcggaagttctatttctgcagaaaaaacatagtacatattatgttgagttgatgagcttcttcttttgtccaggcaatttctttaggatacgcagtgcgttttcctttggggcgaaaaggttggcaaagttactcgaatgtccaaaagaagatctaattgctgaagtaaatcagttcttcacaaatacatggataagacatggtagtggcaatcgtcctgatgcacctacactaggtctggttcatcagcatcatctgaaggttgtccctgctgaagcatcaaatagtcagagaagtgcgatggcactcaagaaaaacgctgaaaatcctaatattcgtgctaaccaggataatctcagtgaaaatgctaatagctatcctgaagctacttctcagccacttcagagaagtgttctacacccgagaaattcactgagaacagtcaacccttctgattctcatgctcatcaccaaaaagttcatgtgacacatgccaatacaaaggtctctgagcagcttgaaagaaacagttctgatggatcaatgcaaaatgaaaggaacaagacagtaccaaattctctctttgttaatgatagaaatgggcaaaacaggtctcggtttgcaagaacccgctctagtcctgaactaacggacccttctgttgaaggatattctcgtggaagacggactggagtggttgaaatggacaaatctttgaaggttgattacaatagcagaagaaacaacttggctccagaagtttctagcagccacatcactaagtcttcacaggatgagtcagtgtcttcgatgaacagttcatctcactatagtgggaaagcagcttctgactcaaacagtgtgtcaagcagctaccgcgaagataatggtttcataatgaacgaagaacttccttctgtatctgaggcatcagataaacagcaagaggagcaagtcctagttaatttaatgtcatcagctaaattgcatgacttcaacgggcaagttcaattgccaatagaaatgccgcctcatttttcggtggcaccctcccctttacttgcaccagcagcttttcccccaaaacattttgctggaattccaccaactagcttaattggggctccatggtccaatatgcatttgatccatggatatgtttcaccacccatggcccattatgtccaaaaccatactttcgcaccaaacatcgaagaaggtaacgagagtgagaaacctattacaccagatgcgagtcgtgatgatggcaacaattggcatgagtatggtgttggatttcctagatattttaatcatcaaggaagagatccacagatgcgccactttaatggaaaagagcattcctcttcacctaacagtgtatctggtgccccctttgaaagacagggagagattgctgttgaggataatggagcagtagaagagaattataccaacatgtttcaaaaccaaacaagtagacaagccagcataaatactcgaataggtagtggaaatgcaagaatcccttcttcacaatccggtttgtcaagaaacaaagctatgcctgagaattcatggggtgaatcagctggaaatacaacaagatcattgagggacaaatggggaaaaaggcctgcctttgcagcacctgacacaactacacatagcaaaaataatactggttggcagactggaaatgcttctgagcatatccccccagaggttgatgatggtgcccggaatggggttatagtaccaaacattagacatgaggcctctgacataataacagggtctggctcaacagcatcaagaactagtcaagtgccaaatgattttgaaccatcacagattggcatgcctaatccactgtttgcacctctttttattggatcccctcagcagagacaatctggtaatggcggactgacttttattcaaacaggtccagcggttccttttttgatgttgccatatgctcctgggaatgatggatctgttccacagtttgagaggaatgaaggggttgatcaacttcctgtcaatattgctgtccaaaattttagttcactcaacaatgttcaccatcctgatatcaatgctacctcaacagcttcatccagtactgcaggtgatccatctgaagagcaaaagcctgacattttgaacagcgattttgatagccattggtgtaatttacaatatggacggtcatgccaaaacccgcgccccatgaatcctgtgttatacccctttgcagtgccaccaatgtatttgcagggccatgttccatgggatgggcctggcagaccagcttcaacaaatgttaactggacccagatggtcccccccagccaacgaatctatcctatgatgcctctacaaccttcttctgaaagaattactggtggtccacagcaccacacggaggatgcgcccagataccgtggtggcacaggaacttacttgccaaatcctgtaagatcctaactagctgctttgatatcttaatgcatagataacatgtttagttgtttactattggtatattgaaaattaaaacatattctatcacatatatagaactctaatatgatgctaatctattgcaaaatggtcttatcaaccatagcttctaaattatatcactgattctagcttttgtaacagctgttataggcgacaagttcacagctaacaagatgctactactcttgtaacaatctagtggaaatgcgttaatcataaaaaataaagtctgtttaatttgcgttgaaattgtgatagaatctaaatctaatagaaaacgaaggtgataaaggaagtaacaaatttgtaggaatgtataatgacaatggacaacattcacatattctatgtatagcaaactagatgtgagattcatggttcactggtgaggatggatactcagctacctggatcaacatacttattagttgctgaatgatgaaaactcttgagtttatttatggttgaatttaaaatttttcaggatgatggaatttaggcctagcggttgtatcttaagtgcaataatttatttcattttctataagaaataaaattcattaagcaatcctttatgaatttgatagtctaaactttttttttgtttgaaaaaagacactttaagggagccccccgcagttaaaactttattcaattatactattaagcattaggttacaaaagttcaatccagttttctaatacatctctctcatgagctgataacctatataaaatcacgaatatagtctgaactggttgatactaattcgtcaattctatctattgcttttcttcttcagaaggttccatttaaggaccgacactcaggctcaagaaaccacagaggaaattataacactgacaagggtgaccataatgataaagaaggaaattggataaattcaaaacaacgaaatcctggccgcagctatggacgtagccactcagagaggtctggcatacgatcggatagacaagcagcagatgaaaaccagtatgataggcagcggcgatcttatagaaatgattcatacaggcatgagacaggcgcccaatcttctggatcaacaaactatatacgcagaccagggaacatgacacatggggatccatcaccatctgcttcaaatggtatcggtgccctttctgggtcttcagctccatatttcatgtactactcatgtgaaccaggcacaaatcacggttcttcatctgaaccacttgaatttggttcacttgggccagttcctacagctgatggtggtgacatgccacgacccactcgccaagcaatgcccaatgagttttatgggcaaaggcatgttgcatttaggggtggctcctctcattcatctcctgatcaaccatcatcacctcaaactcgcaggtaatactctcttctgtcccctttgttgtatcatggtgtcggttttcagtctttgaagtttgattatctgaacaaaacaaaccaaatcattacttgtactacagagtttatcctatttctagaaaacttgtggttgttccttacttaagtgttgcttcctggtagtcaacctagctaaaatcgacaaagttgtatgcctgctaaataagtcaaatctgttagtaagtgcttatgtgttgaatacactggcacatcacgtgagatggatgcagaaaaaggtaggaaaactggcattgaagagaatctgcttcatataatcaggaaagtaggaagttttagctcatttaatttttgctcttcaaattccttttttgagtttttcactaggtacagaagttcttgaaagtctgaaaattgtttgctagagatcaaacttgtcttaattggacaagacacaaaaaagacaattaccagagccttttttgtgagtggcttttccacggggatatggaccaggaattgtgggcttccaaatcagaccttcagtgaacaaaacttgacactgtttactaagtattcatccttttcaaatatatcaaatgaggttgactttggtcttgaaatttttcatgagtgcagactattgaatatgccctagtaattttttagaacttatagacctagtcaaaatggattttgcaacacatgcaatttgcgcagtacgtcccataagcacttccctcttccagtagtattgatgctattgcaagctaatttacaacagctggagtctgttaggaagctttaagttcagtagttaacgtgtcaaaatgaacagagtaaatgtcctccataacaattgctccctccgtttcatattataagttgtttgactttttctattcaaattttgttaagtttgaccaagtttgtagtaaaaattagcaatatctaaaatattaaattagtttcactaaatctaacattgaatatattttgataatatgtttgttttgtgttgaaaatactactatatttttctataagcttggtcaaacttaaagaatttgattcggaaaaaagtcaaatgacttaaaatatgaaacggggggagtaattaaattgtttcctaatattaccatatgtaactttaacctatccagctaatattttgctatcaaactataatgtttttttctggatatatcatgtaatgcactagtacctctttgatcatccgctccattgacacaaaccctctttgatgcaaaaaatctggtgataacatgaatggcatttcccattttagtacctgccttttactcattattctctatgttcagtttttgaactttggctgcattaattattctttgtgcttccatgaattgctttcgtgataattacttttactgatatttttttgttatcatcaagctgaaagtttatgtattttattccctttcaaggtagtccgttctgatctcctaatctgatggctggtcgcattgaatccggtgcttatggttggtttggtgatgagctacccagaaagcaattgtgctctggcagctgataccgaatacttttagcggcctcaccagaatttacttcagtccgacgatacatcagatttatcatagcactacctgatatcggcagcaccaaccttctgatttctgaacaagccatacaacttggaaccctgaatatcttcatgaagaattaacctaaaggataagctcgaggattaactgagagtgccacccttctctgtaatattaccgtcaaaagatgactattaatgctgaaggaaggagaaggattggcttttcaaccttgaaaagcatggaaaattattggtggacaaatgtaactgaatgaatgagatattctcttgtctacaggtagaagagagatcgtgtactctagtttacatacaacaaaacttttcacattagatgtactagattttaggcgaatcctcaacagcaaattgaacggttctgtttctagcatcctttgactcagtaaaaaaattaaagttggtactcatttttctggtgtctgcttgtttattcctggtgcttgcttttaccttgggtaatctgatggtataatttattcctgaggttgcttcatttatatatgctgtcactcgttgaaaccttgatggatgaaaaactttcagaactgcaggccaccggcagttgtatatatacttcccttttgggcgaaccaccacaaaaaaagagaaggaaagaagaacaggcagagtgcttacggtaagacaagaaacgaaaattttaggaagcatatgagaggttatttaacatatgtgggcgcattctgaaatgtctgattacatctaatgcatcgtcggatttctgtactgaatctgaagaaaaaagaaagagtggaattgtctttgagtgtttcagactttgttccttcctacaatacagaacctgtgctaatcaggctaccaagagtaaaatgccattcctggatctaaacatagtggtggtactggtctggcaacaaaagctgtatatatgcagtggcaaaactccaccatggtggaaaatggtctacacatttttcactcttgtccagttcttttcttcagctctgcgatgaaatcctccttctcctggtccgacatcccctccgtcgagcagtccccgacgccccactcggcgccacgcaggcagtatttatcctgaatctccctctcattcctgcaattttttgataaattgttcagagacccatggcaagaacatggctgcaggagagcttcaagagaaacagggctagcgaaaattggggtacttcagtttgttctgcttggacttctcgagcagatccttgagcacttgggaagacttgaacctggagtcgaactcggcgtacttcttctggttctccgcttgagagcaccaaattaagagaaagtttttttttatcagcgaattcatgtcacaacagaagtgacaattggcaggaacattacaggaactctcagcgatcgagattcgagagagatatggcatgcatacatacatacatatatataggagagtagtagccagtttgctaaccattccatttttccaagaactccactcgtggcagatctgggcctggaaccgattccatccctttgaaccctgacatgatgccagcatgtactgcagaaagaaagaacaatcagcatggctgtgcggtgccaattgtgtcttgtgtgttcatccattgttccatgcatcttcagttcatgatccaactatctaccactccctctgttctatatgttctatattataagtcgttttgactaaatttttagacaaaaatagcaatatctataacaccaaattagtttcattaaatgtaacattgaatatattacgataatatacttattttgtgttagaaatgttattagttttttttattaaaattaatcaaacttaaaataatttgcctagtcaaagcgacaatacgaaatgggaaacggagggagtagcgtatacactaacactatcaccgcttgcttgcaagctgttactagtcacttcagctgtgcctgtgtgccggtgtgtacctggactggaccagaggacaagtgagagcgaggcggcggccgctgggacgatggccagtggaagccggccgacgtggccagccgtcttctccggcgccgacgtcgccgcggtcgcggcactgcaccgccccctacaccgcggcgcggtgacaggtgacgcggcgacgaggccgcggaggccaagcatggcgataactctaactcgcctgctggttttcctcctgctccgctcagtggtggcctcgcccagcgtagagagaaggatggggttagtgggttggagactgggagtagtcaggctgctgatgggaaaagatcgaaggatgggtgccgacttgttctcttgtgagccactaacagcgagatgactgggtcttgcctctggggctttgccttgatttttttttaaaaaaatagtttttaatttattaatagatctttccaaaaagtatttccgaaaaatgccccttttggccactccagcccgtctggctagccaaataattttgtcacaccacacgtggctggcatgccggtgacagcctcttgccacaccagaaggttcagattttaaaatacttttggaaaaaggtctattcataaaattaaaaaattaaaaataaaaaaaatattttgcctttgggatattttttttactcttttctcttttgaaacagattattgataggttattgtcatatattatccatttgattataatgatatattaaatattttacaaaacaaaattaataaaaatagcttagaatagagtctaatcaatgtggtggaagaaagtttgttgagaaagtactatattttatattttatagatgtggaccagataatccgtgatagtagtccgttcaaggttttaaatttttaaatattttaaaaatatttttaattaatacttaattaatgatgtagtaattaatcatttcgttttacgtggacgggtgaaaagttttcaactcttgcattccaacgaagccttatagatttggccttgtaaatggtgtgtgttttttttcttaaaacaaagcattatgattttgctataaatctgttgacaaatttcttccttagaatttgtcgatttttgaaccgcttgatgaacctcgggattcgtgcttttgcgtcgacgctttgatttgtttctttcgatggccgctggctaccggcactggcgcggctcatgcacgcgtagatgttagacgaagggcagagataaagcggcagggcatagccaaacatgcatgcatgaatgatggcctccacacgcatcgtacaaacagacattgacattgcgagttcgtaatgcctctttcacgtgagcagtgccaaacataagttttataaaggtacatctcacttatattatagttacaatgtaattacatataaataaaaatgtaattattatagttacagtgtagttatactaaagttacagtgtagttatactatagttacaatgtaattacatgtaagttacagtgtagttattctatacttacagtgtaattacagtataattatattgtatttatatttaataaatttttaagagaaaatttgtcgacaaatgtacaggtagtcctaagcctataaggcctccgtatgatttggcctcgtgtaacagatgacagaacatcgcgaccgtccgtgtcttgatcggacgtttcagatgcgtccacccaacgctaacctcaacttgaaagctgatgaaaccgaaactggattgattcgcctcaaaaagcagagtaccgtgtaataacacacttgacagttgacgcggcatcgcgagaaatttcttcttctccttcagatcccgagctaaagctagctagcttacccagctcgcgcgaatggcctcctacgacggcggcggcgacggccaccgcggccgcccgcccccgcagcagcaccgcccgtcgtccggcggcggaggcgggggcggaagcggcgacctggcgtcgagcgccaagctggtggcggaggcggccaagtcggtgttccaggaccacaacctggagaaggtcgacaagggccgcgtcgcgggcgccgccgccgaactcctccacgccgcctcccagtacggcaagctcgacggcaagcccgctggcaactacctcgagaaggccgaggagtacctccaccagtacggccgcaaggagggttccgccggatccggcggcggcggcaagtaccaggatgagggcggcgagggcaaatacaagaagaagcccggtcatggaggtgggaggtacgaagaagaagaagaagaagattacaagaagaagcctactagtggtggtggtggtggctatggaggaggaaggtatgaggaagaagataattacaagaagaagcctactagtggtggtggtggctatggaggaggaatgtatgaggaagaagatgattacaagaagaagcctagtagtggtggtggtggtggctatggaggaggaagatatgaggaagaagatgaatatagaaagaagccgagtgggggtggctatggtggggggaggtatgaggaagaagaagatgattacatgaagaagccgagtgccggtgcgggtggatatggaggtggtggaaggtatgaggatgagtacaagaagaagcctggtggtggtcatggtggagggaggtatgaggaggatgatgagtacaacaagaagcctagtggtggatatgggtatggtgcttcaagtggtggaggccatggtgggaggtatgaagaagatgactacaagaagaagcctagcgcgcactccggtggcggcggtggcaggtatgaggaagaggaagggtacaagaagcctagtgcccatgggggagggaggtatggtaaggagaaagaggaatatgccaagaagaaaaagaagcatggcaaggggtcgaaggccggcatggcatactacctgaaattggcacaaggtctcataaagaagcaagccggtaaggggaagaccggtgccggcggtatgggtgactacttaaagcttgcgaaggggttcttgaagaagcgctgatttgtaactgaatctatgatgtctcatgaattgtgaaggaccttgctgtgtttggttagtttcctgttctacttaatgcccaaatggtgtgaaatcatgtacgatctccatccggttatacaataaaactgtcttggtcagttggtcatgttgtctctgcattgtaacacgaatgcttagggtgctacccatgaattcgggggaataaatattggatggaaacctgtgttgctcatgttgtgtgtgccattcctgactataattaagtattataatgctatgcagatgcatttttcagagttatttccttattggttcatagttcatagttgacatattactaagttatgttttcagggaataacaaattagccgtgttgtggagtatgagggtaatctatcttaccatactggactatcagttaactaaatttgggttgctattaaggtttgctgggctcaatagaagaaaatgctcttttttccctcttccagaagtgttttcacttgattgacaatggtttcatctttacaaaaatccctttttgatcgataggctgaattattgttgttatgcaagttatgttcatatgattcatggactattcctatcctacctataagctcttatcttctagagacagtcatcaactcctttgttcactcctttgtttttaggctggtcactgaatattgatgtctcaatgctaaatggttttatgcctaaacgattcagtatattgttcaaatacttagtgataaatagttgtctaactagaagaagtatttaatctttaactcgaatctagtgataaactatttaaagtagacaatggattatttagcaaaaacattataaattctgtttgaactctgttatttcggctgtttataaatcacatattgttaacaaaataaattcgaagatgattgttgaaacacatcctcagctggtgggttagtccagggcagaaaataggtggttttagagtgacttgaatgaaacggtggtactattcttagaatacaacaaagctttaaaggataagattcaaaaaacagaaaagaaaatgcagactggataccagctggttcccaactgcaggccttgttcttgaacttccatgatctaattattatgccttcttccttctcccaattccatgataaagagaaaaagcaccactcaagaagaacatgaataaatggtcaactctagtgttacctttacaagcacaaatgtcatctccttccactatggttgaatatctctgcaatgtccatcttaccttatttgcagctgcaggtgcctcttttatgctgtgtgatctgttggtactaattccaaagcttttcagacaacctgaatctaattgatttgagaaatagaggtgtgataggatcagcaatcacagttggtgcttctgccatcttccctggagatgtactgtctagcgctgaggtggtggcagcagctgtatgttggcttaccaccatgagttcagcaaagttgtcaagcgctgcgctgctccctgctggttaaacagctgacctcctcagcttcccattgacttatggctagatgcatgaaggagaaattcttcagtcgttacatcgagaacgctgagggttacctatacccgtttcgatcttcatcaagggtatgtgtcaacaaagtctgatgatgaaggtggtggaatttgcgtctgaaacagcgaaacaaccaaaaaaaacccttccatcagtcttcaccagaagaacaggaatggcttttggtacagcaagcctggtagtcatggttatttggcttctgataatttctttggtgatggtggtcatgaatcagaggaaggcgatccaggggactacataaagtttgacacagatgttcttgaagaaacaaggtcagtatgctgtcatggaggagtcacaggatagtttgaggaactacctgaactaaccaaggctcaccaggaaatactgagctcatttccttgatccatggggtgtcaatgttgcatgccttcatggaattggtattgatgtgctcaatgtttggtatggccaaatatctaaggtaagtactacgctttaggtgtgtttgttttgagtcaacattgcagctgctgatggatttcagtaccgaataatgtaaattaatggaacatcatgtgttcctttctatatcctgatttaaaatattatgctaaatattatgtgttcctttctatatgctgctagccactctgccaaaattagaacgtcctaaacctagatgcatcattgttttttctccagaggtttatattttcaataggcagccaggcaggttctcttcaacttgggcatggttaagcatcatcaaacaatcaatggatgcgtttatatgcgcaggaaaattccttcgtgtctgaatgctccatgaaagacgatacaacttgttcagcaaaaggacatgcaactcagcagacaggcaccacccaaccacatgcaaaagaccatagacgaccggatcacatgtcccctagaaataggcaattcagaacgaaaacacatactaaaatgttcacattgctaggacatcatccatgtgaaggaccggatgagagaacatgcaagagtgtcttttgtcaggaggaacaaattctccatgtttccaatatacaaatctgctgaatcacagcaccagaaatcaccaatgtgtcctccagagaatcacacaccacatggactcaaaaaaaatggtaagaatgaaactatgagataacactgatcaattcaggttcagaactcctcaactgcgatgccttccctggggacctcataagcatccttctgcctcagcttcttcacgccggctatgaagcagatcttgtcagacctgaagctctccaagcttatgctagccaccttcacccacacaaccaccttggtcttcatgccttcgatcgcggagagcttgcctcgagacagagtcaccttgacacgaggcgcgtaccgtatcacggatgaatccttgaagctcacctcacagggcttagacaggtgcacaacaagcttcgagcttgtttgatcatattcgtagcagatgatattccgagggaagaggcctggaggaaggttgtactctcgcaggagatcagagagtgacttgtttggtttgcctggataagagaaaatggaagtcaagtctcttagttcccactcttatgtaaaattcaacttctctgcagatctaacatactgataggcaaattcagaaggcattctgagctattcagggaaattcaactgtggtgaattctgagtgaaatacaaaggtaaaatctgcattacataaaacttgaatatcatttctatgaacaaaattgcaaccaaagtgcacaaattcatacgagtctcaattctcaactctcaactgtaggaacaaacaacaaccttggcagaacttgaggagcagcacacaatattgcatacatctgttctctaaaaaaatagaaaatatataactagaagtgtcataaaacacacaaatagatctcctttgcaagctggcatactttcttttccccaagtcaggcaatgtattaaaaatatgtcatttttatgttttcatgtgagcaggtagattaggatactgattatgctaactttttttctccactgaatacctactggagtatatatcggacatgtatgaaacagaatatgcattacagactggcaagttgcaaatcagctggttggtgtctcataaaaccgtgccatacttaacacaaccttgctaataccgccaaagacttcaagaggaccaaggcaaagattgcaagtaaaacaaggtgttaggtgaacaattctgttagacaaatcccctttcctcttaggagcttttgcataatgtcgtcaacagaaactggacccattgccagccaaagcacattggtagaatgtcacaaaagtcttcagtttggcccccccatgtgcattactgtataactttgtagatcaaaaagggatgaaagaaaaataaagaaaagctatatccgaactccatgcaagaaaagcagaaaagttagaacaaagcagatcactttgcattgttttggatttacgcattaggcaagaaaagcagcattagcaatttggcaccactaataactatgtacaattgtactaagcataatgatttaccaagacaacacaaaatgcacacatcaaggtctgcttcctgtcttaaaactcactcttaatttttatagccacaaatagaacagaattgaaaggaacagtatacctttgagcttgtcgaaaacccatttcgccttctcctcaacagtgctcgagagacgctgaaaatcacaacagttaggtttgtcagtgtgatgtgaatgtcgaacctaaagtgcactgtagcagaatttcctgtgatttgaacctaaactgcattgcacagaagtaaagtgcagtacagtcgaatcaacagggtcattttcatgcatctcccacaagaaaagtgaagcaaaaacaggttgcagaaacatctcgaagaactccaaatgaatcctaacactgacaccaacaataatgtggaagaacaaatcgtgcattcgcacaaccaaactgttaatctccagaaaagaccagatcatttctagacggcagcttcctcagattgtaacagaaaacagcatctccaagaagcaagccagcgaacaaggaaaccaagaacggcattgattgatttcagtagtccaacaaagattcaccaagcaaagaactagccctgatataatccaactcccaacagtctcaacaaaccaatcaaacagaaaagcgaagagaaggcaagtaatacttacggagatatcgccgccaatggcggagagctcctgcttggccttccgggagatggtgaagctgccgatcttggtgagcgccttctccatgggtatcccttctcgtcgctcttggccggaggctgttgtgtggagtgtggacgtgtagacgacgacggacggcctctgcagtctgcagtctgcactgcgattctgcgaatgggtggtggggtgccgcaggatgggcgacacagaaccgggttcaaagctctggcaccctcctcctccggatgatcccaataaataagcagccggctcggggatcgatttggtggtggtctggtggacctacggcgccggatcttctgcggccaaagagttgctgcactgtttgctgcgtcagatggcaggaatttgctcgctttttgttgcgttttactcggaggagaaagaaagccgtttgtttgaactcgtactgccgcgaaatgcacagtggatttcggccttttcggtcaatttaccgatcggcgttcggtacggggaaacgtacagcgagggatcggtaaattgaccgaaaagcctcttttcccaactcttctccctcgttttctgtacgcacgtatttcaaactgctaaatggtacgttttttttaaaagtttctatatgaaagttactttaaaaaaatcaaattaattcatttttttaaaaataattagctaatacttaattaatcacgcgttaatggatcgtcccgttttccgtattactgtaccggttgggaaccgcttcggcgaacacaccctgaatcgtccaacggccgaaccgaggcgcgagccggacagcggtaggagcggggcgcatttggtgcgtgtgccgcgctcatcgcgggtgcggggtaggcgcccgcaccgcaagcgaaccgtgacacggacacgcgctcgcggtggctcgtgtggcctcgtgactcttggcatgcgcgcgcgctgggtgctggttggtttggccgctggagcggacgaacagcggcccggcgcggcactccgcgcgtggtgtgtgcgtgcgtgctactgtcgatcacgccgcgcggcacgggggaccgaccagcctcgtaccgtggatcgggtgggatctcttcgtggtgaaatgctaccaaagctatcggcggccgtgacagagaacggtgcgcgtctcgcagtactgcgcatcaactggtgagggaaacagtacactctgcactgcatatcacgggtcatcgtttgcacgtagtagtggtgtagtgggaagttgggaaccgaacctactactctgctactactactagcaatgaacagaacgaaagtacgaaagctacgcgaaacccgacctggtcagtgagacggtcacgaaggaagggcattttgaatcccagaattgataaaacagatgaatagaaaaaacgtaggaattgaatgccatatttattggatttttatgggattttgaaacacaggaaagtctccaaactatcgtttgattagcacacaggaaaaacacaggaatcttagacacatgaagaggaaaacatgaggtgagacctcatgcttatttttctccaaagttactcattccataggaattttaaaagaattaataggaaataatcctttgtttcaaatgactatatagaattatttttcataggataaaatcctctaaaattcctatggttttgcatttgattcaaataggccgaaatgtgtgctcggagaacaaacgggatagaaaaggataataagctcatggtcatcccgacccatacaaatcgacgatcatgcatgcctccaccagctcacagatgcttcacgcttacaccgattacatgagatcgagctaaggtagtccttgtcattcacgctagctgtcctccacctaaagctaatgtgtgccattctccattctcgtgaattccccttggtcgtgtactcgtgtggtggctctgagccgctgcctgctggcttcgcagccgcgcaccgtacaatcgcctcagatttttggtcggcgtctcgcacgccgatccagtagattgataaggttccccatcgtgtagcgtacaatattacgagtctgtttggagtgtttaatattttgggaaacaactgatgataaattagctgacgataatctggatgagaacccaacttttagcttacatgagcctgttcggggagattatgtagctacagcttttttcaggatcacaagcttttcaaaacagtctagttttccgttcccttaaaagttagcttttcgtttagattttaagaaaatatagttaaagaatccagaaaataaaataaaagtcagaaattgaaaaacacaacttttccatattatcagaactggctactatccagatgattctttagaatcttaagctctccaaacatgtcctattttattttctagaatctataactatggacttgattccgagaaaaaaaacctagattattaaaggaacttctaaccgatagagattataaaagaagctgcggatgggagaccctaacaaaccctatgcgcggggccgacccgagcagagggagacggcgaaacgggcccttggttggataagacaacgtgggccgcggcaaagcctcccccgctctcattgggccgcggagaaacagaaatttgggccgcgtcacgcagcccgcagcgggggcacacgggctcctctccctgtacttccccgacggcccacctctccgcgcccccccacctttcccacgccgctgatactgatagcctcccaccgatccaattccaaccctaaccctccgcctccgcctcgcctcgccggcgccgaagccctcgcccgctcgtcggcgacccctcggcacctcatcctccccgacgcgcgcgcctccgctcgccggtgcgtgctccgtgatttatcctctcttgttctagctcttttacggcttcgcttttggtggttttttttggtgtaattttttttatcagccttcgccaactgttcccccccgtaggggcgagagggattcgtcggccacggtccgcagccgcaatggagcaagatcagggcgttgctgccgcggcggcgtcggagaatccaagcgccggccagggcgctcacgattccggtagcgcgggggctggcgccgcagcctcttccattgcgtctttcgattcggccactgcaaaccctgacgcaaacgtttacagtcagaatccgagctccgtcccgcaagccgatggcgctcagggagcggatgcctccgtgtaccccgccgaccacgcgccgctaaacgggacatcgggccaggtggtagattaccagtctgcgggggctgcagagaacggcgccgccacaaacgagatgggtgagccggttcccgagcagtcctatgcggatggtaatgtttcgcacatatgaacactcttcactcgctatcgggcttgattgtacttgctaattcattgtttcttttcgcagctgtgctttcagcagaagaagcaaggttgtggaatgccgttacagcgaattgcttagacttcaatgcttggactgcgcttattgatgagacagagaaaactgctgaggtaatgtttttactgttgccgtcaccataaaatctgttattactttattctgcaacttgttgtatgcataggcactctaaatttgtaacttctcattttctcattcattcacatgaatgatagatttaccttatgattatatgcatctatatcttggagaatctggttccatgaatctgccttgtggatttgcatcatctcatataggtaatctatgtttatataggttcacaatgcttgatgtgttttggcatagtttgccatgttgagctgtcatttgtaactttactttcctatctctcttattgaaatggtagagctcttatccaagtttctcagggaaaaaaatgaattgttatcatttgtcctatgatagtttttgtaaatatttgttcatttatgttttagttaagtaaattaagtcggaattatatggcaagagtagttctttttgtgctaataattttttttatctattcttgcccagagcaatatcttgaaactaagaaaagtgtatgatgcattccttgcggagttccctctctgctttggatactggaagaaatatgcagatcatgaagcacgtcttgatggtgtcacaaaagttatagaggtttatgaacgtgcagttcttgctgttacttattccgtggacatttggtataactattgtcagtttgcaatttctacatatgaagacccagatatcatcagaaggtagcaatcacactctatctattcctatttgtttcctcttgtagctgatagctgtgtgtgattcatgtccattttttggattgctgccaaaaatcttccctaccaagtcttttgccaacttaaatagtattgcacttgtttgaattgaagccaattttggcaaccctaccaaaatttggctcctaattagtagcaaaccaaaggacacagttgtagcaaaactctacccaccaaaatttggctgcaccaattcttgcctaggttttggcagtaccaaattttgggagggtagagaactaaactcaccctataggaaatctatgttggaatgtttgatatatgtgccttcgaatatactagcaatttataagtaaacttgggacttttctgtcaagaatgatatgatccttcgtggatgtaaatgtaggatgtagataccactgagtgcagcagccggccatcattcattgtaaaagattttatttctacattaacaaattttctcacattgtcttttacagactgttcgaacggggtttggcatatgttggaacagactatcgttccaatattttgtgggatgagtacattaagtacgaagaatcactgcaggcatggagtcatctagccatcatatatacgagaatattggagcatcctataacacagcttgatcggtatttccattggtaagatcattgggtatttgtgcagtttatttttgaattgtattactttttatgaataagtcgttgattagtggtctatcaattgtcagggtgattaaggaattagagtcatataaaccaattacaacaaaagaaatagccatataaatgtaacgtggtattttggatgataattgttatattcttaatgaaacatagtgaagtaaattttatacttgtactaatggtcatttgttttaatttctactcagcctaaaggagttggccgcaacacgaagtttatcagaaatacttacctcagaggaagctgccatgtattctgttactgccgagaacactgctcagacgcttgatggagagacacaacctggtgatgtagatatgtctgctcaacccgaaatttcaggttcaacagaggcagataacctggcaaaatacgtttctgttagagaagaaatgtataacaaggctaaagagtatgagtctaagattattggttttgagctagcaattagaagaccatattttcatgtcaagccccttgacaatccagagcttgaaaattggcacaactatcttgatcttattgagaaagaagaagacataaataaggtatgcttttgcaatggaaatagtcctttactttttcattcagtagacttcatgcagtacctggagtcttgtaacttacaattttagtcttattggctccattatatgctttaacggctagtatttggacgaagcttcctttgtaatggcatattgaactgaggatagagcatggacataatgtttggtttcgatgaggctaagtactccaaactttcatttgtcagtggccgttctgggttaatgatatgtgctaccaaatatcagttgtttgaatttttaatctcatatatgcaggtaattgcttaatgctctccttcttaaccatctatctatcaggcaaggatggtccctccttatggaggggcctccctaatcagctaatggagtaacctgtgtgaacttcttctgtttttttgtcaatattttattgttattccctttatttcctttattacttccgctcaagttttctgatgttacccaatatttgttttcaggttatcaagctgtatgaaagatgtgttattgcatgtgctagttattcagagttttggatccgttatgtgctatgcatggaagctagaggaagcatagaactagcaaacaatgctctggctcgtgccactcatgtttttgtcaaggtatcacatatacagtcagtataatttaccttttaccattatgttttttctcctgcacacttttttgatatggatcttgtgtatatccttctatctacatgccactaacatcatcatacgatatcaatcagcaaggtctgacaactgatctaaaagttctgtttctcatttcatcttgtgttctttcactgtcaaagattctgtatctgcgaaatgaaaatcttgtgattcttgattctatataggtactctgcatggagataaataagaaatataagaaagtggtctgaattattagtttgcaggctgcttaacgcatatctaccctttacttgtaaattgcttttgttattgtgatttgagtagacagtagactccttctgaaaccttgtttgattattgacgtgctgaaaacacaaagaataaactaatagcatctgtctgtcatgattaccatttgccattgataatctgattggggcctgagactgtatcgacaatcagtattttatttattgcaacgtaatgcatgtagtttatactgcaatcgttttagatttactgaataacactgtttcttctattctttaacagaagcaggcagagatccatctgttcagtgcaagattcaaggagcttagtggagatgtctctggagcacgtgtagaataccagcatctttattctgatctgtaccctggccttttagaagccattgttaagcattctaatatggagcaccgattggtatctcccgaatcaaactacggcattat

SEQ ID NO: 61602 - DNA, 1510 bp, Oryza sativa
ctatacaatgagttttgtgtgttttcgtttgcagaggtacttgcttgggcgaaagaaaagagaccaagcgtaactaatgcatggatgatcaaagaagttgattggagaccaaaccaagaccttatccaagcctacttctacctcaccatgtcacttttggtccatagaagacaatagataaagttctacacgttttggattcggattcggattcgagcctcctgatagcatcaacttcaaatggacctaggcgctgatctagaatgaatttcggggcccattagtacttgttggaaagcttatggagtctactttcagatggttttcgttcaacgtcaaaattcctaccgagctgtcaggaatctgtaaaacaagccacgtacctcatccagtcccaatctgattttgagttttgagccttgtaattgtgtcatgggctagcctgagggggtgtgcgcatattaattcagtagccatcatcgtttagagtggggttttgcttagattattctgtcgagaacagtttcgccgctagatcggtttgtaagaccccaacttgtgagcttaatcattcatctgcaattttggttgtattctatctcattcttgtttatgttcttcgattggcaaacagggattagtcttttcggcgaggtcattcgcgtttcgacacgggtgataactagaggagacgttgtgctgcgattgcggggctcaagagcgtgcgcgtttaagaagccggatcgatttgtgtcgcgacttcgcccaaatcgttgtttaatcgggaaccctagtgcacatcactaggaggaaaaagatcctgggagcctggtatctgtttagcaaggtttgcccctcaatccgctgttttattgttaacaaggcttgtaacctgaacaatcttgttttcttactcttctcctaatatattcggtaagtcttttgccgactttgattttttaaaaaagaattgaatgacgaagaagaaaatctcatgtacggtttcctctaaaagcaaaaatcttatctatctaccctatagttcaacaaatggttttactcattcatcattcatcgtgtgacacatccgacgatcgaaagaagtatggtgatttgcatcggacggcatccgctcctctccctccgcgcctcgcaccgcatccgcttctcttgcgcctccctctctcccgcacctctctccgagtctccgagatccgcttctcccgcacctcccctctctcgccgctatcgcctccctccccctcccgtcgccgccccagactgccctcccactgccggctccctcccaccaccactccaatccgccatcctaccgccccatcccggctccgatccctctcccctcctctctcttttactattgcaaatcctagctccttctggtcccccgtcctccaccgcaccccatgccatccgccacacagccgccgatctccgtcgccggttcaaagttggatgtcgccggttctccccgtcgaccgttgcccac

SEQ ID NO: 61603 - DNA, 3107 bp, Oryza sativa
ttgcctagctcatatgcaaacttcagggatactattctttatagccgtgatactctaactttgaaagaagtttatgatgctttgtatgccaaaaaaaagatgaagaagatggtaccctctgaaggttcaaattcacaagcagaaggcttggttgttcggggcaggcaacaggagaagaacacaaagaaccaatcaagagataaaagctcaagtagctaccgtgtgagatcaaagtccagaggcaggtataagtcatgcaaatactgcaagagagatggacatgatatctctgagtattggaagctacaggacaaagacaagagaaccggaaagtatataccaaaaggtaagaaagaagaggaaggtaaagccgcagttgttactgatgagaagtctgatgcagaattgcttgttgcttatgctagttgtgcacaaactaagtgaccagtggattcttgatactgcatgcacctatcacatgtgcccgaatagggattggtttgccacctatgaagctgtccaaggtggtactgttttgatgggtgatgatacaccatgatgggtgatgatacaccatgcgaggttgcaggtattggatataaacacaggggatatattgggctatcacaccctcccagtgcggcttacaagggatatatataggagaaatctaggagtcctaataggaaactaatcctataaagtagagtcctattagataactaatccgaatatactgtcagcctaaaattcggatcacatatttaacggttcatactaaaatttcagatgcatgagtatatagcataatgctaattggaaaatagagtatcctgacaaatgttgttcccttaaaaataaccaaatatgttgaaactatgccatgcaaaaggtcaaacagaagaatttcactgtcacactgcactttcaaactttacgtgagtgttgaattgatataggtggaagaaattattttccttcacggcttcacccaccctatgctgcttagtggatactggattcgattattgtcagttctgaggtaaagaaagagtcgattagagtatagcctatgcaactcaaaaggtatttatttctatttcttttaattgttggaagaaattcaatagtacagtataaatgatgagtacctattttccaccgaagtggaatcggctaaaatgtagttgattggtgcatcctaagatgtgtgtgagtatttagtatttttgatgcaaaaattcacttgaggctacaaaggcatgcatccatagcctcttgccacacctacgatcaccttggattaatctcagtggattggtacttctgtgtcgaaactaactttgtgttagaatatttttttcatggtgatcgagggtaattagggtctccacgcttcatggttactggttctgtaagcttccttatttctttttcagggtagcatgttcgttttgttgattgagttcggtattgccatgggctccttgtagcttaatcatcgccctgatttctgagcatgcctgcctgaaaaaaaaattgaaatcaatttgtgcgatatttagagatgtccccgcgaggtgaagtccccattattattttaaattaattcatgtttgacatatatgtgtttctcaccctattttcagtatttggcacatgttatatctatacatagtgaattatgacataatatctgttaactataaatggagtagggtggcataccgaaatgatatatttattaggtatgtttgatccatgaattgtggtttagtttcaggaagagttatgtccaaagtttggagatctatatattgagtttatcatatttgtaaattatatattcttatgcatatgtttaaaacaatttggtgcagccatctaggtgatgattactcccaatatgtatattaattgttcagagggatcacaaatattattcccatgaccacaaataatattcccataacaacaaaaaaagttcctactgtttttagcgaagtgtattaatttgtgttgctgccaattttaatacaattctcctttgcacacagtttaaatcacgttaagaatctgcagtcagatgcttatggaactttttttaatgcagggtatttttggaactaaacattcccagtaatgctttttttttctctttcaagctttgatgcgttaaaagatctccataaagatgctaagctaagtatgttttctttacgaaattgcatatcgttgcttctttactatgcccttaattcagatagcccttaattctttactatgcccaaaattcagattagcctctttttactatgagggagttttaaattgagaaagcccttaattatttactatgcccaaatttaatacagataatgtattttgctccatactcttttgccttttcaatgattaaaaggtttatttttcacaccctttccgattcagaaattgctgagtgatcttcagggtatatcttccaataagtggaagccaaataaaggtgaaattaggggggacctaataactagaggtaatttctactctgatcttgaaacaagaacaagacatgagcatgtgctatggttggaggaagggcactgtatatatcagattgcttcataacatcacaagaagaaattgtccatgtttaacttttgaaccatatgtacttatttcttggtgcatggaggaccaaaccacctcatagtaaaaagagactgatctattattgagttgtatattcaaacaaaaagaataaagttagatgaaaatcagcattaccttggtttttatattgtgatgcttagctaatgtttggtaaaagtgctcctgttttcagtgattcattctatttgtaaatggactccgagttttttatgtacaacattttatattacgcaaacaatgaaaagcatattttcagtgacgtggatatacaacatttgtattaccaaatgccaccgtagcattaccacgagtatgttactagatagattagtttagttttaggttcagataatagagaggtgaaaacacgtcatcaaagtttgagctcaaatattggttcaggcttgtcatttgttatgtgtagtactacaaaa

SEQ ID NO: 61604 - DNA, 12241 bp, Oryza sativa
attctgtttttctttgaaattactccgtacaccctaggggcgtgggtggtcaccctgaagacgacgttgtgtgaggtaaaacaaactttgttagtacgatctcgaatcagtaattttggagtactcgagttcaggccaaagatcgaacaaggccaaagttcaatataataaagtggtccttttgtattatttaatccaagttctactccttaggctgtgtttagatccaaagtttggatccaaacttcagtcattttccatcacatcaacctgtcatacacacacaacttttcttttcagtcacatcatcttcaattttaatcaaaatctaaactttatgctgaactaaacatagccttagccacaatgtgctgcatcatgaatgtactggagtactctacttgacaaattggactatgaattcgaaagaaaacctgaatatgaaatctggaggcggtttgacagcgatggatatggatatttagctttagccaatagacggtctggtgggagtggataggcgaagaccttagtacagaaccataccagccggcctacttctattttggacgatatcttcttatctaaatttgatgacaggtcaggcgaacggtggcgtcaagaatgtcttgtcaagacggacacacgacgcggcggtatgcaccacaaaccaaccgatcgagctagcgtcgaatcgatctggcagctcatactgccgattgctactctcactcgttgtttgttgtgctctagcttcaactacgttcccacctaacgttagtatcctgatgtgagcgttctgcgtgcactgcacggacagggagatgatcttgtcgattgttaccgacagtgcacggggcaagagatcatacggccacaggtgttaatcagggttcagctatgcgtcgtttgttaatcagactcgctcaaatcctaatgtctttctttcttgtgatacatctgtaagcgatatgtctggctatacattttgtcttcggtctttcacaatttcagatgctttacatgctgctaaccgtgggggtatggttttaaccccgaaatctcatatttaatttccaacgcgctcatattttttaaaaaaaatgtttggaggaacatcctctccaaatatctttttgctttgaatgaacgtgctgctaagatgccgcagttcttggaaggaaacgataaattcatccctcttttcttctcgttttcttttcccttttcagatcaatcaacatatcgattgcgccgttgggagagcagagaacagatatgacggatgagcaaaagctgccgaggcgagcgaacctcccctcaactcacgttcacgtcgtcgtcgcgccacccctgacgccgagggaggtaacagtcgcgccgttgtcctgcgtccccgccagctgctgcggctgcgcccagcgcgatcgatcgatcgatcgatcgactgccgggtaggccacggcagcagacggcgacgtgcgcgtacgctcacccacgtaccacgcgcgcggcgcgccgcccgccgccaggtcggtcgatcgatcgatctagttcaggttggtaagggcggatctacggttgaagggccggtatcaggcgacaccaacaactttcaagcaaacctataaaaaattatttattcatatattataacaccatgatctaagggcctgtttggcacagctccagctccagctccacccctcctggagctggagctcagttaaacagtttcagctccaccaaaactgggagtggagctgggtggagctctctcacaaaatgaactagagttgtgaagctgggtttagacagctccacaactccactccagacccaactcctggagctaaatttaggagttggagctgtaccaaacaggccctaagtataattagtatgctatgataccgatatacacacgttatgaccctaacgaatttattttttgatcctccaccgggttggttgacacgtcgttccggtgggcgggcggctcgtacgtcggcgcctgtgcgcgcatgcgcgcgtgcggtgcggtggccggggacgtacaggacgggggatggatgcagaatgcgatgggcatcgagtttggcgcgcgggctcggttctagcggcgtctgcatatgcattttggcagtttggcacggctcgactgtgtcgtgtggctgggtgttggttgcggcaggcagtgtggtggccactgggcactggctggatcaggatttgatattggattggtctgattggagacacctggccacctgggcggctccagtttgtattttttctatttttcttacgggttaccaggggaagatgatggggaagtaagtcaatatcaaaatattccctttgttttgttggaactagtatgtactacctccatctaagaaccatcctagaaagacatttgttttgcgttgtttatattcaacatttgactgtctgtctaacttaaaaaaattgttatgattagtatttttatttattactagatgataaaacattaataatactttatggtgagactatcttttttttattattttttcatataatttttaaataagacgtacagtcaaacgttggacacggaaaatcataactgcacttaaaatgagacggaggtagtatccatgttgcgtgccgagagatccatgcttgattccccgtacacattcgatcgaattcgagtaggttcggtactttctatgttgatattgtctactactacctccgttttcttaatagataacgtcattgatttttgtcacacatttgatcattcgtcttgttaaaaaaaaatacataattataatttattttgttgtgggttgttttatcactcaaaatactttaagcatgatttatatcttacacatttatataaaacttttgaatagggcgaatggtcaaacatgtgtttaaaagttaatggtttcatctattatacagagcgagcatatatttacggtacgtagttggacttaagggaggagctcctgtataaactggaaatatctttctattgaatgaattaaacccattcacattacgttggaagaccctactgatctctcgaggacatacttgagactatacttccgtttgttcaaacactattcaaatgataataaaatgatctaaaaattagataatttttatactacatacatatataccacttcataaaatcacactaactccaaatccaactaacacatcaagagatatattattaaaaaaacaaataaacttgacacgaactcctttttttcaatatgtagattaaatttgagcttgactttctagcgaaactaatgatacataccactctactctacaacgttgatactaattctatatatcagtcgtctagttactaattaatgttcttgcacgagtcgtgaaccgggtgtaattttgctcattagtcattacgatgcatggtttgtgtatgaaacatgcttaattgcaaatattttcttcatttttattttgagttccggccactgtttgtatatgtactagcgtgcattatgaatcattgacgtgcttattacctccgttgcaggttgtaagatgttttgattttagtcaaagttaaactgttttaattttgagcaagtttatagaaaaaagtagtaacattttcaacccaagacaaatttattatgaaaatatattcaattattgatttgatgaaactaatttagtattataaatattgctatatttatctataaatttagttaaacttaaaacagtttaattttgataaaagtcaaaacagagggagtacttggtaagagttatcgatcgttcaatacactcgctggatcatccggaatccgccagcagcaaagagatcggtgcctaacgatgtatagtactgtagaccgatgtgtacttaaaaattagtccatcattctcaagcaaacaaaatgcacgttttcttgatggaagacggcttacaagtgcacgcatgtaaaggtggctacggcactggcttctccaacatttaatatatgactagttggccaagagcacaggtcgaaaacattgtatctgaacttgatcccagtttttggatgacgatcgatggcgaaatgcatattattattatctcattcctgtcattggtacgtacgtacttaaccggccgggaagtggaaaaagaggagagtttcttttgcgtcctccttatgatgatccactaggctagctaattaataaatttaacggtaatatacaatctacccaatcaattgagcacatgcatgcccaaaaattttaagctaaactcaaaattggctgatataataatatacgatcaaaagataacgtataaatattagaggagtctggttctcagtaaaaaaaaatatcaacgaatttcagtcacttttgaatggctcagatcattcgccgattcttacaaacacagtaactttatccttcccctcgtcctcccgccaatgcatacaaggcaagtcgtttatctacattaaaataacagaaattgctaaacttctgtcgacagaaaatacaatcttaaatcttgtaaattttggatcactggatgtgcttcacgattcgtgctcttcttctctaactccggcgaccacctcttcttctctggtgccggcgaacccaaactccgacagagggccgatgaattagggccccagggtagggtggggttgggaggggggaggggaatgggaagaggagggagttcgccggctttagagggatggccgttgtcgacgtttgatgtctcgactacggtatttggacagtatggggatcgtcggtgctagggtatacgcgagactgaggtaaaagagatggagacgaggatttttatacaggttcgggcccctaaattgtcaggtaataaccctacatcctgttggccggagccggagttgcttttattcaccataataacaccagtacaatatgtgggtagcttatcaaactgttgtcgacatggcggtctgaaggtctgactcgtagtcgacaacagggtagccttgctccttgaatccgtgtccggcgagatcagagatagcgcttttgtatctcctgacagtatccggagacaccgtaggggaatagccatgcctatcactgaagtcgatatccggcggcgtgtcttggcgtatgtaggcttgtatgttgtcgcgtagattgtggtggttgttgatcctctcatggtgggtgtgtgtgttgttcgtctcgtgtcccgtctcctcctagggggccttgtatttatacccataggtgtccccttgtccaagtagaactagggaaaccaatatggatacaatccgagtagtccttgtcgtttccatgtagaactctggttgtctttccttatctggaactccctcgaggtcagtttccgtataagacatggtatgtggtggatccttccgagatttagtcaactactattagatatgtggtatccataaccctgacaaccgtgggaggcagcaacccagcggtgggcggcgaatcgggcgggcggtgaggcggcggtggcgcagccgaagccgcgggatcgggagcgggtgacgggggcaaagcggaaagagtggtaggaggaggcggccggtggtggtgctcaccgccggcgacggggaagacgacgacacgggacagctcgccgccgctagcttgaggcaaaggagaggagagggagggggagggggccggccggggaggctcgccggtgccgttgacacctttcggccagccaacggtggcagcagcacaggaggcgcacggtgtcaagggaggaggagtgctcgaccgatttttgtggcggcggggaggaggggaaggataagtggtttgggttttgtgcggtttgcacgaatctcaaatcaatccaatgataaaaaaaattacaagatattaggaggggttttctgttaaacgaggagtacacaatcccttaaaataatgtcaatgattttcaggcacttctgaatggtttagatcattcgaagactcatataaacacaataactttatttttctttactctttttcccgccaacacatacgaggcaagttctcgcctacatacaccagtgcaccgtctaccggtgagtttcaccatcctccttctctctcaaaatctagcgctaggtttaagttaattgaaatttctagaatttcagtcgcctgacacactaagtatggttcacctatattacactgagtatgcttcacgattagagatgtaagtaggtagttccgctatctacataaaaacccgtttgctaatattaattttctggtcgttcgtatgtgcttcgcgagttcgcgtccccgtcaaacttggcctaccccacgcaaagtaaaatcgagaagaaaccagtgcgtggcaatgatcgagcgagcgatcagcatgcgcgcgcggcgcgtgcgctcgatcgctcgcgtcgtaggccggccggtaaatttctcgcacccgtagtcgcggccgaattgcccgcccggccgccgctgcagtgccccgcctgatacgtacttagattggacgcgcgcgcccctttttacaggtgtcgcttgcatttgggccaggtgcatcgtacgcacgcacgttacgttagtgctatccgtcgacacgaccgcttggactcccacgttaacttggactaccgtatatatatacacctcttccgatgatccgttcctataaggatctgtttggactttggaaagtattagattttgaaaagcgaatggtgtgaatccagctgataagaatcggaataattaagttaccaatttcttgcttctactttattttctgaattatgctgatatagctggttataatatggacaaaatgctgaattgtttggcagaaattttaattctgagagaaaattgagctgtccgaaacctcccaaacaaactctgagattgtttagcaaaaattaagattgaggtaaaagattctcccttggtcacctccttaattaaattttaaattgctcgattggattagcttgaaaatgtttggatttaatttccgtgtgtaatagtgaatactacgggaatctttatattgtgcataaatgcttatatttaagaacggagaaaatactgagggatcgatcatccaataaatcaagtcatggtcatcataatgcaatgtctcaacattgaccacaatttcagtatatatacttctctcttggttgatattacttatcgttctgaacaaacctattgtcaaacctgaaaaaactttaactataaaatataaaatagttatattagaaatataatgaccatatgtatagattggtcctaaaaactacttcaacaaaatcatatagttattgatatttctattatactataatgaaaaatagttatcaaagttactttttaagatcatgtcattgattgttcaaagcgataattattatcaaaccggtggggagcagtagattgttaattcatccctgaccaggggctaagtttgtgcggtcataaatgccaaaagtgcagggttagttagcgggggtgtcactgtcacggtaagaagtaatcacaatcgacatgtgacacaattaatccatctattgagaaccttctgatcatcaggatcgttcgtgtgaaccatccacatagccagctagtttggaccaatcgattcggcagtataaattgcagtgcttgacacgagaaattctgtcaaacactcaatcagcagcagcagcagctagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaagagttaaatcttaactataaatctagacaatcatatgtttagaacttcagattcgtcgttagaattaatttttttctaaacggagtacgccgtattgttttagctataaaatcgtgatgatttgtgcataattccaatagcctcttccatctccgctaattaattagctttatcgtatattctaatgtaaaatcaagctacttaagatataaaaatttacattaaaaattttggtattacctcttgatatcactgaagtaaagtaaattttttcgcattgaattttggtggacaaacgctcatgctattctcaagttgcagagaactttttttttgacacagtaaacctctgctttcattaaccagtatctccaggcaaatcgccggagaccaaaggagatacaaacgtcggggcttggctccagaaacacttggagctagtggccacgatacccacaccaaaagaggccaaacaatcagccactttgttacaagatctagggaaaactgaaatagaaaagacatcaaagtttgatcttaagaaagcccttaattttctgaaaatgacaccatcagggcgacggttcagatcttgggaaataagtgctttgcccagcatctgtgcatccgttttaacctcaatttttgtcatcccctgttgagacactttttctagacttttcatcattgctaacgcctccacatgcagggcgttgcccatccacgataagcttccagcagaaagaaccctttgaatccattgccacaaaaccccagcctccagtgccagtctcagcgaagaaggaagcatcgatattaattttataaacatcttcccgcggcggcttctatttttccatcacttttcttacattttattccccattcttccttatcttctcttacaagttgcagataactggttgtatatctgcagagttaatcagatgtgccattcctcataagggcccaagaacagggtaagccggtaaggccttgcttggatgaggctcattgcaggcccatctttgtgtgtgggacccaacattcaggcccataaaaggaggcccatctaaacttgcaaatcgttcagtccaatgcaggagcacttcgactagctcagttttttttttctctttttgaataatggacctttttaagtccagtatcatccgtgaaatatggatgattttaccatctttaagaatataatagaatttggtacctcgaaatactttctctcaataaccgtaaaatttctcatgaaatattatttcaaattaagagggtgtcggacagtcggaaagaataaatctatttcaaggattagagtgagattttaccaaactaacaatgttttcagtgtgttccatctggtcttagtattcccaactcgtataatcactatcttctttttgtccaagtaatatacatatactgcaccatgtttttttcctttctaaaatccaagtatttatctacctacttttctattttatactttcgctggtaattcaaaaagggtaaaaaagtataaacgttatagcatatatatatatatatatatatatatatatatatatatatatatataagaaatttatttgtatcttgtgatcactgcagttgcagaaattaaagatcggctttgtgaaagcaagatttctgaaaataccaaactactctctccgttttttaatagataacgccgttgactttttctcacatgtttgaccattcgtcttattcaaaaaatttacgtaattataatttaatttgttatgggttgttttatcattcatagttctttaagtgtgatttatatcttatacatttgcataaaatttttgagtaagacgaatggtcaaacatatgagaaaaagtcaacggcgtcatctattaaaaaatggaggcagtatatattatcgcagcctagaatgatcattatttgaggacatcatttaatcagatactcacatataacttcattaggtccaatattaacaagagcacatgcacatcaacttaaaataaaccgctaaataatgtttgtcgtgtgattatactttagtaatcttcggttatatcaccaaggagacatatgtactcaaaatcatcacggagatcacgaagtgagcataattcaattggtttggttccttgttgtggaaccaacctacccgggttcgaattctagatttaatacgggtgctcacatttatggctatttattctttaagtagaaaatcaacacgggccaagtccagttaagccttctgggaccgtattggtttgaaacggacctagctgtttattctttcagtggaaaaccaacacgggtcaagtccagtccagccttctaggaccgtattggtttgaaatggacctagcatgttcacggcacctctggtttagattttgttagacttcacgaaaacctttgaatattggtgaaggagaggtgaagagagaggggagggtgaagaaagaacatggaactgacgggcaggttctgtgtttagcggcctcatcatttcgcttatacttatgcttatcaggcaaaatttgaattttcaactttaaatttggagttgattttgatgtcttttcatcgaagtttattttcgagcgtttgcttttagatcgctaataacacgtatataaaagttttacgtataaattattgttcttttgtaaatatgccgtttcgcttattcctccaataagcgaaccgatgaggccgtagatttggtattttggttcatgtaaaattaaagtaaaaaaaattccaaacatgtttgatgcgtacaaaatgacatgattttcttaatacaacaaatttacagtggcatgggccaaatttatctaagccactgttgttgctgaaggcaaactaaatttaggtttggggttttccaatagatttcccatcgttagtggtgttccaaattttaatatttagatgttgcctatattaactacattattagttgaaatcagaatattatatatactatgatatatatataggataccggtaattgttttttaaaggttcatcactgcccatctctggtgagcctctctccaccttaattaatgaacttgagcacaccaaactctagtttcctttataactagctatgtattgcaagaaaaaaatattttatttagttgatttttatccaagtgtgtttaatcttattcttagttcacgatcgtttagtcggtgactataaaagtctaaaatagttggtatattgatttactcgatcgattggattgaccacttcaataacaatcattcctatcgtgcttaattaagcacctattcataaataatatttagattgtatctaccttatttttgcagtgttttcttgtctacattagagattatcaaaccacacgttatgtttgatatgacattgcatcatagacttattgctggtagctgttttgtcaacatttcattcgatcaaatcaagagtttacgctcctaaccaaaatcaggccactagagatcgtcagtggttatcaccaaaatacactatcaattaatctctcatatatatggggagaattttaactttggtcaagttattttcatggatttttgtttccttcttgctttcctgcgcagtatatactccctccgtattttaatgtatgac

SEQ ID NO: 61605 - DNA, 2179 bp, Oryza sativa
aaatctgtacacgtcagtatgattaattaggcccacatattgtcatactaagaacaataaggctttgtttgacaaatttcaaatcatggcctccaagaagcactgtttcgaacatttgaatttcatatggatttttttaaaaaaaaccatatggaatagtttcaagaatatgaatgcaatggctgcacctgcatataccagtttgggaacctactgctgtacagtgcgtgcaatttgatccccttgaatgtacagactgcacgctagtcctcttatcaaaagatcaattcagaatttcagaatgtcgaaaatggtccagattagaagatagatgaagtgcaggatgtcaaggaatagtccttatcctgaacgtgttccagccatcgccccatgagtagttgaaaaggactctgttcatgtcatggctgagcacgaaattatcttgtacatgctcgcttctcgagatataggtttagttcatcatgataacgtgattccccacgctttgctgcgggaattactaaataatttttaatatatatttttcgtaaaaagaaaacaaatgaaatatcagggtttatcattatttatcatgaaacaaacaaatgaaacccgcactttaatgtgaaacatattgataagtttacgttaaaatattataaaaatgatagatagatttgtaacatattatggaaatgatgagaggggtgatgattggatatattttcatattgatttgttgagttaaatatattgtagatgatgttgcatgtttgtataagattgaatatgtaattattgctgggtgatgatttggcatggttgcatgctaatctttagagtcagtgggttgtaactttatagaaaacatacatagatcatgatgcaagtttacagtcccgttgtcatggttgggaacgtctcttccggcatggaaaacggaacagttcattagcgcgcgattaattaagtattggatgaaaaaaacttaaaaaataaattaatatgatttattaaaacaacatagaaatatttcgtaaaatacacaccgtttagtagtttgaaaatcacgcacgcagaaaacgagggagaggagttgggaacggtaagaaactaactcagaccctgtttagatctagggactaattttttagtacttgtcacatcggatgtttgaacagtaatttgaagtattaaacgtagattaatgacaaaacctgttccataactttggactaattcgcgagacgaatctattaagcctaattaattcatgattagcccatgtgatgctacagtaaacatgtgctaattattgattaattaggcttaaaaagtctgtctcgtggattagctctcatttatgcaattagttttattattagtctacgtttaatacttataattagtgtcaaacatccgatgtgatatggactaaaatttagtccctggatccaaaaaccacctcagcctgatctatggtgacttcatcattctcaaaatatgctggcgtagtcttttgaaggtacatataatgatagggtgtacgtatttgaatacgtttatagagatgagtgtgcgcgtgttgtgatctctcgtgcgtttgtaccgtgtttctaaaaaaaataaagtacaattgtgataacagggaaaaagaacacctccgctagcttatccgtccacttgctgcatccctaaatacgaatgcaatggctgaggatcatctgtcgtttatggtagaggatatgcgttcaaatgtaacggccgcatttaccggtttagaaacactagtgccctacttacgtgcagtgtgttgagtgatttaaagcccttaattttattgcgtgatcaccctttaccagaaaagcaattcaaaatttaacaatggtgaaaatgatccattacaatagaaaatagacgaagggtggaaactctcaagccagaaaaataaacccttataatgaatcgtacgacgaaatggaaaaaatataaagttttgggtcgataattggttggatggaagaccccaaagatttagcaccattgatttttaaaacggcgaaaagacaatcaaattgcctgaagatggaactcaagaataaccactgactggcaatgctaaatccgattacttttgtggcggagattgatgcatgtgctggtgcaacttggaagtaaa

SEQ ID NO: 61606 - DNA, 1044 bp, Oryza sativa
attctaaggcttcggctaacaaatgccaattggttgtgggaccacagctggatccacagaagagaaacttttctagccacattagcaagaaagctacgtgctcccgaggagtgacaagccctttgcccatgtatgctgctacataaccagaccaccctgctatccttttggtcttgaagtcaaattggttcttggtgttcatactcatagggttagctgatgaagttacatctaatccagtaatcatgatgatgtcgatcaaagttggagtcatcggcccttggttaaataagaaggcattgatggtgttggactagaaattggctatggtgaaatcaaagttggcagccatcagaggttcatccttagcaaaattggctatggtgagagcaagcgcttggccgatcccaatctcatcccagtgggttttcttactagccgatatgcgttggtaccaggtggtccagctcttatcaggggtaggcttttcgagagatggccaagacttgaaagtattcttccagtgacccaagttagggttggctagtctaaaggggattctgttggtttcaccaatgatgaaatcagtggggtcaagattgccgattgggccaagaaaatagtggtttttgtgcgataggctgggaatcgcaactaggttggaaaggtgctgcaaatccaaaggaatcgggaagcagaaaacataatgagaaaaggagaaatcgatttcatgcgaggaaaagggatctagctgctgagtacttaccccagcgtactcggccgatggcgcagtagacgggctagtggaagacgacatcgccgcaggcggagatttgatcaaaagcgaaatcgcctggggatcgattttgcgtcggaggaatcgccgaagagagaaaggacaaagtttcgcttgggcggtgaaaacggaagtcacggcatgagattttttgagggcaacggttggtatttaaagcgatagaataacggccgaaaatgacagagtgcgaaacttgctggagtcggtacacggcaaatccggaacat

SEQ ID NO: 61607 - DNA, 15616 bp, Oryza sativa
ttctttaagcatgacataagtatttttatatttgcataaaaattttaaataagacgaatggtcaaacgttggttaaaaagtcaatggcgtcatacattaaaatacggagggagtatatattatcactccatgatcagtactgtttgtacaaaaattatgcttacctgacactatcacgcatgcatgtctagctccttgaagcctggaaatcaaaagcctcattttgaattaatttgtttccccccacatagtgcatatacaattgagtgatctcacgcttgtgcatgcttatatatactgtactctatgtacatcaatttgccaattaggagactaatacgtacgtatagcagaacaaatcaagcaattattaccatctaattgattatctaaacaaaatttagatcaattttatgaacttgcttcacttgttcggcgccgccgcgccgccgccgcgccccatgtaggacgtgatcgccgccgccaaaaccgactggaagctcgggtccgacgtgatcgccttcgcgatcgtgtccgtcacggccgccggcgcgacgccgccgccgccgatggctctctgcaggtacggcgacgtcgtctggccgccgaacagctgctccggcgccggcctcgccgccgccgccgccatgcccatcatgccgaaatgatggccgaacggcgacggcgcaacgcccttggcgtagtatggctgcgccgccgccgcgccgccgtacgccaggtacccgctgctccacgccgccggcagcgccctgctggactcgtaccccgcggcggcggcggcgtagggcgacgccgacgacgggtgcaggagcgagtgcggcgcggtgaggtcgagcgtgacggtggggcaggacgtggcggtggagatggtggtcgggccgagcagcccgacgccgccgccgccgccgacggccgaggcgaacggcaggtggtggtgaacgccgccgctgccgtgcatcgtggagttggtcgagccagacgtcagcatcgccgccgcggccgacgttgtggacgccatcgccgccgccgccggcggcagcgggtggctgtgcgtgccctcgtacgtcgtgatcaggatcgacatgtcgtccgcgcatctctgcacctgatccatcgattaacacaaaaccaacacaaatttaaattttcgcttcaatttaagtacgcatcattcgaatcatatacgtatttgtaaacgtaaatacgtatttatacgcgtatatacgtacctgcttgcgtacagggcagttgggtgcaacggtgcaacggtaataggcgcgcgggcaagggttcccctttgagattttctgcccgtatttccgccactgacacccatcgttcatctaatcataattaacagcgtgattagcacgggtaaattacgtaattattatggtttagagattgggattaagaagagtaatcgttcttctgtaattaattagtaccgtgggggtgtcgcacttgactctgacggaaaccctagccttcttggcctgctgctgctgcagcacctcgtcgtcggcgccatcgccgccgccgctcgagctcctggacgctttgttcggctgggtaggctcgccggcgccggcgccggcggcgtccccgctgctgtcggagctgaggttcagcacgggcatcggcggcaacgcgcggcggctcgcctgcttgtcgtcgtcgtcgtcggaggcaacgccgccgcgagcgcagctcagcccgagggacagccgcccgtcgtcgccgccgccgccggacgacggcgtcctctcgtggcccttccggcgcgtcgcggcggcgttgggcctcgtgcagaggctcagggagacgaggtcgtcgggctcgtcgtcgtcgtcgtctccggagagctccgccgccgtttgctccttgaccttgacgacgtcgaggaagtgcgtgtgcagcgacttgtagtcgctgacgatgcgtgtgagcatcgtcttgagccgctcgttctcctccctcacctcgcccatctccgccttcgctgcctccatcttctcctcctgtcacaataattaccacataattaatcaccaatttctgaattatcagaacaaattacgatcgattgatcgatcgatggatggataccttcttgatgatggttgaatctctctgcgtcgatggtgcaaaactctcaaagactattggaggcgcgcctccaatctgcacccaaatacaattaatcgaattcagtttgatcttgttcaagaactctgcaattagcatcatcacgtctcaaaaaaaagatcgtaattaaatccaatttatgttatcataccgcggcgacgtcgactttcttctcgtccctcaccggcgggctctcgacgacgacgtccattgcggcgttcgatcgatcgtcgttaccgatctcgaaatattaaaccaggcttagcttaatcacgtaggctctgaacaagaagggtatcaagcaaagcgatggctgaacaaagttaattgtccttgcaatggtagcttgccctccttataaagaaggaagctaaggggctaaggctaggaggtcgtcgtcggggcctgcagtttctgactgaaaacggattaaaatattagctttccccaccaaatcccggttaaatcccagtgattaagtgggtaattaaccttgagcgagagagagctcgaggacccaaaaaaatgtcaactcgagcatgggcaaatcgaatgagaaccaattagctggacggacgcgtcgacctcgattcagatataatatactccctttatactccattcgtttctaaatatttaacacagttgacttttttaattatatttgaccgttcatcttactaaaaaaataagtaattattattctttcctatcatttaattcattgttaaatatagttatatgtatacatatagttttatatatttcacaaaagtttttaataagacaaatagtcaaatatgtgttaagaagtgaacggtataagtatttaaaaatagagaaagtattcttcatcatcctcttcgccgtcgccgtcgtcgtagccgttctacattgataaattgcggctgcagccgcgttctctgtccggtttggtccacgcgtatgtgcaaactggactggataatctctcatctcatctccggcgacttggccggcggtggccaccgcaaacagagacaacgatcgatcttagcttgatcgatcggaattaaggtcgttaatcgatcgatgtggccggaggatttgactccgatctcgatgtgacctggcaaaatatactctatcttgaatacttctttcacaaacgcgcaaaaaaaattatacgccaatatattaaaagaaagaaaaaatttatttatacaacacaaacaaacggctagaagaatctattaacttattaaaggaatagaaaaaggagcctccacgttcgctctcacgacctagaaaatctcatattaatcggagaaaaaggaaaacagagtccatatagaaatacaattagaaatggttgaaatttggaattaataaaataaggaatattagaagaggagaatagagtccatatagaaatacaattaagaaataatagaaattcaggattaaaaaccaggaatattagaagtagagcatagagtccatatagaaatataattaaaaaataatagaaattcagaattaaaaataaggaatattagaagtagagcatagagtccatataagaaattaaaactaactaaaattcgaaataaacataataaaattaaaagtagagtttagagttcatgtaaaaatactatttacaaataactaaaattcaaaattttaaaaaaaggggaagaagagtctaaagttaatataggaatacaatttataagtaactgaattcgaaattaaaaattaaagaatattgaaagatgtgtttagagtccacatagagatacaattggaaacaataaaaattcaaaattaaaaataaataatattagtagaagagcctagagtttatatagaaatataatttacagataacgaaaatttcggaattttaaaaaagaaatattgaaagacgagtctagagtccatataggaatataatttacaaataactaaaatttgatattaaaaataattaataactaacacgtatataaaatacaatatgaatattacacattagtagttttgtaaagttagtacaaaatttaaaattatgttatcattttaatatatttgaataatacattgagaaaatatatatgctattatatgagagaatataattatgctagccgtgcaatttgcgtgggttattatactagttttatttatacaacacaaatggctagaaggcccttgtccgggggcggggaagaaaaaaccgggaaaagaaaagaaaatgaaaggatcttgtttacttctcgcagtcgtgattaattagcgttcaggccgtcaggcgtacgcatgcagcgagctaaatcgttggttttttaaaaaaattatttacgccgtcttcttgttgacttttgtactggaggttcgtacgtgtgtaagcaaagtcggagaagcaactaagtttgtgtttagatccaaagtttggatccaaacttcaatagttttccatcacattaacctgtcatacacacataatttttcagtcacgtcatctccaattttaaccaaaatctaaactttggatccaactaaacacagccctaactgagaattgttcagaaatatgtgcatgcgtttcaaaaaaaagaaagaaagaaaagagagagagagatgtgcatgcatggtgatcttccgatctctgaattctgaagcacattggtttaattacatctgtgttctgagaatgaatttatttttctgggcattttgcaagagaattttattaacctgtcaggagctacggttcgattggtcgtgaaaagtagcggcttggaaatgcaccgtaccattaattcttcatatgcatttacctgtttcatccttggctgaaataacggcatccagtgtacttgtttcagttttttctcccatccttattaaaggccggagtatcttatcatttactactaattaagaggtatcgcaagttgaattgattaaaaataaaagtgtacgatcgataatgacatgtgtcaagactatctttaaaagagaggggtatatacctcgtattcgggttaagatatacaatatggttagtacctctatcaaaagaaatatttacttttgctttttttttcgtaaacatgtaaaaaaattgcacgtcaatatgttggaagaaagcaaagttttttattacacaacgaaacggtcataaggctactgctaggggataggaaaaaaagaaaaaaaaacagagtaaaggaaggaaaaacctccttaaacaaaaacaactcctattgcgagggagggtgtaggtggagcccgactaaacatccaacaaatccacaaaagaaacagcactagcttccacggttggccttccagacggatggagtcccgcaccatcaaaatcgaagagagtgagtagtcgaaaaccctggtgttccgctccttccacatctaccaggaaaccaagaggaccagagaatcgaaacggtcatgaagatgctctggcatgcgtgctctagtagacgatcttctcgtcttggatcaaaaccttaggagaaattaatccaggcgagtagaaaattgaaattcttaacaaatcttcattgaatttgaactccctcttatcgcggttgcagtggtcttggagtccatcctccggaaagacccgcctatggtcttctgcagatgttgtggcttttgggagtctagtgggcccaactgccaccctccccatctttataggagcagttttttttttcagtttttttttgtccttcaatggtcgcctggccggttgcgtcgtgtaactaaaactctagttttttctaatatattgacgtacaatttttttgcgtgttcatggaaattcattgaatttgaagcggtttgaatggaattcaaccaactctgaacacaaatggacgccgaattttcgaccagcaaaatctcaggaggatctgagatagcgagatctcgccgagaaactaaaccatatatactggccgtgacagggccggaggtgttgaaaattctgaaattccatcgaaaaatttcaaacccctaacccgcaccggccggtatccatcagttcgtacttctaccaattttcctcaaacgcgtctgaacttgaacagtacatggtactgcgtgaacagtatcatcaatcatgtgcttaaattagagagagctggaagaccaaataattttaattatctttttttcctaaataaaaaatcatgcatgtgatgtgagtgacaatgtccaagtcgatggatccgaccgtgcaccggcttccggtgagatcgatcgagtgcgacacttccaagctgccatccaatcagctttaagtatcgcctaattaagcttgaattatttagtgatagtaatattaataatattattagcttgaattcattattcggtttcggttggcctacttgctgaagattccagccaggccccgttgaaactgttcctgcactgcacatcgcattgacacaaaggacagatctgatccctttttaatcagcatcatggaaagtgtgacctcacactggcctttgctgattcgtatagctttgtaatcgagcacgataattaattagcagagaaagatatccgatttgcttgtgttcccacaccccacccggcaccggtgtagggcccactggtgcgcgggtaaggtaaggattcacattctcgatgtttgacatcatcttataataagtggatgtgtgccagttcgtatataaactacttttgttgaaagataaacattgccgtaaattcaattcttattttattattgatctggttgaagactcgaagttttccgattaatctcaattttaaggggggatcgaaatccttaaattgtgcaagtgtatccatttttcagcgtagtttagagacttttcatcgatttggcgaacggaggaagaatccaccgcagggataggtgggtacggcgtgtaagggtacaaatttaaacaagttggagtttgaaaatggctggagtagaggaaaacggtggcgaataagataagcacatggcggttgggttcgatggacttagttcaagtaaactgcgtgattagtcaacggatgcatcaaggaggcgtctttcctacctaattcctaaatatttgttaattgttttccaaatggatacagctaagaaacaaagaaaataaaataaaattcagacagagaagagaagaccttctttgtatgatgcatcatgtgaggccaagcttttcaacgatttggtcaagactttggacctaaagtgggatcacactaataatatttccatcacatttttcttaaggaaagacctgtcactccttgggcccaaggaaattaagagaaaaagaaatatattttgttttttgttctctttaggtatttgatgcttggaaggcattgctacaccatcttggagagattttaaaaaataaatcgtttaatttccatgacgtcgctattgaaaattctgagtcgcgttatcgatagttcttgcgagttactccagaagtcagatgctgatggtagttttttttttcatggattactgagtcctgaaatgaaaaaattgcaaagtcagaaggaggatcatcttgggtcatcttgcacatggaccagatcaagaacttagccaatgggaacagtttctggtgtaatttagccacaaaggaatattgtatttggaacttcttgcagtttgagcatcaaaatactcgaggtcaacaatttgtcagaaacccatggaaatgtcagttcatggatctgccacgccaagacttaaattagaagtgatggattattgatggataaatacagtaaagtactcaactgacacagctcatacacaccctagttaattttcacagaagacctcctttttcagatttacaggttctgtaattttcacagaagactttgcagttaactgaccaatatcatcaagacttgtacggcaattcttggaacacatgaaaaaagaggaaactttcaaaggaaaacactagtgggaaaagtgcatgggcattttagtagttagtacgtgaactgctagttaatatttcactttctgcatggaaacttgacacaggtttggccttttcttggtgactgctaaaagagatgaccatgaatgctaatggttgtcaatgtgtaatctgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgccgggcgtggcgtggctggctggcggcgtgcgtgcgtcacgtcactatccttttgcagccactaacccacgttcccacgattccctccgcaacagcgcgtccacgttctttctcctgatagataaggaggccgcgagtccgatccgagttcctcgcttctttcccggtgttagtttctccttctccgcgtctgagttgctctcgcttccctgcttctgatctcttgcgcgcacgagagattggaagaagcagtgcctccgaaaccacaccttcgcctgagatctgcaccgggtaggcgggtgagcgggtgatcaggtttttggggagtgcctcctgcacgactgctcatcgccatgtcgtgcctcctgcacgactgctcatcgccatgtctggagttgctgccgccgctattggcggaggtggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgtaagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttttgacgccggcagtgagctgtatgtcatggagcagttctatgactacaagatggtcgatgaccgttctgtagtagaacaagctcatgagattcagatgctggctaaggaacttgagaacaacaactgtgagttgctggacaagtttgtggcgggtggcattattgccaaactaccaccttcttggtcggactttgtgtaacgctccgcttttcgtgaggcgttaaaaactaactcggcaaaatcctaattgcgaaaatttttgttctttgtgtgcgagtctaagttgtgccaagatctcaattcaaatcccgttgttccctctcatcgaaatcaaaatcctccgcctcaaatctcctctcccaattcaagtctccgaaatctaaatccgaaagtcaatcccttcctttgaatcctcgccaaatacatttccaaatcccaaaatgtccaaacccccgtttgtttcctttccttgactccaccccatgttcccgagaacaaatacccaagttttccttttgaatctttcccatgacttctccttgaatttcccttgatacatccctaaaccctcgagtttgaatatcaaatttgaattcgaatccaaaccctaaatctctccatttctctccaaatcaatctcctccgaaaaagtctattttgcctccctcggatttttgtgggccgttttctcctcggcccatctcctctcagccgctcctcccccttcccttcgcacgtgctgagcacgcgcgtcgtgcccgagccaagagagagcgccgccctctctctctcgccctctctgctttctctctccccggcgccgattcccgccaccgcctttggttcccgcgcacgcgccggtcgtggcagaccgcccggtcgccgccgccgtcagcgcctgcgtcgtgcgctgccgcccagccgctccgtgcgcgcgcgccatgccgctcggtcgccgcccgtgccctgttgccgcgtcatccttcccccccctgtgcgctcgcgtccaaaacacggagccagagctcgccctcctcctctccctccccaaagcagcatggtcgaacccctcctttccaccctccccttttcctttttccctcgggctcgacccctctctcgctctccacccttgtccctctgcgcgctgaggcagagcaccgctgacgccgcacgccagctcgccgcccccaccttgaccgcgccagcctgcgctcccgtggttcggattcggccgtccgatccaccgccttcgccgcccaaagcatccacgccgtcgccgctttcgcatcgcccacgaaaccgccgctgccgccagccgagcgcttgaccgccaaggtcggttctccccccccaaaccgacatcgcctcaccccgcgcctataaaacccgaagccgagctccccatcccatctcaatccctcccactacacactcctactccaccgcgccattgtcgcccttcctctgctctcgccgtcgccgtccgccgccgagcaccgggagaccggtgcgtgcgaggacgcgtgacgcgggactccgggcaccctccttcctccccttcctcggcccgaggccggagagctcgctcccgagccgtcggccgctcgtctctgcgcccgtctcggcttggtaatgccaccctccgttctcccttcttgctcgtcctctccctccctagctcgcgtggtagctcggctagcccccgaacacgcatggacactgccccaggtctcgccgccgaatcgccgctcgtcgcccttgcaccgcgcgctagctcgccggccgccatgctctgtcccggaggccgtctctcgtcgccagccaacctcggtgccgccccgtccaatccgacgccgggaacggattccttgaaccccggagatgctcccatccctttgaatcgaaccctcgtcgtctcgtcgtgttttcccctttttgctctccggtgattgccgccgccggccgtcgtcgcgcgtcctcttcctgatccgagccgtggaatgagttccccttctcctcctcctgccgccagtgctagccgccccttccggctcgccgccgttcgccggatcccgccgcacaccgtgagccgtcggatcagcctgcccggcctcctctgcctccccatccgacgtggctgccacgtcggcgccacctcgacgcgaccgggtcaaaagctgacctcggtcagccgcctccctccgtcccccaccctcgcgcgcggtccacggagagccgacacgctgcgcgtgggcccaccgcacaccgcgtccacccgcgcgccgcgcatggaccgccttccccccccccccccgaaccctagcgccgcacccgcgtgcgctctccccaccgtgaacccaaccaccgccatgtgggtcccgcgtggtggaccgcgcccaccccgacgggcctccctctctccctgcgcgccctcataggccgcctcctcgcgcccgcgccggcccatttggttcggccgagccgcgttagcctttgggccgcaccaatgccaccgaacaagtctaatatacatccctccatccttttctttttccagggatttaataaatcctttttcctttgtcccataaatcaattccttattccaaaattccataaaccatttcctttggccccacgcgtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgagatctatttaatggcactaataattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcactccacccttgtggtacctcggtattcgtgctctctgagcgcgtataccaaatatcccacctgcaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcgtgccaatagttgggaacgccggggcgaggtcggacaaaccgggttcctggtaaggcaaggacgagaagcttgctcacttaccgatcaaggtgattggagtttgatttgtgcacgcctaaaaaggcctatgtttatatgaggatttgatccttctatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcaccctcgctctatataaatatatatatagttcctccgccctgaagagaagataaagtgaagtgaagattagggtttcgtcctggttcccagccgtcgcctgtggagttgggtgttagttcgttggttccgctgctgctgctgttgttggtgtttcctcgtccgtgtcgtcagttgcattctcgggttgttctgagctgcaacctaagttaaggtaaataagtcctctatttattttaaggatttgcaaagattcatatttgtcaccgtgggtaccagcactatgtcctgggactggtaccgagatcgcggtttcgtaggaagcggttcgcgccgtttttcctacgacacgctcctatcaggtgccgttgtacggcggtatcagattggggtgtgacactttgccacttctctaaagcacaagagacaagagttcagtgttcctgatctcattggctctttgggtgttgaggagaaggcgagggcaaaggacgttcggggcaaaaaggttgagggagggttctagtgccaatatggtacagaagaagaaccctcatgcatcccacaacaacaagaaagtcaagcgtgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacatacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgttgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccctaatcaggtggccgaaagaaagaaccgtactcta

SEQ ID NO: 61608 - DNA, 15707 bp, Oryza sativa
agtttttacctcaggacctttaaaactgcaaattaaagatagtttatgtatgttttgttttttgtttgcctgcctgttaatgagatactggagacctactagtagctacggcctcagtactagtttgtctagcagagaagaatggatcataattctctaggaatatgaatcaaatgattgcactgcttgtacttcttttcctaatctgaattgtcctgcatggcagcatctgttttatttgttcttttggttgacccactacgattgctgagttagtgacgtgtgtttaaattctctacagtttttggatctatttggggatgcacaagcgatcaagaaggctaccaatcggcatcttactcatttttcgcggaagagaagcatgctgtcatcaaagaagcgaagagctgatgatgttatcatgtcagacagagataaattggctaggattggggatggtactcagccagttgtgggaactgatccaaatgctcataatcctccagtttggccagcgacatctgaagcatcggggcaacaatggggagctgcttatgcaccacaggtttttatattcctataatcctaccaatcatttatttatgtcctgaacgtgtgtagcatgttttctatgctgttgcaaaaaagtgaaaatatattttggtttctttaaacgtcttctgagttggtagactttcctctactgtttatatcctcgcttgctatgtctctgctgtaatctgtcacttgtactatctctctttgttatagtatttcttttaactatttgttgatgcgattgactcttaacctgtttgcattgcaggccacttatcctgcgtatggaacttacgactacagccatcaaatgcctcaatctgctcctcaagcagctgcttacggcgcctatcctccaacataccccgctcaggtactgaagatgttctccatctaaacttgtagagtacctctggatttgaactgctttgtgcttagtaatctgatcaaattgtgctcgaaattattttaggcctacacacaacaaacctatgcacaaccttcagcaatggcggtggcggcaccagcacccgcagtggcaccggcggcagcttaccctcagcaacctgttgcagctcagcaaccatattatggaacaggaacatactactgatctgtagactgattcaagagggtgctacgaaagtctgtttatttgttctcgcgcttgtatcgctgcagcctaaattagcatattttactgatgatactgtaggtcgaagccatggcaggaccctttgtattagtactactagcgttaccagaagactagttaagcacatgatttgtatagcacctcgtgacattttcctgctagcataatggtccattgttttcatctctaaatggtcgttctgttggaatgagttatgcatgtgtcttgtcaaccagccacgttggccttgtctacttgttctgccatgcatcaatttgcagaacaccagaatccattacgccgcaagcatgtttctgtgtatgtgagcgacggccgggaatggaataagagcgggtacaataatatgatgatatcatatttgtgtttatgtgaacaagatgataacatcttatttgtgtttatgtggaggagaggagagaggaaaaatgggctacatatttatatagccacctgtagcatgaccaatagtgtagtatgtgtagtatgtatataggcctggttagatcaatttgctgtggcaaattatttttgcaaaagttttagtggtaaaagatttggcattagagttttgctagttggtgtttagattcacggtaaagttttgccattttactagtaaagatagagagagcgcggctcccaacatactttttagcaaaatttgctactttagcctcccaaataacaaatgccaaatttgtcaacttttgctactagtgtttagatcatttcgataaaaaaatgctccaaaacaacaaaagttttgtcattttggaggaactaaacagggccatagttaactagtattgtatttattagtatgctactaagtttgatatagatgatgtgttaattatattaataaagttagtagttggcttatattattaaactgctctaacggataaaccgcggtggtggtggcggtcgtacgcaccgagagcgggagagcccacgacgagcgaaacgatcgctatcctccggtaaatacgctcgcaaactcctgcacattcctgcgttggtggtggttccaagcccgaagcgtgccgcctcctcgtgtccctttctcttccttggatcggcgtctcgtctccttgtttgccacgaacccacgacgccctcgtcgtctcgcgcccatctcacccgcctctcccctcctcgcctatatcaacaaaccaaccggtttcttcgccggtgaggctatgcaccggtgattggctgctctgctcaagccaaggtaagccacggctttctttcattcccactggtattatctctctctatccgctagtaaattcaacttggtaaaattgctcggtaaaagttgaaccgacatccgacatgtgtgtaaatctacagttctatccggccttgttcggttaatcttcatgagaaagggatcgaaggttgaggtgtggaataaatactctccaaatctccttcaattttcttagaggaaggattaacccaaaaagaccttagtgtgttaatacttttggtaaacttcagattattgatttttagcttactgtattacgcttgattttgtttagtactacatcgaaaatactgatcgatcgacggtaagagtgcaggttatcgatcgtcttggacatggccgaaatcgacactaggccgcttggatctgtacgagcagcactgacccacttccagcagagagctgatcatcacagcaggtttagcccagatagaaatgtgcgtaactgaactgaaactatccacaaaagtacaaaactgcaattccattttagttcctggattccatctcttctcacacacttgtcaattgtcaaatgcagctgcaggagatcgagatcctgacgaaggagctcgcgagctgcaggatgcagctcgaggtgaaagagaacgagaagatccaggccaacctgaagctcgaatccctccaaaacgccatgcaagaatcgtccgacaaccggatgatcgcaaggcagcaatctgaagcttctgaagagtgcaaggcactgagggacgaactgaccgtcgtcagaggcgagctcgacgccgtcaggagctcgaactcgtttctgctgagagagatcgagctgatggagacgaggatgatcctggagaaggagagcatcagggactctctgaatcacgtgctgcagatcaacgagtccgttctttcgtctgctgtcgccgcgatcagggcggaggaggagaggtcggtgttcttccaggagatcacgctcgagttcttgagctctgacaagaaccgggaggtgatcgaccggcaggtggagatgatcaagaacctggagagtgagctgatggcgaagacggtggagatcgcttacctgcagtcgcagctgcagcaggtgaaggagcactgcatttcatcggaaatcatcgcagggaaccaagaacagcaagcggaagcatcgctgacgctgggcaatggcgacgcggaggctgtggtcgtcgccggcggcgggtttgtcgcggtgatctccaaggaagacgacggcggcggcgaggagttctacacgaaggagatcgagcacgatcagcagcaggcggccggggcggcggggctcgccgtcgccgatgggtacgtgctcgtggcgaagagcgacggcggcgacgcggacctgaaggggaagctggaggcggcgcgcgcggagatcggcgacctgcggttcagcctggaggaggcggtgaggcgggcggagctggccgaggaggcgaaggcggcgctggagagggcgctcagggaggagatccagaggaaggcgcagccgcggaacacgccgtctctgacgacgacgacgacgactccggcgaagccgccattgacggggccgagaggaggcgacgggaggccattgcctggaggctgcctgacactggggaaggtgctcaacatgaagtacaagtaaaactttttcaggttttttcaagcaaagcatgcatgaattcaaagatttcaagtgatgctggtgtatgcctatgacttgttatgattacattcatgtgcttccttaattgtctacttaagatgtagtatgactgtaagagcactcaaatggatgccatatatattaaactagctgggtggcccgcgcaattgcacggctagcacgcaaacaaaatcatatatttttccgtatgacttttacttaaaatttattaaatagctatcttattgtcttaagactttgaaagaccaaaccttatcattcccgtatttctaattatatagtttttaaaattcacactagctgctaccccttacttctatcatatccttctttatttgcttgctcgatctgccactatttctattcattctccttgaaacctctaaaaaaatggatcttatagtttttagaatttattgtctcgttaggttttgtttttataatttctataagttccgtcaaacgctgccattatactcctctacggcccatccattgtgttttctttttattgtcattgagatttaaaaaatcgaacataattattgttcaggttcaattttttactttctagaagtcccgccaaaccgtcagcggctttactactgtacttctttatggcccgctgcctccactctttattgtcattaagattttaaaatcgaacatgattatcattggttttttttttactttttagaagttctgaacctttaaaaattggatcctgtagtttttagagtttattgtcttgttgagttttattttttataatttttagatgtcccgttaaacgatgccactatactcctctacagcctatctgccacctactctttattgtcattgggattctaaaaattgaacataactaccgttgaaatttattttttattttctaaaagttccgccaaccgcctacactttgcccgctgcttcttctttttattgtcattgagattttaaaaattgaatatgattatcactggggtttattttttttgtctttctagaagtcccggcaaccaccttacccgtttgcttcacggcatgcctgtcgtccctccttttaatcgttattaagattctatttggtgttttattaacggtttttatatgttgtatcaaccgccaccactctacttctttataggcctgttacttaatttatctcgtcatgtgttttacatggttttcttttaatagtctttatttttttatcaccaattttaattatttataaattatattcctaaatgattctttttctttttctaattaatcgtgtgttaattgtttaatgacgattaattgtatatgtgcaaccgtgcaagctttgtttatttgacagcacaactcttgtctgtgtaggtttataattgaattagattatatgtgtactgtgtacaccgccaaagaaatagaaaaggaaagactcatagtatgtaacttacacagtacatatatatggacttatcttttctacaacaaatctatacagttaaaatctgaattgaatcaaaggttttaattaatctcgtattgggttcttatatggactcctcttacaatattgcttatttctaatttcgaatttcagctattttttatattgtatttctatttggactcttcttttctttttcttcgattaatgtgggaatttctagcctccatagcgaacgtgatgcctccttttcgagctgtcttaataatataatagatagatactgtttaggcaggtatttagtttgcattaacatttcatatctcaatatttttataattttatgaatggttctagcactcttttttttcctgaatttagaactcattgcctgatgatttatggacacctccaaagatgaaactcattttcattattctaaaaagactggaatggtatttcttggagcaaaggagacattatctcgggagatattgaagaatttctcctttctttattcacagctttatatacatcagacaatttaatgggtaccaaatcttatactgctaaagttggagtaggatatatacccaattaattcccatattaaaaaatccattaaatttctgcccgtttgagccacaccattctcatctatttaaatgccttctccttgcttgtcatcgccattgccatcgtcatcacagcacaaatcagtcaaatagtcaaacaaaacacacaccaccagcagcagctagccatagccatggccatgacgacccgcaccctcctcctcgccgccgtctgcgccgccgccgccttgccccgaggctggagcccgataaagaacatcgacgacccgcacatccaggagctcggcaggtgggcgatcacggagaacaaccgggtgtcgccgagcgacgagctcacgttccacagggtcaccggcggcgagcagcaggtggtgtccggcatgaactaccgcctcgaaatcgaggcggcgagcggcggcggcgacgtcaccggcagctacggcgcggtggtgttcgagcaggagtggagcaacacgcgcaagctcatctccttcgacaagaaccacaacttctgagctccccggagggcgatcgatagctctcgatcggcaagatttatgtgttgaatagctcgagttgttttgatgtaaccattgcgtggatattttgtccatccaattgtttttcacatcgataaaaagccagatttcttctgatctcaatctcttttttttgaatgaatgaggaaaacaaagcttttcaaacaacaccattaattcctcacagggcccacatgtcagtgaatattgctgtatatgtaataccacagaggatctggattcgaccgccccctccttttgttctagtactaaactataaacgcatgggtgacactatatatatatatatatatttgtcaacagatatgacattgctctttggagacattaaggagatgttctttttgataagggtacatggtactgaatatgttacctctcctcttgtactttttggcaatagagtcgtttcctctcctcttgtactgaatatgttaccctttgagtctaaatcaagcaacaattcgatccccaaattcactatttgacacttttaactgccccacgccggcaaatgcatgaatgggaaatcacataaatggggaaaatacatttttataggaaattaaatgcatatgtaaagttgataattttaaaacaaggagtaggaagaatacataaatataattctttggatggttaacaacactggaaaatagatgaaagaaatatactgaaatatgaaagagatgtactgaaatggaagcttccaaacgattggaccttctgctatcctttttctttttagaaaaatcatgcattgtgccattgcaaaggaattttacatgatttggaagcgctagtattttgttctaaaggtcaaaggagaaattttcctatatatgtgactttgttaccaagggcactttatcaaccttatgtgaaaagttcattttatcccgagcagtgcatctcacctttgggaagtgcttcatatgttctggggtaagataactcttcccgtgaggtcaacaaagtgcatttggctaaaggctaacggcgatggtaaaaagaaagaaaaaaaaaatactctctccgtttcaaaatataaacattttcagtatagtgataagtcaaatattttcaactttaactattaatggtgagaaaataaaaaagatcagtcatgtaaaattgatattactatatttatgttaaacaaactatctaatacgcaactcttttcatttgaaatatcttacttttatagatattgttgatcaaaatagtatcttggagactgtgtcagagtctaaaaatacttatattttaggacggagggagtatatgttatggcattttgtaaaactcacattcatctacggctattttgttgaatcaatcacatgtcagtggcaaaaagtagaattgctcccatcccgtcaatacacaattgcatttactgtatcccaaaaattgcctactattttgctctcagatttcatatctaaataattgatttggaaatcatttagagatcccaaactatatgtacttataaccagatagagtaacatgcatgagagcaaatcaaagcatatcccaatttgtaaaattacaaacctgccaattaatttcttcttatttagtgagcataatacatatacatgttaagatatcaccagcaattaaaaggatgctaattgaatcatacaattggataggtagcaattagcagcctataattttctacctgttggcagccacacccttccatctatttaaacgacctctactttgcttctcttttcaccttcacccactgttaaaaaaaaaagtttaaccgcagcagctgcagctaagctactagccatgaccatgaggaccagcagcctcctgctcgccgccgtcgccgtcgtcgccatcgtcgccggcgccacggcggccaccgtcgggtcatgggagccggtggacatcaacgacccgcacgtccaggagctcggccggtgggcggtggcggaggaggacaggggggtggcggcgggcgggctgacgttcgagagggtgaccgacggcgagaagcaggtggtcgccggcgtgaactaccgcctcaccctggaggcgtcgagcagcggcgccaaggacggcaggtacgaggcggtggtgtacgagcaggacccgcggagcaacgcgcgcaagctcgtctccttcgagcccatccactgatcgatcgagcagctagctctgcgacggcgaaactccggcgatcgagattgctttgattaattaccaaagtgtggtgtttatgtttttatttatttactcctgcatgcgtggataggcttggcccatccatgtagcgtgattgcgtgagatactgagatcaataagaggggagatttatattttcttatgttcgtaaggtaaaattgttgaatgaatggatggaaatgaaattgttgaaacaacattgatcatttatctccaggttcccttcgttctgccagaatccaaattaataaggtttcatttcttcattttttttaaaaaaaagtttttgagctctttagggtcacacacaaatacatgtctgtaatacacattgtcaaacttaacaaggtcagtcatttcctagcgaataggggccgtagtgttggccgttctgagttttggccggacgacagttgtaaccttatctcacacctggtgagtgtggacaattcagtaatctaatgaattccctttccccgaaaaaaaaacttaacaaaaatctaaatatttggatcaactgacacatgtataaatcacatgacaatttccggtgttattaaaaatttaaaatgaaccgtaaaaattttgacggcataaaacacaaagcatgtcacatttggatattataaaaaccactttttccgggaatccatacaacatattcctgtcagtagtgtgttcagttgacaggtttggtatctttgatcttatagaggttgggcttctctatactctccaatcacaacacttggattttctctacttgtggtctagaggtgaaagggttgaggatgaatgagtaaaattttaaacacacaaatacaactaaaccaatcacaacaaaattacatatttttagtaagacagatagttaggtgtatgtagaaaatattaataatattagatattaaaaacagagaaagtccgtaacttttgaacggtagatggccgaattttccattaagtatctattacttattgcatagagtatatacatattgcaatgcaccagccaaaaaattaagaaattgattaacaaggaaaaacatagatcaacaaagagtaaaaaaagacagtatttcatatgcgtaattcaactattttaattgatactaaatcatcatacatcaagatggatttggatccaataaatttctacctacttgaggccttaccattccccttcttttaaagcatgttcgagatggcgatcgaacaggatcctaaaatattaggggacccaaaattttcatactttaattcatgctaatatgttccagcatgtttaagacatacgttccatttcgtttcattttgtaaaagctttgctcttccttatttacttatttggctagaatagacttcttttcttcaggtccaataaatgttctatagtaatgcacggccattttaaataactatgactaaacatatatacaagttcacattctttggatctacctatctattatagagtaaatagttcttttcacaataagagttatccatacagtgacagtatttaattataaaagttaattggctaagtagctgaccctattagtcagtttttttaagataaaggaaaataagcctttatctttttattactattttctccgcttaatgaatagccgtttgctaccaatgggggaatggcttcttatttccaatctagatgattggatttgtaccaaaggaaaccagaaatttcatatatagtagaaatctgggatagagaagctcgtcctattcattggtaccgatcatgaatactttaaaaattgtcttatttatttgaacccatgatcaggttccatttttttcacttaatcaaaattaaatgactacagctagacaattcttcttggcaattgaaacgtgactctagcttgataaattatgcaaccttggtgaatacatatttgtgttcattcattaagtctattctttaatctacatatagtttttttaggttattcctaaatgatctacatatttgtattcattcattaaatctattcgttatttgtgcatttgagtaaatggacattgatgcatgcatcgatgcacacaagtatttataacccacatgcaatatatttgctattggctagaaaatagtggggatggtgcatacatggagtttgttgctagagtaaatatagtatgagagagttattagcttttcttggtcttggtgtacctgtaaaatatgtatatcaatttggaatggaggagtatgtattatgtgaagtgaaatttactcttctatttcttagcattttctaacattaagtcttattttatattttgcaccgggtctcaaatttgtatgtatggccctggcgccctcttctaagttatcctcgtaatctagttcaaacactttcacactgccatgaggaccgtagcatcctcgttgcaaccgctgtcgcctttaagatttttaatatcttaatattgatttgaaaatgtagaaaagatttttaatatcttaatattgatttgaaaatgtagaaactatatgtatttataacaagatttgtagtaataacatgcatgggaggggagcaaatcatgcatatcccaattaatttgtagacctgacaatgaatttcttgttgcttactaagcatattgtattaccaacacatcggaaagatataaagaacaaaataagtggggtacttcatatgcaatcaaccaacgatataataatcgtatgcaatcaacgatataaatggatgctaatcactaaaaatcatacaattattttttgaatctaaaaaaaaaccatacaattggaaagacagcatccaataattttcttccaacaagagccacactttattccatctatttaaacttcctctcttttgcacaagcagctagcctttcaccttcacacacactgtaaaaaaaaaaaaaagctcacaatgaggaccagcagcctcgtcctgttcgccgccgtcgccgtcttcggcgctgcctgcacggcggcggccggcgacgaatcctggaagacgatcgacgcgaacgaccggcacgtccaggacgtcgccctgtgggcggtggcggagacagactgggcgtcggcgacgggcggcctcacgctcaacacggtggacggcgccgagaagaggtttgaggccggcgtgaactactaccgcctcaccctcgaggcgtcgagccgcgtcgtcgccaagtacctcaggttccaggcggtggtgtacgaggagggcgacgagcacaagctcgtctccttcgtccccatccactgatcgaacgctagcagctagtcactccatccaaaaaacgaatctataattggatatgacacattagtacaacaaatctacacacaagtatatcaaaattcatagtactataatgtgtcatatccagtactagtttggttttttagggatgaatagagtatctgaaactatgagaggctgcgaaggcaaaattaattatggcaagatttattctttttcttgtattccctgtgtggatataccacacacgtccatgtccacgtccacgacacgatacacatccatccattcatgtattgtgacgtcgatcagtaagatgcaaattatattcagattttctattttgttgtcaataaaaaaatatgggagaaatctgttgatttttttttatcataggatatcgatgcacaccaatgttcgtgctggtcgttgggtatattcgtgcgcaacagagagaaaattgttgtgtgcgtgcgggggctcgatcacgcacacttgtttcttccactaagcagtggcatgcgtgtgtaatgggttagagcctttaggctgccctttcacaaactatcttagactcttagtccttaaatattctagcttaaaattttactaaatttcagcccaatccttatattttgtagactaagaggtagggctcattaccacccctacacatgcctacaagtgtacggactcgatcccacaaccttactatagttaaccttaaaatattaagatttttttctgtcgaaagttgtatagataattccaattatatttcttcacgtcgtataatctaagattgatgaatgcaatcgattttgctaaacatccgtcgggtgatttcttctctcatatttgatgttttcttggccataggattacaccgagattagtgcaggaatgatgacgtttctcgcttccatatcgctctctctctctccccctttcttttctaaataaaagttgatttctttatatgtcaaaaaattaagacatttgaaactaaaataaagaatgtaaaattaatcctattcctatataactaaaattatatttgtaaattcagttgatatgatatgtaagtccctgtataaaaattgttgtgcaagtaaatatgtatttgctattttctttaaaatataaaattacagtcatatataactaaattacatttgtaaattcagttatatgacatgtaagtacactatataaaaaagttgtgcaggtacatatgtattggttattttcttttatagtctgttggatgtaaatgtaagggtaaaaaaaaatctgagtgattttttttttagaaatcacccgataaattccgtcgcccatacgaacatgcaagaatttgcctcttatatatattgatgcgacgatctgtccacacaggacgagtacatgaaaaaggaaaaaaaaaacttcaacaatcttggatcatctgtccgctacgaaggagacgagcttgcgcgagttgattacggactacttgcgccacggcctcactgtccggcctccttcgccgtggcctccttcgtatagccgtcactgcctacttgcgccgacgacgacgggacgtacggccgtggtgttccgcgacggggaaccgcacacgtcccgccacagcgcggtggtcggcacggccatggtgcggctggtcgacgcgctggtgcacggcggcggcgatgacgatgacgacgatgacggcggtggcgggtactactacttcgccttcggctgggagtgggagaagccgctgctggaggggacgctggtgttcgacaagtcggtggcgctacagggggtggcggctccgccaagtggcggatccaccatggggtctctgaggtttcgagaccccactacccgtattataactatgagactctacaaagacctcactaaaattttctgtcatacgtcttttagaaaagagggctataattttatataatttgttcagaccctcctgttaatctttcctagatccaccctggctcccggagccgggggaggccgccggcggcgcagagccagcgaacgtcgtgcgcggcgtggtgcgcgcgcgtgctcatgttcttgacggtgcagtgactaccggagctcgtcgctgcctagccgcatttgcattgcatgctgtcagcctgcatagaacattcgcaatcagcaaggactcagatcacccgttttgtttgctctatgaaacgaattgccttcaaacttttggtttagctcaaatttactattgtcagcaggaaacttgacactatataagggtgtcagggtgatagacaaagttgttctgatttaattatgttatctggtttggctccaatttacaattgttatcatgaatcttaagacttagggtgatagacaattgttctgatttaattatgtttctttattgtggcatttggtactgccagtgttttcagaagcttctctctactatgctacaggaagccccacggagaaagatacaacctcatctctttgcttgtgtttatgcttatcagccaaaatttgaattttcaatcttaaatttaaagttgattttagggttttttttcatcaaagtttatttttcagcctttgcttttaaatcgttaagaacatgtatataaaagttttattcacaaactatttttcgtttgcaaatatgccgtttggcttattccctcgataaacgaaacaatgagggacctagatttgagtcaaccaaaataggcccaatttagcactgctatatcctctgctgtgggttctaacttttgccaggttggccgaagatgtggcggacgaccaatgtcattaagattgggaggaaaggaagtacaaaatgtgtgttacattgacaagagaatgtcgagtaggtccgaggcaaaatgccccggtcccgtgaacaaagaaaggcccaaaatctgcgcggaaaaaactgtagattcacttaattacattggggaatgattcctgccaactaaaatcttacatattgtattccgttttccaaatgtcaatggcagttgcatcactgcattgggttttaagaaaagggactgcatttatgacatcacattttgtacaccgtagattaaaaatcttacaatgtaaacttgcactgtaattaggataaaaacgattgattacctaaaggaaaagataagagagatagaaacatactcttttttttaggggaagatagaaacatacttacatataagcaagatagcaattaataagaagaaagtgactgaaatccagctaaaaatgtgatgtgtttttagcgaaactgtaaaatgggtaaataacaaagtcaaagggataccgaaaataatcctgaaaaaactttgcagttgatttggtaaaagatcatactacctccgttttttaatagatgacaccgttg

SEQ ID NO: 61609 - DNA, 2630 bp, Oryza sativa
aataagatgaatggtcaaacatgtgagaaaaagtcaacggcgtcatctattaaaaaacgaagggagtattaaaaaatcaagaaaatttcactcttctggaaatcagcaaggcaaacattaaaatgtctaaagctgctctaccgatggagtaagccactgcagcaacacgtatacgccaaaaaggataatgatatacagcaggtaattgcttctgtacagcaggaagatatgatgaaaccctcaagttaatgggcgtcgaatgcagcaggtaattgcatttgcaatagcactgtggtttaactattttctacatgaaatggtgcaacccggataaatcaatgtcgctgcaaaattacttatgaaacatcgtggtaaaaacaagacaacctgataaatttacagattacgtttacctagaactatggatatttgtccaatccacgatttatgtaaacaccaccagcatcctcttattttcttgcatgatgacgcatctcggactgggtaacctccggtaaggttacaatattgcaccacccccatcttccagaagcaggatgtgaaatagcttgtgtagcgtccatcatatatatgtgcatcgctcacatttgacacttgacagtacaaatatccgtagcctgagaatgatgccatgttaaaattctaacttctcatgtggagtctttctttggtgctggagctgtaggccctggtgggcgagccaaatttaagttttgcatctcacttgcaagaatcgccctcctttctttcaaaaaattgagccggtttgtcagcttggctaatgcaaatggcactgccccagattcctgaaataatagcaagcacatacaacggtcatcacgaacttcaatccacgaaagtggcagtaaataaccgcatttctatagaggatactagcagtatacttataggacacaaaaaggccaaagaaacatacattactatatcttgccgactagaagtgatatcggttgaggggtcagtgagattacctctgttctagtgctcgaataggcatttgatccaagcctgcctaacagtggattgtttgagtattgtttctgtgcaaggttccactttgatgtaaatgatccatcttggccatccttcataatcccacccttagaagataagatcctttgagccctttggctgatggtacttgattgttcattggatgcaatacctacgcaaaatcacatatttgaactactaagagtgttgtttctttggatttatttattttttaaaaaatgagcagggattatatttatcatattttgttgataattagtactcttttgatgcttgtggagagttggcttgtctatggaagaagatgaatgttgtgtggtttgcttccttgattgctcaatatctgcctgaaatgtgacataaaaaataacttaatgatagaattgagaccatgaataactaaaaacacacccagaactgactgcacactcattgttaactccatcgagctggatatttcctacgcaatctcgtctttttgcttggttgtctacagcaatgaaatatgcgcgattgtgatgtaacaaggatatttactttttttttcctgcacattttttactgggcacctctgcgcatattcaggcagacataactaatgtgactaactttgttacacagtttcaaaaacatctactactatgagacatgcacatgcaatagtcgtcctggatttggtgttaagggtataatatatatgccatgggcattttagtcttttccaatctattgtacaaaatatatgttcactgggcctaactcaattgcaatagaattcattccccattcctctcttcttctcctaaattaacatgtgtctctaatagtcttaccatgtctgtagccgatgccatgtcagacatagaattgggcccaacatttgatggtgaagtattctgttcatctctgcagaaaggtagcccacaagtatgttcccttcacaattctaattggacaacaaaaggctacataaagtgctaaaataccacagaacgctgaaagatattcttactcgaaaagcttgtctgtacttaggagtcgtttgttgcaagagtcacataatgaggtggagctcatctggacattgttgttgagttgtccacggagatcagaaaccttttgcttcaagttcaaaatatcagcttcagcagtagcaacttcctcaagatcagccttagtctttcattagcagaacaaaaaaaataaaataaaatggtgggaaaacacttgtactttaactcgacaataaaattttaaaaagaaaaccttgctatcaattgttgatgggaaggacacctgtcctctacgcaaattcatcagcccagactccaatgaggccctcaattttctctccttctgtagctgatcccgcaaattttccacctgttgtatgaaaaacaatttccgtttaacagagatttgcatatttcagccagatattgaagatgtataaaatttctggtgatcttaacataatgtaaggatttcttatggagataaagagacttaatcataaaatctacctggatgttctgtttctagaaaaaaaatactttcccatagtttgagctctt

SEQ ID NO: 61610 - DNA, 1663 bp, Oryza sativa
tatagattatttatgggtaatccctataagtaatcgattcacggtagaaatttggatttaactactagggattttaccagtgtattatatttaatcatttagtcatagactaaattaaatcgtataatatttctaggattccgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaataataaagttaatataaagaaatcgactttcgcattcgactttcatttggattcatttggatttttatttgaattctaaccgaattcaaatcaattttcgcacgtaactatagagcccgagggagttgcggatccaagcgaaggtcaagacccgcaagacattgagcaatgcaagtcatcactattccttgaacatgttgatcccaattgcgaaattgttttgtttacaaataaaattgcatgcaatgatgaacatcccagttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaagaagaaataaaattaaacaactgttttcgactggggcggacggaggatttgggtggtatctggaaaaggctagtactgtcgccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgctgtcacaccctaaaaatcctaaatatataaactgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaatgtttttaaaagtctcttttggctttgggccgaaagtcggcccaaaaccttctctctctccctcggcccagtcggcccagtcggcccagtccgcagccgccgcgcgcgtgcgtccggtcactgacaggtgggtcccacctgtcggacccgtcgtcttcctccggccgcccgtcgcccgaaccctagcgccgcgccgccgccgtctccttccaaattcggccgcgcctttccttctccggtgaaatcgattgaggggaaatgtttcccgagatctcctctaccttttctcttttggaatcgtcggctaaaatcgtttggaaatccg

SEQ ID NO: 61611 - DNA, 2219 bp, Oryza sativa
ggatcggttgatctcggccgttcgttttggataagatcgatctcggccgtctgttcccgtgaaccgctgccgtgcgcctggtccaccgcaaaaccctagccgctgacgcaataaatccctttttccttttcaaaaataattcgttattgcgtcataattcaattaaaatccatataagtgttttaatccgatttaatctttaaaaattcataactaattcatcttagctcggatttagttggttcaagtctctaaatttttctaaaaatgagatctacatgttaaaaatatccacatgtactgttcatgcttgtttatgtgctgttttggtgattttgcttctttctgtttagattccggcgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcatttggtggaattaacctattgtttgttatagccctttttgttattggttcctttattccttgataccttgggttattttaacttgactagttgggctatatatattggttcgactagatattagatgtgattgcttagccatgcttagaaacattagcacactattgggataacttatgattcattattatttaatgatggcttaatgctagttcacgatggtcaatcgtgattggttaattaattccttgcctactaaaatttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgcggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacctctcatcatgataacagatgctataactggtaataatttgtttagctcctggtttggaatggtatattcctggtttggagatagaactgtgcagccgggatggttgttcagaatggttgggcctatgcaacagggtatgttgtatagcgttggattaatattgtttaattattacttaactgttttattaaattctgaaatgtttattaaatgctgtttgtgcaaatgaaaccctactatgccacccttttgttaccctgtgcacttgcatatttgctgcgtgacttgctgagtatgtcatatactcaccttgcaatcattcatcagaggaagagttctacagtgaagctgatggtgtggaggattaggtgtagccttggtcaagctgcctgtggagtggagccgtctgcgccgtttatcttatttttcgctgcttagatctttattgattgacaggaactatctacctctgtaatgacattttattcgcttattaattagagtaataattgtactctattatcaatttgttattgtgtgcctcggctaattcctggacgagggttcacacacatgtaagcgtttggaattttggatagaaattccaggcgtgacaactgccatgagtgtgtgagagagagaacttaacttgaaccataatttaatatgtgtgtgagacttctctttcccgggagcgccagaactcctctcactgctagaaacatggacgcctagagtgcatgaggattgaagttcatggagcgggtactgccaatgcgaggttatcgaaaagttttgccgtgacacgtctcatgtgttgggatgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatggg

SEQ ID NO: 61612 - DNA, 22773 bp, Oryza sativa
cgcagtacagcgcgttcctttatccggtctgtgaccagtcacagaccggtcagatcacgggttaggtggcgacaggcggtcagacgcatgcttcgccccatcctgtctagacgagagcttctaggcactcgtccccggctggagctagcgtgttatatcccagagatgacacgttagccccggtcgatttataccaggcttcatcctaaccattacaggcaagatgttgtgtgaagaagggcaaacatgcaagttgctaggctgacgcgtggtgggcaagaatgaccgatttgtgaccggtctgacattggtcatgtcatcggcagacagccacgttcccacgacgcgcctgcctccggcagaaatggaggtaggtgtgtgctgtcccgtcgggaagatgttcggaggacgaccgtgcaaatctcggtccattgatgaagagaaaaaaagtccagtttggaaagagaggggcgcatgtggtatccccttgaagtataaaaggaggaccttgcccatagagcagggggttggttgattgattctttccagattcagagcctagaacaagggataggccggctcacactttgtagctcctccatacacaaatccacaaaaacacaggagtagggtattacgcttcgcagcggcccgaacctgtatagatcgccgtgtctcgtgtgtcttgcgggcgggtaatctttccacactcggagagagagagagagcttgggattgcaccctaagcccctggtcgaaccggcaaaggggggcttgcgcagtctcccggtgaggggccacgagctccgtcaggagtaattatcatcaagaaatatatatctataacatgccacataaatgacaatcgaactagtactaaaaacatacaaagaagtaggcacaatacgtgctggaacagttaaaacgatacttatagactttttcccacccctatggagtggaaaaatataaaaccaacaacttttgctgattataaaaaaaagagtaaattgcgttgacggtacaggaacttggcaggtgggtgcgattaggtgtaaaaacttgaaaaccgagcgtagcggtacaataacttggctaggtgggtgcgctcatggtgcaaaagttgccacgccattgttccacctaagcgaaagtgccacattagcattgaccatctcattttacagaaaagtccatagtaacttttatattacgatcccattgttcggtagaaagattggaaagataggccctgccgccgcccgccgcggcgtcgacggagcaaggtcatcgagcaggcgacctcgacgtcctacaggttcggcaacactggcggcgccatgaccagtgccgcgtcctgtgctggctccttccttccacattcgctgggcgcagatcgagtctccgacaacatcaaatctctgttcccctcctcgtccacagccagcggcgccgcctccgccagacacgacgagtacaggggatccccgccgcgccgctggacacgacgagtacaggggatccccgccggacctcctgtcgcaacgacaagcaaccagcagacgcagtcacagtcacgcaggagctatgcctcaatctggtgagcaattttgggactgacgaagtgacatttctctgtgttggctgcctatacaggggtttggatgttctgcaatatatgtacctagaagtatatatgcaagtgatgtatagttcctgtaggttcttttgtaagtactttgggagtgatttcattatgtacggaattatgatgaaagtgatataaagttcctctgtgcttttattaagtactctgtaagtgatttccaaatgcatcaaaagctgcctcacataatttgtttccaaattggtacgaaaaattcagaattgtatgcttctgtctgaatgagacatttggtacactttatgcccaacagcccaagcgataatctgtcataattttgccagcttgttttgaccaccacttgcaatgtagggaatttctatacacatatataatgtgggacattttcttgtccataaataaatcaaggtagaaattttcatactgaaattcaggaagaaatcaacatgcccataacaaaataaaaggtgcaaaataaacactgttcaagaacagggaaatcagactaatgtagcttatgaaacatgtctatctggttggtatgaaactaaataaaactctctgactgaaacatatgctaatgttttccacataaaattgattactagctgttttcattttttctttgtctccttccttttcttcggttctgcttcattatttggtatcgatttcttattaggtggtgcatttttcttccttggctctgccatcctcttcctaattgttgccctgccctctttggttgcggtcgtcattggtggctccactccagcccttctgtttgtggcaataaaatttgattccggcaatggaccaggggcaactctagacgagctgttgattgtgttctgcacaaagtacttgaaattgtggaaaaatgtttcacaaagttacaaaatggagaattgagaaagcattgcctaacctctctaatcaaggaagacaatatggtattgtctaactggttgtagtttggctgactagttagaatactagtctgactattcagaatatcaggcatgacctgcaaaggcataacatcttcttgaacaggctgtagagaaggagcactggcctgctgctttccactttttatatcttccttcctcttcttgcatcccttcttattgtgattaactccttggcaatagctacagtgtagttgcacaccatgtttgaatatttttgttcctccttcaagctcttgaggctgctttcttctacatctactaggccttccgactttcttttcataaaccggtgggttgaccttcactccattcatcttcgcccaagcagttttgtctctaacaggcattatattaaatccatatgcttccataaatttctctgttgagtaacaaaaggacaccacgtctttaggcttgatcctctcactcctcaagcaagaaattgcatggttgcatggtatccctgttagttgccatctcctacattcacaatgttttgctatgatgtcaacaatatattggtgttctttctcagtaacttggaacacccctttaccagcaggcaagacatagcatgtatttgctatttctgcatttttctcaacctttttctttatttttgggcatatatttcccgaccacttctttacgcactcctcctgcttattatgtatcctattcatgatctggctcctaatcttctcaagcatggacaacattggaagctctctaggttcaagaatatacttgttgaatacctcagaattgttgttcagcaaaatatcacacttgggaaaatcactaaagaattctctgcaccactgatttggtggtatttcctccaagtatccataagcatcagtactaagatacttcatcttttccatgttggattcccattccggtattgaactggaccttgcaattgcccacaattggttctttagagtctcccctttatgcaaaacatggaagttttggtatagatgcctaacacaaaatctttgttctgaatctggaaatttatccctcacagctggcaccaatccctacaatttaattaaaaataaggtgaattctagtccatcatcaagtttaaaaataaaataaaatatgatgaaatagagatgtaaggaataccttttgtctatctgtcataatagtatacggtgccgtgttgtcaataaggagatcttctttcaaagtattcaagaaccaaccccaactagctctactctccacttccacaattgccatggctataggatagatgtagtcattggggtcaatgcctactgcagtcaataaatgtcccccaaatttggttttgatgtggcatccattaagaaaaatgataggtctacaaccacttaagaagcctcttttgcaagcatcaaatgacaaatagcatgtatggaagcacatattctgtaaattcaagaaaaatttgctacctggattagatgtcctaagctcttgtccataatcccataacatatcatactgagctatttcatcaccgtgtatagcctccaaagctaaccttctcgctcgtcctagtttgtatcttgatggtgttacatttaggtctttttgaactactttacaaaactcttgagtgtcatcttatcattatctctaaagctttcaatgtacctatttgcaagatatctagcagtacataattcaactcccactctttttgacatttgtgaccatccacatattgttttatcataaaacattttgtcctgctgtcctcagaggcatttaacatccatgggcattcttcagaacatttggcctctattcgtttcttggtgtttcttgcaaatctgattgcaactctatttttcacactatattgttttattgcctgcctaacttcaatagcatcattaaacaacatcccaaccttaaagataggtgactccatgtccacatcagccacaaagttcttaaatttcaacttgatgcccccataatcttcatcagatgactctggtagcagcaaaccttcatcatctggatcacatgcaggaagctcaactactagcttgctagcctcagcattttcagtttggtcaacacaattgtcaaaaacatcatcatcccccttgtcagcctcataatcactatcaataaagtctggatctaattcactgtcatcctcatcatcaattttatcaccttttgcaacttgatcatcacaaaccttctgactcattgcgactctcctgggactagccacaataggtaaagtagttggggctgaaagagctacatcatcccaattaatcgattccacaatatcctgatgatccgtgtacaaaagcaatgatctgaaccttggtactaatgcaaccatgctgttagtgcttgcatccgaatttattctccttagcccatcactaaatgttttcccaggcaataaccaataaaccttaaccttcctcttagaattatcatatcctagttgctcaataaaatcatcaagccataaggaagaccatgtgtcagtgtcgcaatgatcaaaccagtccaccttctcatccaaataaattctgctactgccaactccacaaaaaaacccaccatgatgcagttcaattgtgaattcttcctcctcatggcctgcaatatgaaataattggtgatgtgttatacccgcataaggaaaataatacactaagattatttgcagattattgaactaattatatgctgctgataggggtacaaaatacatatagcaagaatttatcattgccaatgttactcttatatcgtatacagctacaggaaacaccaataattacagtacaaccaatctcgtggctagtaccattatatcacttcattgcattgtaataacaaataacaggatattcaagtgaaagaccaaaataatgcagccatcgtacagatcaatgagaccttaactttgcaatcatccatcaattgaacaaaaaatagaaatctactaccatcagcaagtgatttaccataacaaggagcagaagctccaagaactcaccgagtcggagccatcccaaagcttgcagcaatcacgtcgacagcagcagtttgtggacttgaattggcttggttatggtttagggcttgaattagtgtggcacacggagccctcgtcgccgccgcgatgtagttgcacggtttccctcgtcgtcgtcgtcgccgtcgccaagtcgccgccgccgccaccgccgccgttgcgtctccaccagtgcaaccacctctcgatcaggatcacgtaagaaagatgaagggagatatttgtacgttaagaaatcatattagggggttttctataaaatgagataggtctttcgcgtcaatgctaatgtgccactttcgctgaggtggaacaatggcgtggcaacttttgcaccatgggcgcacccacctagccaagttattgtaccgctacgctcggttttcaactttttgcacctaatcgcaccctcctgccaagttattgtaccgtcaacgcaatttactctaaaaaaaaaactgataccaataatataaatttcattttttaacaaaatgatacccaagtaggggttaaaagtgcgggtactttaatacaaccgaaccgagacgagcggaggggagtgaggaatctttttcggcttattttgctatatttatgtcgccagattttttttaatggatctcagtcgatttgtgggcaatatgattagcgctacttgcaccattgctctttgctggccttgtcggtggctgcacctctccgtcccatccccttcccaccggtgctcgggatggccggatccaacactgcccctccccaccggcagtcgggaggggctggatcctgtactgccccacctcacagtggcatggcgggaggcctcccatggcgagggagtggtgggtggcctcctcacggtgtgggcttggcgggaggcctccatggagagggagtgatagatggcttccaacggtgagggcgtggcaggaggactccacgaaggcgcagagggccacctccccatgtggcacaacgggcggcttccccatggctggcgcggtgggtggcctctcttcttcacgaccgacggctttaacggcagtgcagtgggcagccttcctccggcggcgcgacgggcggcctcaccatggaggggcgcagtgggtggcgggcggccaaatccggctagggtgctccacaaaaattgcgtggtgggcgacctctcctccgcggtgagcggccttgattggtgacgcaatgggtagccttgatggtggcgcaatgggcggcctcaccatggcggggcgcggggggtagagggcggctagatccggctaggttgctcgacgatggttggcgcactcgcgggaggattcaccacggcaagcaacgatgtatttctcttccttgttgattcttgattttctaattttggcctctctgcgttgttgttggatggatggtgagattgtgagaaatgtattcttggattcttggtacatggatgttaatgaatgtgttcttggatttggatgatggtgagctgctcgattcatcggctcgaatcaagccaattcatcgagctggattttcgctggcggggttatgaggggtgaggggttacggactgccagcgaaaatcgattttcactggcggccacgctaagaggcccgccataaaaaatagctctattttcgctggcggcggctccaagaggccctccataaaaaaacgggttttcgttggtgtctgattttcactggcggcaggaaacagcaccgaaataaaatttgacgctataaaagcaccacccccacaccagcgaaaaccctgttctctccgcctcgtccttatcctatctcctcctagggcagctgcatgggtttgatttttgctggcggttgatttaacacagccgccagcgaaaatgaattattgcaagcggtcggtgtaaggcaaccgccagcaaaatggatttttgctggcggctggcttaagatgatcggcagcgaaaatgaattatccctggcggtcgataccgccagatcttcgctggcctttgctttgtggcggctacaaattccgctagcgaaaacctaaaatgtccgccacaaagatggttttcgtagtagtggtacttgttgtggggttctcaaccggcaacaatatgtgttatcggtgtcggttctacaactggcaccgatgaccgaggtcattagtgacgcctgcggagatgctggttgggaaatctgacatctatggcgggttctcaaccggcacaaatccgattttctgtagtcgtgcaagtaattggtttcgttgatcatcaacttgtacttactatgttggatacgtaccgcaccattttttctttttgcagcagataaaaaagtattaaacaaacacgtaaataaactttcaaatagaaaccaatacaaatatctgcgattttaatttccagccttccaaacgggttgtaccaagatttaaatcgtggacattttaaattaggataattaaaggtaattcaagctgtgaatacagggaacactagaacaggttcggtcatctgtaaggggtctaaagcctaattgttggcggctgttaaatgctaattctataccgccaacatctgcataaagtttagataataaaacatccaacatggtgataagtgcttaatctcacatattccacaagtgttggtgtatatttgtatgcaggtgataaaccccgaggttgggaagaaatctagactaaagtgaggagaattatgtatccatacaaggatgggttgtgaacttcatcaaaatatcagaaaatctgcccaaaattccgggaaatggatagaggagagtccagggagtccacaggccgaaggccaggccgggagggcccagcccaggttcggccgaacccccctgatcaccgttgatcctggggtttggcgtggacgctccagatgatgtcctgatggtggttgcggggcagttcggacatttccccttctcacaacctttataactgccctataaaaggagtttcactccttcactctcacacacacttccaatcttgagctgaattataagaggctctattgaactatattgtataatagaatagtaagtgagtagagtagaagaagtcagaagaattccagagttgtcggtaatcttctctcatttcttttattctgtttattactctgaattcaatataatattcttcctgagtaatttagatttatcttgtggagaattatctcttggttagttcctaaatagcatacgggattattgttcactataatcaacaaaaatatagtgattgctttgatgagttataaacactaaagtagatattaattgcttagacgtggtgtttaggtaattgttatctagtaattgctgcgtatcccacagtacgtttgaggtaggtgtagaggtggtgacagccctcgagatcacttaagtcctccttgtccgggtacgtagtagagcgacatctgggaacagcgggttgccagtgcccgaagtattgcgttaggattaaagttaagcttcccttagacactgtttctcactaataaatcctctctatcctggcctatcatgtgcttggtgtccttggatgaaccggaggaagatctgaccacacacgtttccttggattcgattgcctttggaatactccgtaggggaagcgctacagtggtatattcgtgcgcttgcggattctatctgtgatcgtaagaaataccaacactcatctctatcgggtagtgcccccgtcactaagcaaaggtcactaatgtgagaaaatatctcaatcgggcatccggccatcacggatgacacacatctcaatcgggcctaaattatagtccgtcaatataatccaaaaaaaaaaaaggattcgatagcctttggaatactccgtaggggaagtgctacagcggtatatccgcgcgcttgcggattctatctgtgatcgtaagaaataccaacacttatctctatcaggtagcacccccgtcactaagcaaaggtcactaatgtgagaaaatatctcaatcgggcatccggccatcacgaatgacacacatctcaattgggcctaaattatagtccgtcaatataatccaaaaaaataaattttattttttggctagtctcagacctttgctagccacgcccgtggtcacccatcccgaaattgctccatccttagcacgcttaaccttagagttttttgggatcgacttccggagaagaagttgtacattcattcacatacacaaccatcaatatatttcacacaaccacattcacataatatccattttgatcatatatttcatacccattcacatatttcacatatttagctagcaaaatcgagttaattggatcaaatatatatttagcaagtattaaaatgatgaggaggcaaatcagacttctaggcaaaaaaatttcaaattgaattttatgatactaaatgaggtcatatgaaaaaactatcaaaaacaaagttgaagaactcattgagatctaccgattttatttctgtcatttctccatccgggtttgattgaactatataaaatttgaattttaaaatataggaaattcaaataattttttggatagtagatgatttcaaatggaaaaattgtcaacgacaaagttgtataacttatcaagatctataacttttattttggtcatttttctatataacatttttttgaacagtttgaatttgaatttgaaaatatgacaactccaaataatattttcaaatactaaatgacttcaaatggaaaagttatcaataacaaagttgtataaattatcaagatttacaatttttattttggtcatttctctatataacatttattgaataatttgaatttgaatttgaaaatatgacaacttcaaagaacaatttcaaatactaaatgatttcaactgaaaaagtcatcaacaacaaagttgtataactcatcaagatttataacttttattttggtcattttttcatccgacaaagtgatagtaacattgtttataaaattcacatatctctcatctggttttataaactataacacagatatatcaattttgtgaacaatatttctaacactttgcgggatgaagaaatgaccaaaataaaagttatagatcttgatgattgttgatgacttttttagttgaaatcatttagtatttgaaaatgttgtttgaagttgtcatattttcaaattcacattcaaactgtcaaaaaaaagttatatagaaaaatgatcaaaataaaaattgtaaatattgaaaggttatacaactttgttgttgacaatttttccatttgaaatcatttactacccgaaaaattattttgactaataaaatgaattattatactacagttaattattttgcttcatgtcaactcacaaatataaacatttcatatgaaaaatggaaaaatactaagtcattgtcagggttacggattagggataccccttacccttcgatatatgttacatatcgatatggcatacccgtgcatacatggacattctctgtacgagttaaggaaatccttcgcggaattggcagatgtaaagagatctactcggacaagactaggttgtcagcgtaccgtgtgcggtttgatgtctccgagtcctgcttggagactacttgacctgcggtataaaaaggaccccctgggaggacctgcggggtcgaatctcatagccaacaccaccaccacagcctacgaagtcggagcccgcggaagccagatcgccgagaggtctagtcgaattgactcgattacgatctcgtcggttttatcgagttccattgttccctttgtaacctgtgatttccatcatacaatcccataccactggattagggctattacctatcaaggggcctgaacctgtataatcttcgtcttctgtttgcttgatgtcgtactacgtagacccttgtaccaacgtaccccaatactctctatatccggtctacgggtatcatccgtcgacagtggcgtgctaggtagggggacttggtgctcaaggatctactactatttcatccagcctcgtcgacaacagcgtcaacgccaacctcaactacgagcttcctgcctcgacgacgcttacgtgcactcaagtcggcgaaattgtctttccggtttacaccatgatgccgatctcagctgggccgtcgaggaccagaaacgagaacgcagtggctgtagcccaagatgactccacgtcgaaggatcctcccgccgaagcggagaacggaacatcgacgacatccgagctcgagaagaattctaatgcggccaaaccttgtcgttccgacaagaaacacaggccgacgagaataacttccgaggtgacagggtcctggtgccctatccacaaaaccaggaaacacactttgcaagcctgcttggtcttcctcaacgcccgcaccgagatccgcgcctgcaaagagcgtggaattcagcgtgtttctccaactcgtggtgtctattgtcctattcacaagacaaagaatcacgacctttcaagctgtaaagatttcctcatcgtcaccaagatgtcatctcccaaggtccagcagccaggcaagacccttagagatgaagacaaagaacgaggaacgacgttgaccccagattgtatcgtcggtgttatcgacatcggttcttccgaaccatcggtcctacatctactcgaagactacgactcctcgtcaacaagtacgccgcgtgaggtcttggctctcgacggcacaggcacatcggcacgcgctaacaccggggcggaaaatcaaacatctacaccggctcagcacatcaggaccctcaacgcgatactgagggaaaccccttatgaccccgtcctacacgatgacctcgcacaatggacggaacggttacgggagtcagtgaccaccctcagtaacgcgtttgaggaggccgccactgcaacccacccggaacagcaaccaactgctgatgtcaacggcgaaaaccccgaacagcgggaatcaccccatcgggccgccctccacctcacggcaccagcgatctccgcgaccacctaaacggccgccgagaagctcgtcgcacacgggaaaacgagaaccgttcccggcatcacgtctcttcacgacaacacaacaatgaagaacgaggaggccactcgagccaagactgagaccgtggtcaccgccacaatcgtcactttcgcgacgatcgtgagcgacggacgccggatgatatcagtcgaggacgccgccatcatgacgaggacgacagagaacggcgccgggacaacaacggagggcgacgacaagactctcgagaacccggccggcgttctcgtaatcctacaccggaaccaagcgacccgtcgtcgtcctcatcctcttcctcctcctcatcgttagacagacatccacaaaggacatacgatcactgacaacccactgcccccagtgctgggtgtagggctttcagtcgttcgttgcgcgatgtccgatggcctgagaggttccgaccgggagcaatagaaaagtacgatgggagcactgaccaagaagaatttcttcaagtatactccacagtactctgtgctgccagagcggacgacaacgtgttggcgaattgcttgccaactgcgttaaaaggctctgcgcgttcatggttgatgcaccttccgccctactcgatttcttcgtgggcagacctatggcagcagttcgtcgccaatttccagggaacctacaagcgccacgcgatcgaagacgacttacacacattgacacagaactcgggtgaatccttgagggaatatgttcggcgctttaatgagtgcagaaatacaatcctcgaaatcatcgatgcttctgtaattcgcgccttcaagtctggtgtcagagatcgctacactacccaggagttggcaacgagacgcatcacaactactcggagactattcgagattgttgagcgatgcgcccacgttgacgatgcacttagacgcaagaacgacaagccgaagaccgggggcgagaagaaaccaaccacggacacacctgagtcaagcagaaagaaatatcgcaagaacgcgaaaaggaaagctcaagcagaagtactcgcagcagaatatgctaaccctctcaagcgcccagaccgacaaggtagtgacgcaaggaaagcatggtgtcccatacacaggtcgaacatacgttctttggaagactgccttgttttcaaaaaatcgctcgagaagcacatgacatcggaacaaggcaaacgagtacgcgtggtcgagaaggatgcggagatgactgctcaggagtcggacccagcgtatccagattctgacctccacgtctcacacatcttcggaggctctacagcgtactcctccaagcgagagtataagaaagtggagcgagaagtctgctcgacgtggcagggggctgcacccaagatgaagtggtctgaacagaagatacaattttcggaagatgaccatcccaagaccgccgttatcccaggacgctacccgatcgtggtcgaacccactattcggaacatcaaggtcgcgcgggttcttattgacggtggcagctcaatcaacctcctcttcgccagcacattggacgccatgggaataccacgaagcgagttgacacccaccgatcaacccttccatggaatcactccccggtcttcgtccaaaccaatgggcaaaatcacgctgcctgtgactttcggccaagcaaacaacttccgaacagagaatatcacctttgatgtcgctgaattcgatacttgcgaagttcatggccacatctcactacgcgtatcaagtgctcaagatgccagggccgaagggaacaatcaccatccaagggaacgcgaagctggcggtacaatgtgacaagcggagcctcgacatggtcgagcaaacgccaagtccacctgccactaccgagccacccaagaaaatgagcaagacaaacaagacgccgaaaccggacggcgcaatcaagatcgttcctctctctagtgccaaccccgacaaaaccgtcaagatcggggcatcgctagacgagaaataggaactcgcgctcatcaccttcctccgcgacaatgctgacgtgttcgcttggcagccgtccgacatgccgggagtccccagggaggtgatcgagcacaaactcatggtgcaacccgatgccaagccagttaagcaaagactgcggagatttgcaccagaccgaagacaagccatacgagaagagctcgacaaacttctcaaagctggctttatcagagaagtacttcatccagagtggctagccaacccagtcatggtgtggaaggccaacgggaaaatggagaatgtgtgtcgacttcaccgacctcaacaaggcgtgccccaaggatcatttccctcttcctcgaatggacctactggtgtgagctgttgagcttcctcgacgcttactccggctaccaccaaatcagcatggcgagagaggacgaagagaagacagcattcatcaggccgtttggggtattttgctacgttaagatgccattcggaatcataaccgccgggaacactttccagcgcacggtctagggcgcacttagcgatcagctcggcaacaacgttgaggcatacgtcgacgacatcgttgtcaagaccaagaaaagcgactcattgtttgacgacttacgggaaatgttcgacaacctccgacggtatcggctcatgctcaatccagagaagtgcaccttcggagtaccatcgggcaagctgctcggcttcctcgtttctggcagaggaatagaagcgaatcccgagaagatcaaggcaatcgagaacatgaagtcgcccacaagactcaaggaagtacagaagctaaccggatgcatggctgcactaagcagattcgtcgctaggatgggagaacgaggacaacccttcttcgctctgctgaagaagcaagacaaatttgtatggacacaggaagccgaagaggcatttattgcactcaagcgctacctatcaaatccccatgtactcgttgctccccaacctaatgaagaattattcctttatattgccgccacgccatactccgtccgcactgtaattgtcgtagagagagagaaagttcaacgaccagtatactatgtcagcgaagctctccacaacgcaaaaaccagatatccacagatccaaaaactgctctacgcagtaatcatgacgtcaagaaagctacgacactatttccaagcccacagagtcacagttgtctcctccttccctctcggtgaagttgtgagaaacaaagacgttgtcgggcgcattgcgaaatgggtagtcgagctaagccagtttgacgtccactttgtaccacgaacagccatcaagtcccaagtactcgccgattttgtagctgactggaccatgcccgataatcaatcagataacaagatcgacgacgaaacatggacaatggcgttcgacggtgcactcaacagccaaggagcaggggcaggattcatcttgacatgtccctccggagatcatttcaagcacgcaatccacctcaacttcagggcgaccaataacacagccgagtacgaaggactactcgccgggataagagcagcagctgcacttggggccaaacgactgatcgtgaaaggggactccgagctagtcgcgaaccaggtacacaaagattataaatgctctaaccccaagttatctaagtacctcgcagaagtcaggaaactggagaaaaggttcgatgggatcaaggtccgacacgtataccgcaaggacaacgtcgagccagatgacctagcgtgacaggcgtccaggtgagaaccactcgaacccggaacttttctagacatcctaacgaagccatcggtgaaagaggcaatcggcgagatcaacacagccgcccccgacatcagctcggaggccacagagcggaacgcgccatcgccgatatcgaggtcacagacgactagcgcaccccactgatcaaattcatcagcagcgaagagttgcccgaggacgacgcagaggctgagaaaataacccgtaaaacgaaaatctactgcacaatcggcaacgatctatacaagaaagcgccaaacagagtacttctcaaatgtgcctcgtccgacgacggcaaacatctcctcctcgacatacatgaaggcatctgtgggtcacatgccgccggtcgcacattggtcgggaaagcctttcgacaagggttcttctggccaaccgccctcaaagatgcatgcgacatagtccagcggtgtgaagcctgtcaattccacagcaagcacacaaagctacctgcacaagcgctccagaccatccctcttacttggccgttctcgtgctgggggctagatatactcgggccattcccacgaggatagggcggctacaagttcctatttgtggcgatcgacaaattcactaaatggatcgaagcgatacccacgggggaaatcaaggccgccaacgccatcaagttcatcaaggggatattctgcagatacggactaccgcatcgcatcattaccgacaacggctcccagttcatcagcgccgacttccaggattactgcatcgggctgggagtcaaaatatacttcgcttcggtttcccatcctcaaagcaacgaacaaatcgagagggcaaacagcatagtactacaagggatcaagacctatgtctacgacaggctcatgtcacatgacaacaaatgggtcaaagaactcccatcagtactatgggccatacgcaccacaccgacaacatccaacaaggaaacacccttcttcctcgtatacggctccgaggccatgctccccagtgagctacgacatcagagtacacgagcacagaagtattccgacgaggaacaggaagagcagcgaaacgacgatgtgaatctactcgaggaacatcgcgaacgagttgccgtccgagcagccacctaccaacaagcccttcgccgctaccacgagaagcgcatccgagacgcatactttcgatcggcgactacgtcctccgaagggttcaaagccaagcagggcgaaacaagctctcacccaaatgggaaggaccatacacgatcacacaagtcttgcgaccaggcgcattcaaaattgcagacggcaatggccgcgagttggcaaactcatggaacattgaccaactacgtaaattctatgtatgagtcaataccctccatacctgtaagacaacttacatcatcaataaagcctatttttcaggcgcatattgcaatcacagtgtcctgcccgacaatccctcacccagatgacacctagcgttgacacctgtcctcatgtccctttacgccatgctgacaaggccttcgaggaacctaagggatcttcggctggggacgcccagagccgataaggccttgtcagattctgtagagacgaaagaccatgccagccgtggtcgtgtaagagttctccccgtgcgtattaaccaagccgcgtaatccgaaatgaattttccaacttcgcggctgggggctaggatcagcgtttgttcaaccgaggaaggtcaaaggtccaagagccttgtcctctgagaatcattctccgacgacaaggctgggggttagggagagtgtacaactcaaacgactggccaaagtcggaaactgaggaggcactcttacacactacatccagagtaagaaggactcattaagatagatttcttttctatttcataagatatttcttacaattttacacaagtccaaaagcatattacacttttccctaagatgtctatcgcaggctaccaggaaggccaacgccagtccatcgactggaagactttctccgctagcggcgccatcgacttcgccaggtgatctatctctgccggagtcctccgagaacgagcgaacccatcacagagaaactcgaggtgcagctgcggacgatgctctcggatgcaagccaacacatgccctccggcgtaccggctcgaccgacggcattcctgcttcagggcttcgtcaatgcgcttgccgacgccctcgagctgagtacatgccccattcagccacgagatgtagccggccgccgattcctcgggatctccacggggcacccggagctccctgcaaacatgggccatggacgtgcagcaactcttcagataagagtcgaaccacacctcgcgacccttgagcgcctccacggcctggtcttttttcacctccaccatcgccctctcgagttccgcgacttcacacttcgtcttccagtattggatgcgacgatcttggtcagcaagtctactctcgagatctgctcttccattccgagaacacgaaaatcaagtcactccgggaggaaggatgaaggagatgaaaacaaagatcaccaacctaagggagccatcgccacacccgtctccacgggtgagtttcgttccatgtcgtcctgcgagacacgcgtttggagggcaatcgccggggcgatcaccggtgagtcgggctgctcacgctgtgggacatcctcgacatcaacatccctacaaacgacaaccaaaagtactcaggacaagagtgctaacagagatcaaggcagcgattacacgaataaaggcggtcgaaaccgacgaatgttatacaaagtatggtctattacaacagagctgaggccctactcttcaaaaaacgggagaacagactctcccagttcgccaacctcctccatcacgcccttacgagcgtcgttggcggccccccgatccaagacctgccgaagatcgtgttcggggtgtgccagccggacacacgctaggacgtgacaggccccggtgtaaatccagttcgacgtctcctccacgatcctggccgcatgcttggagggtatcgcctccatcgccgtagccagttccgcaagcgaggacgtcagcgagaactcgtcggggttcgctgggatggttgtcgtgacaccacactccccggcgagctgatgaagaccggtgtaggtgacccgcagcgacccacggatctccgacaggttgttctcgagttccgacattcggtcctcgagcccccgccgttgccgctcgttaccggccaccagctccctcatcttctggagatcctcgcgaacctccgccaggtcgcgctccagcttgtcggcacgcgtgttcgccgacgacgctgccgctgtcttcgcctcctcgatctcgcgacttatgccgcgagccccagcctcgaggatgcattgcatctcagcctggagctccctccaggtgaggacgttggcaggcggcctgcgactaggcccgagggcactggacggaccgcttggcgtcgcttcacggctccttggcgcgacaacgacgtcggttgaggttgctgcaggagacgctccggaggccccttcggacttgtccggcgtcgccctcgcctgcgccgacctgcagaggatcctcatgtccggcccttaaatcgcgtcaccggaagaaaaacgaggagaggacttctacttccgtttacttacttctcgccgagcgtcaccagcttcctccgccgcgggggtggcgaagacgcgtccacggcctgggtaaatcaagcgcgagttgaggttgacacctttcgaatacgaagttaacgaaccaagggactcaccgatggggaggatgctctccggcgactgccgagcacggaggtaaaagtccttcccgttttcgggacgcggctgccactggtcgtggcagcagcggcgacggctgcgtcgggcaccccccgagcggcgctcaccttcaatgaggccgccgcctggtggtccgcgagcggtccgatgacgtcagccagagggagagcctgtatcacatgaagtcattttccgacccaggagacaaagacaaagattgtggtttcgcgctcggtcgcctccttatcgcaaagagggacggggacgtcgctggccgttgtcaggccgctgatcattaactgaccgacgcggcgctccacggtggcgtcactcaagcctgcagatcgagaacagaactcgataaatcaagaagaacatgaacggaaggggatcaatttaaccaaacaagaaaaataccccgaggagaaaaccgggtcacgtcctctggtccagagtagtcaaaggctggatgggcacgagcctggagccgctggatccgcctactaatgaagtcggcagcaacttcgtaccctgacaaacctcgcgctcggaggtcatcgatggcatcgataaacaattgaagagcaggggtcaaggtgggttttgcggtccaagatgggattttgtctggctgttcctcgggaacgacaaagatcagatctgaatcctctatctgaaggtagaaccacctcgcccgccacttactacgagaagaagggctctagaaagggatgtatcgcgacttcaggccatctcgaagtcggaaacccacacatccagataccctggtggattccatccaacacaactcgtagtaaaagcggaagaggtcgagaaatggctctaccccaatgtaggcctcacaaagatgggaaaagatgctgagaaaggcaatggaattggggttcaaatggagcaaagaacggccgtagaaattcaagatcaagagaagaaattcagaaggcgggggaagaaagccacagagaatataatcctcgatcgcaaccatacggcccaggacaagttcgggttcagtacctcctggttccctctccatggttccacggccgggaagggcgccatcctcctgtagcttcttcaacgatgcgctggtggaggtggacttgccgagatccattgccgccggaaatcgccggagaaggggccgagatgaacaagctctggttttgcaggagcggaggagacgaggaatgcctggaggctggagagctttcttccacaatgggcggacttcaaagtggatcctcaaaatcctcttaaatagatgcgcttccgacggtgcgaatttcaaggaaaggagagagattaccgccggaaatttctaggtccgttacgcgcggcagtttttcagacttcagtttaaattcactcatgaccgttgggtttcacatggtattgtcgattgcgtcctgtctccacggttcatacaccgagaacgacaacagcttcgacatcagaagtcgtgatcggtcacatgagttcatttaagcagaagtagggggctactgtcagggttacggattagggataccccttacccttcgatatatgttacatatcgatatggcatacccgtgcatacatggacattctctgtacgagttaaggaaatccttcgcggaattggcagatgtaaagagatctactcggacaagactaggttgtcagcgtaccgtgtgcggtttgatgtctccgagtcctgcttggagactacttgacttgcggtataaaaaggaccccctgggaggacctgcggggtcgaatctcatagccaacactaccaccacagcctacgaagtcggagcccgcggaagccagatcgccgagaggtctagtcgaattgactcgattacgatctcgtcggtttcatcgagttccattgttccctttggaacctgtgatttccatcatataatcccataccactggattagggctattacctatcaagtggcctgaaccagtataatcttcgtcttctgtttgcttgatgtcgtactacgtagacccttgtaccaacgtaccccaatactctctatatccggtctacgggtatcacccgtcgacagtcatctcaatcaggcattagtatagagcccgtcatggatgagtcatctatgacgggcctaattgttgagatatggtcgcacagacatgttagatgtgcataaaactcaggcccgtcacggatgacatatatcagtgatgggtcgtagtttaggcccgattgagataacattccatatctcaatcgggccgcaagttggcccccgtcatggat

SEQ ID NO: 61613 - DNA, 2424 bp, Oryza sativa
cttgctttcgggttgagctgcatcggtttcgatcttcaacaagaggtaaaacttgttatgacggcttgtgttctcgggattagtgcttccatctttatgacactctaatcttgtctatataattcgtcaagttatcatatattttacataatctttggcaatatcatcatctaacctacaatcggctaacatccgttaatagaaggcagctgattaggttaaatagtgaagttgtcctagattatatgagatatctaccactttatgaaacacccagtggcttgattgtctagatattattcttcttttcatacttaatgctgcatcagttgagtttgatctattaagtcatgcttagaatatcaatctctaacctgtcctctggttgcctattatggtagtatcggagtttcagccgatcttatctgatttaaccatattcgatctatatgcttcaatgacatgttaaatccgccttttgtgtcaagatatcgtcgcaatctaaatatattaagcttttgtttaatacattatacctgttttaatatcttgatatatagtagtatcggagtattagccgatacaagctagatctatctgatcggctatgctataaacatatataatcctgttattgatatatatttcgatctaagtgatttatactatctcggcatggtgaccgatctatcccaatcacgtgatttaagtatatattaatataagaattatatatcgttaatatctacagccgatcgaatagatttagttccttactatctatttataaccgccgatcgattcatatatgacatcggcttaaagataaatgatatgtcatcggcacctagccgatcggctatcatttatagatttaaccacgaattctttgtctctatttcttgttgataacaggatcaaatcaactagcacgctcatacattcgaaggcgagctttggacctgcactggagttaagcagatctaccctggtctacgtgttttctcatcaagcagtatacacagataatttctatatatagtgcgacaacgttggtgcatactcaatggcacaacagaaacggaacaccacggcctctgtttctcaagcgtggaccatctgcaaaggcttttgactctgtatcctgggaatatttgttggaaatgctacaatggagaggattcggtacgcggtggagagactggattgccttgttattatcgaccaccacatccaagataatgttgaatgaaacaacaggagaggcaatcacacataagagaggattgcggcaaggggacccgctttcaccctacctcttcatattagcaatcgaccctttgcaaaagatactgaatgtggccacagaccaagggatcttgtcaccaataacaaacagggtggctaagttccgaacatcgctatatgcggatgatgcggcaatctttcttaacccaagtcgagctgatgtggacaacctgatcaccctgctagaaaagtttggacatgccacagatctacaggtgaacttaagtaagagctcggtggtgcctatgagatgtgagaacatagagcttcaggaagtgctgaacaatttcaatggaaagcggactaatttccccatcacatatctaggactacctctgttaacggggagaatcaagagagtgcatctccaaccagtcatggacaagctccactctcgtcttgcaggatggaaaggaaagctgttgcaacaggcgggaaggaagacccttgtctcttcggtactaacctcaataccaacatatttcctcacagcgctgaaacccccaaaaaatttcctgcatgatatggataaaattagaaagagattcctttgggctggcgacaaagagattagtgggggcaaatgcaaagtaaattggccagagaaatttgctcgagccttgagagtgcgatggctatagttcagctgggagagcccaaataagccttgggcagggacacctcccccttgtgatgaaatggacagaaggttgtttgcctctgctacaagggtgacgataggtgatggtcgaaaagcgagtttctgggaatcaaattggattggcgaacaaccacggaaggagttagccccagccttatacaatcatgccaaaaaaaaaggtaggacggtctacgaaggattagcaaatgaccaatggatactagacatcaggcacaacctcacagtcgagctagtcaaggaattctttgaggttttctaccacgtgtggaatagcgacattgcactcacagaaggtgttgaggacactataacttggcgatggatggcaaatggaaagtacaacgcaaagtcagcctacatagcacagtttaatggcaggataagctcagcagctgcaaaattgatttggaagcattgggcaccttccaaatgca

SEQ ID NO: 61614 - DNA, 2200 bp, Oryza sativa
acgggaatcagtttgaatcgtaatctgggaaactatgaggtagaggatttggaacttgaacataaccatatacttcaaacaccagaaacccgttacttgatgccatcacaaagaagcatttcagaggtgcaagcatttgaaattgaaatggcagatgcttctggaattcaatcaagagtcgcccatgaatttgctggtcgacatgctggaggatcctctaatcttggttatacttgtcgtgaccacaagaattatctatgaaccaaacgcctaaaggaactaaagtatggcgaagctgaagtgaagaatgatgtgcatcattctcatttgtgctaccatcctcaatcagaacggtgcaatcctcagtctataatcaatctgttttcttgtaagtacgtcactcttgccagtgggttaatggtaacgaagatggagggattattttggcaccaacagaggagtaaacagaaatcatctcccgccctcaccgccagtaattacgaggctatttaactaataatctgttgattaattttatttgctatagactaatttcagccgttgctttagaacggagggagcggatagaaggaatgtcagaggatacgattcctcactatctgtgtgaatttgaacttgggaaaattataggatatgacacggatgagttgtattcgtctgtaagtatttgtattatcgaacatacaataaattctattatgaccctacttacaaacatgataagattggtagtaaatcaccatttataaagctacaaataatattaacatttttacacttcaattgcattcgtaggcttaatatcttagcattgaagatacaaatagatatatgtttcctattccagggttaataaaaaagaatggcataacataagtgatagaatattccagattatatgtatctagctagctccaactcataagagagataagggacaggatatagctttttagcaaaggtcgggatattatattctattatcttaaaaaaagacaggatatggaaaaacggttgtccgacctaattacaccccctatataggtagttttgaacttttcatcttgaaactattgtcttacatgtttgtacaaaggcaaaacctggttttcttgggctgcttttcagcttagctctattgggcttaatgggcttacacccaaatctaggaataagttcacatcgtgacccttaactgtgattgaaatctaatccatgaccctaaaccataaaactggatatctcgacccccaaactcctaaaactggtgcaatttaactccctcagcggttttggagggcagttttgctgacgtggcgcctacgtagcgatattgaccgagtcttcgttccacgtggcattgacgtggcacttaggtggcattagaattaaaaaatgtgtgggacccattagtcattcacacaaaaaaaaatgtgggcccactaacatgtggggcccacatgtcagtcctcttccttcttcctcctccctctctcccttctctctctttctttccccttcttccccttcggccggcagcggacggcgagaacgagtggcgacgacaggacgggcgagggcaggagcggcgagccgtgcagccgctgccgctgccgtactcctcctttcgaggcctcgcagctgccgccaccctgacacctctccccgccagcgctcgcggctcccatccaccgacgacgcggcttgcagcgatgcggttgcacagcctcctgcacacgcttgcggccgggggagtgcttgttgtggggctcggagtggctggtgggagcacggtggcgcggaggccgcctcctctgctgttcggcgatgggcggcgatggccattgtcccggttctactgctccaagggcgggcggcgtccggctaggaattgcgattgtgacgacggccgccatcttcgctccctgccacggccgcgtctccgcggctcgccgttgttgccgctccagcgacggccgagctgtcctggccggaggagcgaatgggcgaagcaactttcccggtgggcgactgggcgagcggatgcgctgcttcttgtagtccagccagtcgatgcctacatggttgaacacaatataatatatatatatataatgcaagaaagaacgaaagaagttaggaatcgaacgaatagagatagagattattagcgaagaac

SEQ ID NO: 61615 - DNA, 2606 bp, Oryza sativa
gtttggctgcctcttctggaaaacattcaataccctatttctcctgcaaatttattttatctacaaagtacttcatccgttttacaatataagtcattctaacatttcctacatttatattgatgttaataaatctagacatatatatctatctagattcattcatgtctagattcattaacatcagatagatatatatgtctagattcattaacatcaatagatagatatatatgtctagattcattaacatcaatataaatatgggaaatactagaatgacttacattgtgaaacagatggagtataatataaagtgagggttaataggagccatcgatatcgtcgtgaaggtataaaatcaccatgttaataaaaaaaaagagagaaaaaaatcatatgccatcatggtgaggctgacatattatagcggtgtaaactacccaaacaattcaactaattttcgcaaattgagactaatattatagcggtgtagattaatgcacaaacaattaattcaactagtttccataaagcgatagattgagattatagcggtgtagattaatacctgaaaaattgaactagctttcacaaaatttgcagtgctctgtacagacgcattagctgtcaccagaaacggcatattcttcgtgaaatccaggcaggaaccgctcctggaaagctggacaacggagtgagatttggaggcgagtgtgtgcttcgccagggcatcaacatcaagcccatccctgcggtccagttggagaagatgggtacacccccatttgtttgatgaatcgtgatccaaagcatgctaatttttgccaattgcacgcccagatcttggtcctatgtgactcgtgtccacatcactgacgccgacacatcccttccgatagatgatggaatttttactaggaacagagataaatgcatagcctttttgttacttttttacttgcaacttactcaggagtatataacttcaggagcaattttctagcatgtgcgtttcttgataattaatttaaacccatgtggatttgctctcatggagtcatggtatacaattatgaactgaacttaattacaatattaattatctgagaatgctggagaaagataaaattcttgcgtaattgatattctgaagttgtatagagactgtagctgtaacttgttttttttttttacatttataaagattgagtagaacagtttggaatgaccctatgagagcgtatgaaatcaagtttctctttggcagctggtgggcatcgtgtttatccacttgattcatgtctttgtctatgtgtactatggtatacggtctttgtcttcgtacatgccacatttcactttcaaagcaaaaatacgaacaagaatacaaaacacaagaaagaaattcagccactttattttgaaatgtttaagtgcaagggaaaaacacgtgttgacgtgtaacaggtgcagacgccaaatctttagtgcatcatcattaaagaaatgaaaaatacacaagagtagttgcatacttgcatgcatatgtttcgatcctaaagtgtgatgacatgaatcatatccttagcccgatgaacttgtttttctaaaaaaaatgagtcaaatgattagtatattgtttttttaataatggaaatggtttgtattcggactctaccgatatatatattgctatatatatcagtaaagaaggggatataaacagtacactactaaggttatgtatggcagtgcatgcagccatgttacatgtaagagaagaatctatgtccccttggtgctgattttcggccactacaaggtcatgggtgtgacagtctgacagatatatactaccttcgttttttaatagatgacactgttgactttttctcacatatttgaacactcgtcttattcaaaaattttatgcaaatgcatatgatataaatcacacttaaaatactatgagtgataaaaacaactcataacaaaataaattataattacgtaaattttttgaataagacgagtggtcaaacatatgagaaaaagtcaacggcgtcatctattaaaaaacggagggagtatgttgtaaggaataccatttcgcttcaatagaccctaacaatttcttgggtttcatcactcgtctgcacgaacttagtgctaccggtcatgctttttcctttaaaaagttaagtatgatactcaactgaaaagccatttgaaacgcagaaattatacaagaattattcaattcaagttctgaaagtgtgtgctttctggggccaaaccaccatctgagggcatattttataacaaagtagaagtggatgaattttgtaggactgaaatcccttggaaaacattttatccttttgaatactggaatgaatcctatagaatcctttgacctttgaatgaaatagctcatttcacacaaactttagaggaaatttaatataagggctagagcccttgttttctcttcattcgtgactcaaaattcttatacttttcctatgatactaccaacaaaatgatttgcaaaattctgtgccttaatttcctctacgatttgttgtggcatgataccttat

SEQ ID NO: 61616 - DNA, 1671 bp, Oryza sativa
gaatcgtgtcaaatgagggagaggagaggggtatttatagtgtggagcttgcttgggagtgtggagaacctccatggcatccaatgagcatattcactctcctcatgccaagtgtccatttggatgatggttggagcgccgaaaacggtcataaccgtcattaggaagcagttatctaccgaactggacttgggccggggcgaacggcctctaccggggttcggccgaacccctgagttcggctgaacccgagatagctctgtttgctccagttttcgtcccggacactcattttgggcccctcaattcattggtatgaatgtttgtgtaacatactgctgtaggctctccggacctcccattatatttgagagatgaagtgaatagttcaagtccaaacaaacataacgaaacatgcgacgcctcgagagaagaatattgaagacattgctgggcctttatgtcacgcccggaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaataacgatctagcgatggcttcagctccactcccacaggcagctcaactggggtataagccaaacgtcttctccttctggatcctttatcttcaaaggaggtttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccaagtataacatccataattattgtgagaggtgtgagactaatcacgaaaaacattgctcaacccgcccataaccgcgggcacggctattcgaatagttttactctggccagaggtgtaccactgtacccacaagacacaaccccacatcatatcaccatgtgcctcaataccaccacggtacctcggaaaagagttgtgacaataccccttgcacaacataacccattacagcgcacctttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataac

SEQ ID NO: 61617 - DNA, 71681 bp, Oryza sativa
atataggatcaacatgctcaaaggattgtgtttaggatctgtgtgacttggcttgcaataatcggtcttcaattaatcttctgaacacttctgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggactaagatggcgacctcgccggagattggatggtcggctgcgactttggaggacatgaacacgtagaggacgacgagacgaacccaacggtactcaccctcgaaccaaacgacgaacgacgacggccggcgacgaggtctgttggcggcgcggcttcggtcgacggcggtgacggggctccggtgaccggcggcttcgggggtcaggcggccgggattctccacacctcggcgcaccttacggcggtgacggcgaccggcggcgacgacggaagcggcggcgcgacgcggatggagctcggccggcgacgacggcggggtggagcacgtggcggcggcgctacgaggcacgggagaccacgggagagggggcaaacgaaagaggaggactagggggtcctatttatagccttgaagagatcggactcctcccgcaagaaatcgatccgggaaaatcaaaaactcggttttggagataaactcgaaaacgagttcgattcggataagatactcaacgatttgctccgatttttgggggtaaagatagaggaggataagaggaatatttcccctcagcaaaattggagaaaaagagcaacggggaggcgagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttctaatgctcaaataatttcaagaaaaatcctgaaaatacttggacactcaaagtacttaacaaaattacaattagaccatttaatgattaatttaatatgtggttaattactgaaatgctctttgtatgattaaaaattaggaattgagctccgaaaaaatctgagaaaattccagagagttgacttaatcatggagaatttaataaaaaattaaatccatccatgctttatatttaggaaattttatttcccacatttaacttcacatgtaaattaatgaacatttaatataaattctattattaatttattaaataatttataaatcctgaaacgaaaatcaggatgtgacactttagcctgccagtcaacttcagcctgagatgtgcccatcaaaccactcgaaggcggcgaccagatgtgttacacattcaggagacttgacaaaaatggctaaagatctacaacatctcaaatattcttaactcatactcatgtgaagctagtttccaggatgtgcggatgtgcactagagtcacacattcatcttaagcatgattatacgtagcaaacacaaataagatgaaagctattatagactacatctactttagttacactggctgaccggccaaataaataatagaacagcggaagcttgtttacccaatccacaagcacaccgactaggggtttaccccattaagttcaaatcctagaagaagcagtcaaaacctgcatcactcaaagactaagtttaaaacctgcaagcaaaaggttaattcaacggcaagagtcagtacattatttgaaataatatactggcaagcaccaagacaagcctaacactctacttgtaaggaatattatcaaggaaggcataatatggttcgttttagcataaagcaagttttgtttgcataaaacacatttaaatctgatttgctttcaaatagttttcagcaagctagtacttagcatatgggcatcaaagtagacattaatcatgtatgaatatgcacctcattgccatccatggcagcaaggagatcattctcaaatctcatcacaatttgaaagtaaatttcagcatttagaagaataaacacaagtctatactcaacacatatccatatgccgctcataaccgcgagcacggctaatcgattaagttttagactctgcagaatttgtacagctttacctacatgatatgaacactctagtttgtttcgagtttgcaagactctaccacattctacacgttgaatataacatacccaagcctgtaaacctgagaactaaatttaatttaaatgcatcatgtggttttggagtgattttaattgtttttggatcttaatcatctcatcatcacatgcaatgataggcctagagtcacaaaaacaattaatctggaaattatatgcatccaaaaaaaattctacaaaaattctcaaaaataccttgatatgtcagaaatcaacccacaaattttcagaattttgtttagtaaggtttgctaactccttgatctactttaatatctccaaaatcctgaaaaactgcttagcagattcaaacttgctctccctgtaaaatttatttcaaaacctctttttgatgtttggtttcagccaaagtcttctactaactttcttctaacaccccgaggagtggcacaccctggatcactctctaaccctttcttctctccctccaaaaatccaatcagctgttaactgcactgtcaactgctgctaaccaacactgtcaacacatgttcattactccatcgaacctaaaccagagacttctaacccaacccacttcagcacatttactctccacatcacccccgaccaagaggatctctagcccaggtttcttgctgttgacagaaaacacgaggcctgggagatatgcttaactccagtgcaggtccaaaactcgcctttgggtatgctagcgtgccagttgatttgatcctgcaatcaacaagaaataacggcaaagaaaccgcggttaaacctataaacgctagccgatcagctaagtgccgatgacatatcatttatctttgagccgatgtcatctatgtatcgatcggcggtcataaataagtaagaaggaactagatctactcgatcggctgtagatattaacaatatatattccttatatcgatatatacttaaatcaagtgattgggataaatcggtcgccatgccgagacagtataaatcacttagatcgaaatatatattaataacgggattatatatgttcatagcatactcgatcaaatggatctaatatgtaccgactagtactctgataccactctatactaagatattaaaacaagtataatatatcaaacaaaaatctgatatacttaaatgcgacaagatcttaacataaatggcagatttaacatatccatgaagcatatagagcaaatatagttaaatcagataagatcggctgaaaccccgatactaccctaatcggcaaccagaaggcaggctagagattaatattctaagcacgacttaatagatcaaactcaactgatgcagcattaagtatgaaaagaagaacaatatctagacaatcaagccgctggaagtttcatagagtggtggatatcccatataatctaagtcaacatcgatgtttaacctaatcggctgccctctactgacagatgttagccgataacaggttaaatagtgatattgccaaagattatgtaagatatatgataactcgacgaattacataaacaagattagagtatcgtaaagatggaagcactaatcccgagaacgcaaaccatcataacaagttttacctcttgttgaagatcgaaaccaatgcagctcaacccaaaagcaagaactcatcgaaataaaactaaagcaaaagggtggcgatgcgccgaaattgtattgaacgtgtgtgtttttttattacatggggttcggggtctatttatacccgaaaattacaaactatgtccatatcggacacgactcttatctctaacaaactctaagataccataagtctttacggcagacttttgcccgaacatatctctaaggaaattacataaaacatcctaactaatagatacaattgccttatcaggactctatccatgcgtggcaatcatcttgaagcatatcaactcaacccgatatcacacaccaagttccattgctagaatcggctgtctcggctcacccagtctgactcggactcagccgatcctaatcgtagccgatctggactccagccgattctcactctgtttcaggaccgatttccgcccttgattctgcttcgatctaatcctctttttcgatgcagatattaccaaatttggtcgttaacacttgccccccaagtccggaatatttggtaatgtttcggatttgccctgtatcgactcctagctagtttcgcactctgccgttttccgaccattaccctcaacgctttaaatactaatcaccgccctgaaaaatcttcaccccgttacttccgttttcaccgccgaagccaacctcatcccctttctctccggcgatttccccgacgctcaaggcgaccccagacaatcccatctccggccagatctccgcccgtagtgatgtcgtcctcctccagcccatctaccacaccgtcggccgagtacgctgaggtaagttctcatcggctagatcccttttcttcgcatgaaatcgatttccctctgcctcatcttgttttcttcttctctatctttgttcgcatttgtagcatccctccaatctgatagcgattcccagcctatcgcacgaaaaccattactttattggtccaatcggcaatcttgaccccattgattttatcatcggtgaaactaacagaatcccctttctaggtcattggaagaatatttttaagtcttggccatctctcgagaaaaccacccctgagaagagttggaccacatggtacaagcgtgtatcggctagtaagaaagttcactgggatgagatcgggatcggccaagcgcttgcccttaccatagccaattccgctaaggacgaacctctgatggctgccgccacctatttctagtccaacaccatcaatgccttcttgttcaaccaagggctgatgactccaactttgatcgacattaccatgatcaccggattagatgtaacttcatcggctaattctatgagcatgaacaccaagaaccaatttgacttcaggaccaagagcataggtggttggtctggttatgtggcagcatatatgggccaaggatctgttactccttgagagcatgtggcctttttactcatgtggttgggaaagtttcttttctgtggatccagttgtggccctacaaccaattggcaatttgtagccgaaaccctaaaatcaaagaaacaacttcccttgggcaaaatcctcctcggctatctataccaaatattgaacaatgcatcggccaagatagtcgtcggctcagtagttggggcaggtggaccattgtggctgctgcaaacctagctaaatctgatagtcatgaaagttgtcaatcggccatccgtgacagaagctgaatttccaaggttggagccgattatagaagatgacggagaagaacgcacccatcgtaggtgcatgtcttatgaagaatatgcatccacaccaaccgttgccggagcaaaactatcggctgaactactcaaggattggttttgcagtttttatcagagctttcataaagatgcccgaatctggtttccctatgaggactcaatggacctagatctcccgtcagactttaggtttgaggacatcaatcatgaaaaataccaaatatccaaggaagttctcatagctgcaatcagcccatgcatccttcctgtcggcattcatcagggaataaacatccaagtctcttatgaattttaccacccaataagctcgactagacaacttggactgggtcaactcccaattggcttattctttaccgataagatccagtgccgaggagaaatctcatcatctttgatgatggatcggctgctaaacctccaaggaccccctctaggcagtattgataacattgaattggcaggattcaagagcagaaactttgacagatggtggggcgaatggaagctgcacctatttcatcaatcggcttcgatgtacatgatagatctattccctgatgtcataccccaggtaaaccttatcattattaacctgagtaattgtcagccgattcattacttgactaatctcttgttcttgttctgcagacaatcgactcttcccctccacgccaaagcaacagtggcagagacattgaatatgctccaggtctaattcccaatggaggtgggccatctccccctgtcatcggctatcatgcccccaggacttcaactctcctccaaggcctaatcagggaaccagccgatgcaggcaggaaaagaagaactaggtcattggctatggacgcattagctccagctccaaagaaaagggccaaatccaagaaaaccaagtcgactgatgacctgccttctttggatccatccatcgagcaagctctagatgaagaagaaattgacgaggctgttgaccaggctcccgctgatgtaagtgatactgaggaaacaccatcggcttcacccaagcaaactcctccgactccttctgcgccagttcatttttcaagataaagcagctctctttgatcccttttgtaatcacttcacttttcggccgatcactcacagagtttattgttgcagaagaagaaaactgctatgaaaaagaagccagcagcaacaattttcaaaccggctcaaccagtaagatattttaattcttttattagttgatatcagccaattttatctaacacttgtttcttttacagcatcctcctcctcctccttctcctcctggacaacaatcatcaagtgaccgaactccatcggctgtggggagtcatcatgttgaggaagaagtacaaccaactgctcctgctatcccagtaagttttcccttgatgcaagaaattagatcggctatatctacttagctctcaatcttcctaacattgtttctgcaggttttagccgatctcttctcttttgacattagagattatcttgatgaggcagaggaagatacttcgagcaaagctctagcccccttatccgatgatgtaaagaaaacacttgaagatatctcccatcggctagaggcctcctctttagatagcttagtggtcgactgtgggtcgattaggacacgactgcatgaagttcaagctctgattcccgaagaactggccgacgtccttactccagccgcttatctcgagcagcatcaattcaagctggaaaaatgtcacgcctagaaatttagcccaaatttctagactattttgtgtatttaatccctgtccaggaccagccagggtacacaaaatgacaagtaatatacagttccaaacgtaaataaagcgtaaaatacttacagcagaggcacttagtcctcacaccgaaagagaacgacagcagcggaaaaagcgatcctagcggggcttcagctcctctccacaggcaaagctcaattggggtctgagccttggtcttctaacttcgtcttcagctcagaagcactacacttctgaaaagggggaaataatagcaaggctgagtacaaccaccgtactcagcaagccacaccattgatgcagacgtacaaggggaacacaaggatggtttgtggctatttgtataaaggcggttgtaaaacattttattgagaaaaacagtaaaactgttgagtaattaaagtaacattaaatctccactgatcaacgctacaccacgttgaacaggcccaaccaacccacctgaactacagtgcattgagtcaatttattaaagtgggactaatcacggtgaatctggtcgatcgcccataaccgcgggcacggctattcgaatagttttactctggccagaggtgtacaactgtacccacaagacacgattccacacatgtcgccatgccccaaagtatcaccatgatactgcaaagggggaaatcgtgacaagaccctgcgcataaccctcccctaaccatccacaccacgctaaggtttcacccccacccctcaaaaggcagtgggcggtctctcttgcgccgcagtgaatccggcagctggacaaccggacaccccggccgacccaactccatcacgcccaccctcgccaccggtggctaggaaagggtcaagctatacttcagatcaagcaattacccactcccgcttgtggtaagcacggtaagtctcccagggtttcccgtgaaccggtccttaactgcaatgggtgcgaccagcaaaaccatgcacccacagcccaccattcagtcgcattttagttggataaatacgaccatgaaacatggctagatgtctcgaacacgcagctcattctgatcctaaaaaggtctaatactgcagttatcccatcaaatgagctagtggtaattaagcatggctaagcatataattctagctaggtcacataagtaacatgagctagtcaatttatttgatgaaccctgagttcctctcgacactcaaggctgttgttggcccgatctttcggtgagttgtgacaactacgatttgggagaaacgttgacgatccgactacaaccgtacgagacgttgtgttgcgccttagcgatcgatacacctctccgttggttgttgatcttgccggtgcagatcaaccctattcctgcaagcaaatcgaagaaacaagcaagaacaagataaaagcaatctgatattgcaaataggaatttaatacaaatgataaattggggttccgaagaacaagcagacggacggtctagccgacacgcgcgctgcaagcaagtagcaatggctaaactttaatctaacaaaacccgagaaaccttgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgacgcaacacattgttcctgtgattctggccacacgagatggaatttagagaagaggctggatccgttagaaagagggctccgagagctttctatcaagtactcacaggccgaaaacggaggtcgtatgcagattcggtggccgtttgaagtcagcagtgtagtaggtggccgaatcggattccagcacttggagtacttgatctcgatatcttcttgttcatccatgatgtcagcaatgattgcatccgtggtagccatggtcacatcattattacccagggttgacaaaggacagatatcaagtaaacatggcacaagcgagcagataggtaatacccacatcccatgtaattagcaaaacatgcatatttatttgcaaacggtaaaacatttgtaaagtaggatcaaaacgctcaaggggaatgtgtgacttgcgttgcttcttcacttggatcttctgaacacttttcctcgcgaccgcgaacttccgaaacgacggaaactacatgttggcacgcaaaacgaggaaaaactctaataaacaccaaggaaacagtacataaaaagtaaacaaacatgtaaatctcaattttagatgaattttgcaagttgaatggtttgggcgattttatgtggtttgggcgcgagggcgcaggcgggagaggctggaatcgtgggcgacgtggggcggcatatgcgcggcatggcggcttcggctctggaggccgaaggtagaaggaagagctgacaagtggggtcttcgggcccacctgtcggcgaaagggggaggggagtcagggggttatttagactttacgcgaggggaaggtgaaatgggccgacggcttaagagaagagaggggaggccgactgaggaagggggaaggagaggggcgcggcccgcgggaggggaaggattcttgggccgaaaacggcccaaggaggaaggggattttttattttgttttctttttattttaattgataaaatgaactttgtgctattcaaattatttctcgagctccgaaaattcgcaggaaatttcagagagtttttttagggcacaaagaatattacagaatattcccggccaatgatttttaaaggaaaattttaattctcccattatttcacttaattaaattgaattaacttttatttaatttctagaaaatgcattatttaatgatttttagtcccgaacaaaaatcggggcgttacaaaaaaaccaagctaagactagccgaacgttggaagcgcaaggagattgaagccacaatccaagtcaatcgacagcttgtgcatgaagaaaaggtcaaacttgatcaactatttgagggtccgattaggtccaatattgaccggctcgaagctcgcaagatcgagctcttggcacaacttgaagaatgcaatgctgagctggacatagaacataaaaaaatagccgatctcccaaagtctgtcgaagagcagaaagcaaaactcaagaatgttgttgatctgaccaagtccctaaaggttatttctggaactgatgctcaagatgctcaagccattgaagaagtagaacaaattaggcaaagggctatttcagctatccagcaatacttgtcttggtgactttctgtgtaatagaccttagaaattttttgtaatcggctaagatactctagtactttactgtcttgacaatcctttgtgccgattaatacaacttctcaattcgcacaaaaattttcattttttgtatatatgtgcccccctaattctacaatgtcaaaagcgagaaaattataaaaacaactaagggcgatataacaatatcggccattgtacatcggcaaaccactaccgattacaatagaaaaacaactaagggcgatataacaatatcggccattgtacatcagcaaaccacaaccgattacaataaaaaaaaatctaagggcgatataatcatatcggccatctcaaggcgatgcaaacacatcggctatcgtgtattggcaatcatcagccgatcatgcattaacccaaacactagggtaatatttcttcaagtatttgccatttaatgctcttccataagacttcaccatcgagtccttccaacatgtaagcccctttagacactactttatgaatctggaacagtccatccctattcggcgaccacttgccaaatttgctatcccgagtcccaatcggcaaaatcaacttccatataagttcaccttccgaaaaatccttgggcaccactttcttgttatagtgtcgagcaattcactccttatccctagtaacctttgcaagggctcgcaaccgcgattgaaccagatcttccctcttatcggccataagattgtaatactcatcaactcttaaatccttttgtagttccgttctcctggagccgatccttgtctcccacggcagaacagcctcatggccataaacaagtttataaggagggacctagatcgatccatgacaagccatccgataagaccacaatgcttcggccaaccgagtatgccattgccgaggataatcagaaatcttccttttaatcaacttaatcaagcttttgttagatgcctcggctttcccattagcttgtgcataatatggtgaagaatttaacaatttgattcccatactatcggcaaattgaacaaactcatcggatacgaaaattgaaccttgatcagttgtaatagtttgaggaatactaaatcgtcatattatatgctcttgaacaaattgtatcgcatccccagaatcaaccttcttcaaaggaatcgcctctacccatttggtgaaataatcggtcgccaccaatataaacttatgtcctttactcgatggtggattaatcatgccgatcatatcaatgccccaacctctgaacggccatggtttaatgataggattcatagacgacgccggcgctcgctggattgctctaaatttctgacaatcttgacaccctttgtaatatctgaaacaatcttccagcattgtcggccaaaaatacccagcacgccgaagtaaccacttcatcttatgagccgattgatgagtaccacaaatcccttcatgaacttcaccgattgcaaccttagcctgatcggcactcaaacacttaagcaacaccccatcaatcgtccgataatagagctcatcatccaataaagtgtacttcaacgccttatatcttaatttccgagaagccgattgagatggattctgtaaatattgatgcacatcatacctccaatcatcggctgttattgctgcgacttcgaccttaacatctttgatcattgacttataccccgatgccccttgggccaaatcattagcttcaatattttgttctcgagatacatgcttcaaagtaaccagccgaaactccttcattaattcttagcacttctcattataaaccattaatgtatcattcttacactcttattcccctgccaattgactgattaccagcaaagaatcccccatgatttcaatagtatcggcttcaacttctttgagtaattgcaatcctttgagcactgcctcatactcagcttgattattagtttcataaggtttgatagtataagcaaactcgaaacatgcccccctaggggaaattataactaagccgataccacaaccatgagtatacaccgatccatcaaaaaataaagtccatggcacaatctcgaccgagccgattgaatcatcacggtgttccacgataaaatcggctatagcttgtcctttaatcgccttcggcgattcataccgaagatcaaactcagttaaggaaaatatccactttccaatccttcctttcaaaatcgaagccgataacatgtacttaacgacatcggctttgcagatgacggtgcattcattggacaacagataatgccccaaccttgtacatgaaaaatataagcacaagcataacttctccaaaggggaatatctagtttttgcatccaagagtcgacgactgaggtagaatacaactctttcttttccttcaagctcctgaatcaagactgagccgattaacttctcaccagctgatagatataatataaaaggtattcctttctgcggaggaatcaaaattggaggagagctaaggtattccttaatactatccaaagctttctgctgctctgccccccaagtaaactgctgaccggctttcaatctcaacaatggtgtaaaaggctctaaccgtccaaacaaattagaaataaaccttctaacaaaatttatcttgccgatcatctcttgtagttctgtcttgttctctggaggctaaatcttcttgatcgcattaacactcctttgagtcaccttgatccccctctcatgaacaagaaatctcaaaaactggccagccgatatgccaaaagcacattttgtcgggctcatcttcaggccatattttctggttctctcaaaaaccttcctgaaataggctatgtggtcttctatctccttagacttaacaaccacatcatcaatataaacctcaaccaaccagccgattagatcatgatatatgtaattcatggctctttgatatgtagctccagcactcttcaagccgaaagtcatcacaacccattcaaataagccgattgcaccaggacacctaaaagctgtcttatggatatcttcttcggccataaagatttgattgtatcctgcattaccatccataaaactcaaaatcttatgccccgaagcagcatcaaccagctaatcagctactggcattgggtattcgtctttcggggtagccttatttaagtttcggaaatcaatgcacaccctgaccttgccgttcttcttgataacaagaactatactagaaacccactcagcatatcgacaaggacgaataaaaccagcatcatataatcgtttaatctcaaccttgacaagttcaagcatatcggctttgcatctcctcggaggttgttggtgtggcctaatccctgatttgataggtagccgatgttcaacaattgatcggctgagtccaggcatttcataatactcccacgcgaagcaatctctgaattctttcaacagctctatcaacttggttgtgaattccgaggacaaattcttactaataaatgtcggccttggccgatcacctggacctatatcaatttcttccaactcatcagccgacatgaaaccctgtccttgtttgtcatcgagatcatctactgtgtcctcggtgtagacgtttgaaccctccatgacgccctcaaaataatagtttgggttctccatcttcaattgttgtatatcagaatcggacacttttagaaaatctccatcccaaacttttccagataaacaatcaagaccatccatctcccaaagagctaaatcggcactggcaacattcactgacctgttggctggcacaatttcaatcttgtcgccttgccactaaatcaagcattgatgcatggttgaagaaatacaacaattggcatgaacccaatcccttccaagcaacaagctataagaacccttcccatcgatgacaaagaacgttgtagggatggttttcttgccgactgtcagctccacattcaaaactcctttggtttctgatggattgccgccaaagtctttgagcaccatgtttgtcttgatgagatcttcagcgtttctgcccaacttcctgaatgtagtgtaaggcatcaagtttactgcagccccaccatcaaccatcatcttggacatcggtttcccatttacataaccatttatatacaatggcttaagatgccaattctccgacccctctagtttctcgaaaactgcctgctctggtgacaaaattaatttagccgattcttcttcaacttcgtcgatatcggcttgcttgatcccaaactcggcaggcaacgtgaaaaccatgttgaccgaagcagttacaacactttttcccttagccaaccttcttgcttcatcggctgtggcttcatcggctacaggaacttgattcttaacacgccactcctgcctcggcttcgttttcatcagccgatggttgatttcctgctcgacttccaaaaagcgctccctattcctcaatctttgaacccttctcttttgattcttcgtaaagataccagaaggacaccattgagtttttatgttttcactgtcctcctggccacgatcttggtttactggacccaatctttgatgaacaggaactcttgtctgccttagccgactgcccctactaaacaattggcttgaactctccgcaatatcactgcacccaggacagtcctcaatagatggcaacctcataccttcattccaacaaaatataaagaactcgcaactccaatgaggatcaaagccatcatcatcttcttcataatgcctctcctgttgtttatcatactttccctgatatttgttaataatcttagccgaatttacctgaaatcctatggcacgacccccatcggctgttcggccagctgtatgcaccatattgacaggaaaaggattgccatcaactttcatcggcctcttagaatcatcaaatttgattttacctccttcaatagccgcttggatctactgcatgaagaccttgcaattattagtcgtatgaaacccagaattatgccacttgcaataccttttcttgctcaattcttcagccgatggaattgtgtgaccggcaggaagtggaatctgcttctctcggagtagcaagtcaaaaattttgtcagccttggtgatatcaaagtcatacctttcctctttccctgagttctttacccattggcatggtataacatttttacttcttacccatttggctgcagctatctcatcctcatcatccgatccacatacataaggacagacatgattaatctttctagaattatttctcgcctctgcaaacctttgttcatacaaggttaccttctgtgttagatgggacaagctttcaaagtcttcagatgagaatttctctctaatcggagcaatcataccctgaaaagctaaatcggctaattgggcatcagtcaaacttaagctgtagcacttattcctcatctctctgaacctctgaatatactcatgcataggctcatcatgtctttgcttaattgccgtcaaatcagacaatttcatctcatgtaccccactatagaaatagctgtgaaaatgcttctccaaatcggcccaactgttaattgacccatatggcaaagaagaaaaccaagtgaaagccgatccagacaaagacaaccgaaacaacctaaccttcaaggcatccacagccgatgcttcaccacattgagctaagaatcggctaacatgttcataagttgatgtgctatcttgccctgagaactttgaaaaatctggaaccttgaaccggttaggtagaggaactctctcaaaccattcaggatatggctgtcggtataaatttccagcatctttcggcctaagcccaaactgctccttcatgacatctgcgattagatcggcccatggttgttgttgaggcgttccttgaggctgctgtggcatgggctcaaattggttgtactaaggaacaaactggggttgagccgattctgcctgctggtattgaacttgaggtgatggcggctgatattgatagttcaaattgaccccttggtaattctgaagatccggctggatgttgcgcaccaaatgctcggaaataacctgaggtatcaccgtgccatctggttgtacgtgatgaactaagtgctctgggacagcttgatttgcagcatgctgcataggctgaccaccaagcgttgcaaaccaagacgatgcattcattgagccttgctgctgaatcggcagaacaacctgttgcctaaatggcgtctgctgaatcggctgcaaaacctgccgtctcggtggcgtctgcttgctgagttggttccacaacctattggattgggggtgtttgttgaatcggctgcacaacctgctgccttggcggtgtttgctgaatcggctgctgctgggttggatcaatggtgtgttgagggggtaagaacatagatgcaacatggtcctatgttagccgattcacattccgttcagcatactgtggtgtttctctcaccaacaatcggggattaattaattagcctggagccgaaggtggtgcagcagatgcaggagctggtaatggtgccgtcggctgagccgatggcgcattaagtgggatcgactggacaactggttgattatcggtgattaatggccgataattcgggaatactccccctggtaagtaaactggtcctgtagcttggtattcggccattgaaccatcaaccattgatttcaccatgtttgccaaagtattggtcaatattccagattgattgatctaagcatggtgtacagcataatcaacctgatcttggaagttgttgaactgcaactgtgctgtattgccatcttgattagggccttcaccttgaactccctgagtaccatcaccttgaactccctatactccttgagagttatcaccttgatttccttgagaaccatctgaagcacctttgtcactcggttgagccgagccatctggagcttgtttcacctctccgtctttggaagaaccagtcccaggaatatcagcaactacctttaccttatacttctacaccatcgttcccttgcgggtttgcataaatgagctcaagaactggttgcgtgcctgctgcatcatcgcttcaaaatccttcttttgatcgggtgtcaacttgtctggagcgatgttcacgatgttgccttcattaacctcagataggcccaactgctgtatcttatctttaatagaactggggctagctgaggacggtgataatggcggcttgtcatccatgagagaaacctttgacttctaatcggtcccactaggcatgccaaaagcgtgttgacggaagacatgaggcctgggagatctgcttaactccagtgcaggtccaaaactcgccttcgggtatgctagcgtgccagctgatttgatcctgcaatcaacaagaaataatggcaaagaaaccacagttaaacctataaacgatagccgatcggctaagtgccgatgacatatcatttatctttgagccgatgtcatctatatatcgatcggcgggcataaataagtaagaaggaactagatctactcgatcggctgtagatattaacaatatatattccttatatcgatatatacttaaatcaagtgattgggatagatcggtcgccatgctgagacagtatgaatcacttagatcgaaatatatattaataatgggattatatatgttcatagcatagccgatcaaacggatctagtatgtaccggctaatactccaataccactctatactaagatattaaaacaagtataatatatcaaacaaaagtctgatatacttaaatgcgacaagatcttaacataaagggcagatttaacatatcatgaagcatatagggcaaatatagttaaatcagataagatcggctaaaaccccgatactaccctaatcggcaaccagaaggcaggctagagattaatattctaagcacgacttaatagatcaaactcaactgatgcagcattaagtatgaaaagaagaacaatatctagacaatcaagccgctggaagtttcatagagtggtggatatcccatataatctaagtcaacattgatatttaacctaatcggctgccctctactgacagatgttagccgataacaggttaaatagcgatattgccaaagattatgtaagatatatgataactcaacgaattacataaacaagattagagtatcgtaaagatggaagcgctaatcctgagaacgcaaaccatcgtaacaagttttacctcttgttgaagatcgaaaccgatgcagctcaactcgaaagcaagaactatgtccatatcggacacgactcttatctctaacaaactctaagataccataagtctttacggcagacttttgcccgaacatatctctaaggaaattacataaaacatcctaactaatagatacaattgccttctcaggactctatcaatgcgtggcaatcatcttgaagcatatcaactcaaaatgtcacacaccaagttccattgctagaatcggctgtcttggctcacccagtctgactcggactcagccgatcctaatcgtagccgatctggactctagccgattctcactctgtttcaggaccgatttccgcctttgattctgcttcgatctaatcctcttttccaatgcagatattaccaaatttggtcattaacacttgctgcacaaaatcgaccatgaatcccctccaaagatcgttggcaggcaaccctctttgacttagcctccaaggctattttcgaatttctttcactgacagtgggccccacaccccctgggacccacatgacagcctcccactctcccctcgcagcatccaccgtcccccatgcccgatggatgcccaaggaacacaatgagtgcaccagccacctctctctctctcaatcccccactccactcttccttatttcccaagccaaagcaccggaagcaacagcacactccccacactcgcgttccaagtccaagaaaacaaaccccacgcacagaatgcccagagctcggccatcttccccggctccggagacttagccgtcgtcgtcgtgcatccccggtgagtccctctctcttccctcctatggaacgtgacctacgcatcacgccgagctcacccgtaccccttttgccctaggaccaatctgtcgagcacgtggtgggcaccgtcctcgccgccggccacctgaaccgccgacgccgctccggccgccgttcctcaccaccgaagcaacaccaagatccggtgagtttctgtcggattcctcgcgcatgcaccctctgtggctcatccctaacacccccatactctcgaagttgcagttcgcgccttgagtcgacccggcgacgtcgatgccggagttttgccgccgttggccaacaaccaccgtctccgccactccctggacctcgctgcctctgtttctctgcttggtgagcaccctggtaccatatgagagcacatgcactaaccctttgcactaaccaagcctctgcatgcacatgcatgggcataccgagacacaccgccgctgtagctcatgttccatgggctacagaccaccattgccctcaccaccaccactggcggatgcgcaagaacgttctttacattttctcttttgtgctcgaaccgattcgatccgtcgattgccgccggtgaggcgtagaccgagctcagccatggctgctcctgatgtgagctagctgggaacttcatttcttgaatttgatcgactcgatctagggtccaatctgaaaactgccatgactcatattactatagcaggaccttgatggaaataaacaaaatcatagggactcttaataaagtttgctgtccaggtggcagaagaagtgcgggttgattcccccaacttccgagggcctctctgcaaatctcctttcactgtcctgtggacccggctggaattcaatttcgaaaattgatttctattttggtttaaagcagagaacgagcagaacttctaatatttgtagaaaattcattttaacttcaaaaattgtgaaaccacttctgttaaccttctaaaatcattctcagtaactttgtaaaaggaattttgttcatttctgtacaaaaatgttgcttaataaaacttagccctttttaaacctttttaattgtaaaatgcatatctctgtaaataaaaaagtgacaaaataaaaattccttcaccagaaaccacctaagaccagcacacactcactgcataagtttcatgcattttggtttttatgcatttttgtatttatcgtatacgcgtattttgtatagaggaagaatacgtcgaagaagaagagggtgagtttgttgacgaccaggttcaggagtttgcagacgaaggcaagtttgcccctcctttgaccacattgatcctatgttttattgggctaaatgattctattgcaaacatgcatacgttagctagtattaattttggtaaaaaaaattatataaatgtgggaatggtagatatgacctaattgctgcataatccaccttgaaatattgaatccatgctggttgtaaccatagagtgcttttgaatacaattattgtgttctttgggattatactatgcttatattgccgctataaccttatattcggttaccgccttgcaaattactcgttttgataaatgttatatgtgaaaatggttattttgatgttgctggacagaaatttaaatgtgtgagtattgtgaactgaaaatggagataacttgttttttagacttgggcggcgagtggtgtacatatggtggtagttgtacaccgatagggggagcgtttgcctggatcgattaaggaccccactctatgtcaccaactaatgaaaacagtacaaaccacatatgctaagtatgggctggcctcaacctattaagttgtttagagtttagccttgcatcttggtaggccgaagggtatgggttaccgggttttggtaacttatcggaacttcctatggtttgtgatatgatgaaattgattaatgacatgtggtatgtgatgatttgagcgggtagtctgtccaatacaatggtgtcatgcctcgtgagggattccgggctgggttccttacggcgctaggttaaagcgtgggcccgctacctagtggcgctaccttgctagtagcgtgggtaaaacacacatcgtgctggtgcaaggctagacaataaacaatgtaacggtttcgttatgacctctagatcacactcaatgtgtagagtctggtgataccgacgggtatcggacaaactagagcgatccatatcatgtgggcttaaaagttgtacaaactctgcagagtctaaaactaatcgattagccatgctcacggtcatgagcggcatggtgaagtgtcatgagtatagttggtgattttgataaactcttgtgaacttggaaaatggttggaatgttttgtttatgaacttgggtaaagttcggtgaatggtgatgagatgatggcgagtggtgatgatctaccttgagggggtagatgtgtgttatttatccatttacattacaagttttacttactctatactattgttataaaattccgttgcgaaacatgttgtgaactaaaattggcatttatgcaaattaacctatacacagcttatccttgaatatggccaacatgtagtatgctaggattgtttctgacttgccagtacattaatttgattaatgtactgatttcttgctttcttttacttgtttttgctcaaaccccgctgcagttaatgactgtttcgatgaggagtttgatgcagcttgtgatgttgcagatttccaggatggttctaactagggatttaccctagtcggtttgcctatgggcttttgggtagcacgcttaccgcatgaaccaatatttatggcttgtcgccaagtactacttagaaccttattaagactatttatgcttattgcttagaaccacttattattttgatatcatgcttgagatgatttatgtgagactatgttgcattcctgggcgactagtcccacatgaggatgggtttgaaatggttgagataaccagggaatatgcctttgttgagatcgagtctctggggtacgcttttggtcgccaccatcgagtggttgacggccatatgacataaatgactggtgtggctattccaacggttgtcttctatttcatatccaatggcttagagcctatgtagtgcactcttcaagacatgtcggggtctgcgatgaggttggatggttatcgtatttatttgggctttatttgagaccccatccatccagatatttcgcgctgacatgcctcggagcgttgcaccacctaggctttgggacgtcctcacattgaatgtggtctagaggtcataacgaagcctttacattatttattatctaatccttgcatgagcacgatgagtgttgttccacactaagtctagaatcttaatgtcattatattggaggggtctttaccaatataacgccataggcaagccgatacagtcgcttcctatgtggcactcaacgttgtacgtgaggcggaacattacagtcgtcccctcacgcggaacagtatagtcgttccctaccaaaccataaataaaagtgaggcgaaacgttacagtcgtcccctgataaacatcatacacataaaaggcggatcggtacagtcgtcccctttgcataaacacaaatagccctacagttcactcgtagacactatcgctactacaacggcctccctaatgcaaggatagataataaacaacttaatgagctaaggccatcccatactagcacatgtggttgcacggtatacataatgaacatacattgagtgaaaaccttaggtcggtttgggcgcacactccccctatcggtacacaactaatcaccatatgtgcaccacttgaggcccaaacctaaaattcaagttttccatcattttatttgtcaaatacttcatttattcatctatgtccagaatctaaataaaatcatttttcatgttaatatgagcccaagtgataagtaaaatcattctaagcatggctaagaatatagtaaactagtgacaatgtaactcatattccaagtagtaataggatataattactaaggttaggaatgagtgatatggatatatgtggggttaaagtgataatgcaagtaataagagtttgtctaacaagttttacaaaattttaatgtattagtgtacaatcgatatgcaagatttgcaaacattttcaataacctccaaaaacataggatcaacttgatcaaagagagagggaggtgggactttccttgaaactggaaaaaatcagcacctaaatcacttcttcaccgtttaagcaatcatctaaataaagtacacattatgcaattaaacaccgaattatgcgaaaaatccaaaatgctctaaaatgcatgatttgtgcacagtggataggtactggtctaaaatgaatttaggtgaaataatttctattttatctctttttatttgggagttatgaattttagaagtttgcttcggtataggatattatttgccaaggtagtgttataaaatattaaaatatttttacaaagtgattcttattaacttttactccacagagatgtagggaagtattttctaagactaacacatttggtttcacaatttttggagttataatgattttcttatgaattttacaagttataacgtgttgtatgcatataatgttttacatgcatatgtcttgagagctttatatccagaacataatacttcttgattgagttgagtaaaaggaataatttggttaactaatccatttttagttcataagcttatggtcttattatcgtggtttagttcataagcttatggtcttattatcgtggttcatatttttatagactaggggagatctagtctatgctagtacctagaaattactatatgagctaagttcttctaagttttggtggatggggatagaactatggctccactggtcctaataagttttatttggatttatttggagctaccatgcatatatatacttattcatatgtattgtttaaccactattatgtgtttagtacctatactaccaaattaaggtttagagctatggtctgaacagaggttgccatatttcactctactaggttgaagtatattacttgctggttctatagaaatttggttcacttcatttagactaaagatgaattttctacaaaatttacaatttaaggtatgctctatgttggttatcacttacataaatatttagaggcttttattacacagtaagtatataattttatattataacttggaagtatatgttttggtaattctacagaacttgggtttactcaaaaaggatctaacatgaattttatataaacttctaaatttcagcccacagaaaactaattattttgtttatactagttttagagacattaggtacaaagtaagtatattatcttatttcactttacagtggagaataagttggtgattctgtcgaatgtgaatttaccctaaaatgagttgagatgaattttgtatacattttataagtttatgtatactttatgtatgatttatcttatatgaattttagaggctaaatttgtactgttagtggaagtttttattccataacattaaattacataacttggtgagttcatagaaatttgtttcatctaaaaatgagctatatttaattttatatggattttacaagttttaggtacttttcttttataatctcggatttttgtttccaaagggtccactgtcagtgatttgcgaatatgcagaaagacccttcaggttttctaagaataaacccgcagtcctaggcccatatgccattgagtggaaaagttacatattgaatcttggaaaaagtacaaattacccctccgaactatcacggtcgtccgaattaccccctaccataaaaccggacattcttcacccccaactatgcaaaccggacgaattacccccctcgacccaatccgcggtggttttggtctacgtggcatacgcgtggcagtccagtcagcaacttatttattaaaaaataggtggccccacctgtcagttttttttctctctctcctatccccctctctctcttctatccctctctctctcttctccttcagagttcagacgcggcggaggcagcaagcgcgggcaggggcgaggtgaggtgaggcggcagccgctgggaggctgcgtgctgcggccgcatcgacctcgggggcctcccggtggatggcggcggcgcgagacgagggagcggcggacgagcggatggcagcgcgcggggctgggcgatgggcaggcggcggtgcgagacgagtgggcgggcgctggacgatggacgactgcatgcagcggcggaggcgtcggtgcatggcgacggcgcgagacgagggagcggcggacgggcggacggcggcatgcggggcagggcagtgggcagcggcgagggacgaggaggcggcgcgagacgagggggcgggcgcgggcggtcaacggcgcgcgatggcggagcccgacctgggacacagagctggcgggcgcgcgaaatgaggaggcggcggcgacatgggacacagagccagcgtggcgtgggatgcggcagcgacggcggacaggggcgagggcggtggctcgcttgggcggacgagggcggagggaggggaggggtcgcgacgaggagggagatcgtaatggggaggaacatgcacacgacaacgttcgcggtgaaggagctcgacacggacgacgaggagaccgaggagcgggaggccgccatggctagcatcctcgagctctaccgccgcaacctcatcgagcgccaacctcatctaccgccgctaacagccgcctccgcgcccacccgcctccggcctcgtctccttgtctaccgcacgcagccatccttgccgccatccgcccgccgccagcagccatccccaccgccggccgcccgtcggcgtcggctcctcgctagcccgccgcccgcagctatccggcccatccccgccgccatccggcctatccccgccgccggccgcccgtcggcgtcgactcctcgcccgcccacagccatccatgccgccggccgcccatcggcgtcggctcctcgcccgcccaccgcccgccgccggccacccgtcggcagtcggctcctcgcccgcccgccgcctgctttgttcaccgagagagagggggagagaggagtgaaaaagtaatgctgacaggtgggccccacctgttttatttgttttttttttgctgactgtaccgccacgtgtgtgccatgtaggctgaaaaccgctttgaatcgagatcgggttgtaatttatccggttttaagtgtttggggtgtcaaatgtccagtattatagtttatgggggtaaatcatactactgcaatagttcggggggtaattcatcatttttccttgaatcttatagttgtttaaattctcgaaatgaggtccctgtctcagtacagaggcagagcaaccatggctgagctcgatctcgggctcgccggcggcgtttggtggcttggtggggttgaggtcaaaagataaaatgaatagaacgttctcgcgattttattcctcttcgggtggcagtgcatgtgcgcctacagctatgtagtgttcaaatgggtgcatgcatgtgtggctacgaggttcctggagactcactgaaggacacactagggtcggcgatggctggacagtgacgatgacccgagaagagttccggcggcggcagagaatggcatggcgacggcgtcagcttctcctggccttcgggctgtcaaggagaggaggggaatagcttagagagaacctaggatgctttagatgcgaggaattgcgccgaagctctcccaggtttgaggaattgacgacgatggccggcgaccggagttggagaagacggcgatgatctccctcgtcggtgcacgattcttggggattcttgtgggctttagcagaggagttcatggtggtgtttgtggggcagaagctcggcttgagatccaccggattgacaggaacggcgacgcgatccacggcggcgctccaggcttgctccagatcagcgatggcgaggtccgcgttcccgaacgtccactgcatgaaatcgactgaacttaaggggaacggaacctgcactgagaggagacaagggaacggacaagagatcgagacaaccgcggctcaataggcgatgcgacggtcgtcatccttgcggccggcgatggagttatgggcggcggagaagcagggctctctctctcggtttcatcggctcaagagcgagagtgaatgagaggtgacgcggctttgagttttggaggagaagctttcacgctgccacgatagtgaacacgcatcgagcacccttcttgccatcgatctctctctctcgcctgtgcttgccagttgaagcggtggaggaggtaatggacagggttgagctagccttaggcactgtcgagtgggcccagatcgatggaaccaaggctacggagagtgagatgggtagaagtctgagtgaacttgatttttagtttaattttcggaattattttctcctctaactttgtaactccataatttaatgtgtggaccagattaattagtgtagataattagtgtagattttactgatggtagatgtttatatctagattccattttctttggttacacccaagaataatgggtagactgctcacagaaattagacaaagatgggctattcaaaagttagatcaaatttttaggagacctaaacagaagataaaaattctaaaaaatatatatttattcatgataagtaatctagtatttaaataaattatttaccatattcacttatgtgcagttaaatgtacttttggatgaagtatggctttagtcgattaaagtttaatttgatttcttatagttgtctgctttgactgattaatttgacgcatcaaacttagttattaatttgtaccaatattacagtgaatttcttatgctaaacatagtttacataaattttccatgattttatcttgcatagattattttaaagaattagaatgacctttctttgtatatgtgttcctacttcataaatgcatctaatattattatagggttttttattaaacttcttttaagctgagaagatgatatttgagtttaaccttaagtccacatgttatcttctcaaagttagctatagatatgcttagtgaaataattcttttaggttatgctcatgaatcctaacatgagatgcaaaccaaaatccaaatacttaaggacctaagtcaagtcatcctttatgcatatgcgtgcacacatgtatgattgcatttatgctcaggttaggaatgaaaaggctttatttgtttctcaaattttatttatgcaatagcttaggttggtctcaccacctaagttaaaacggaaatttttggctcttaaaattgtagaagttagcttataactattttgccaagaaattttaagtcctaaaatttcaggtatgtgacacataccaggattttcatctaggaaaaattttgaggaaaatttaaaactttttgaaagctaatgcaattgagaatatattagttggtaatagagttaaaatcctgtaaatagaattaaaacacaaagttttgttggaacaagattagagctaagccaaaatttgattttataaaatcttgagttaacaaatctcaattcaaataagttggtttaaccataaaataggaatttaattctttaggttctgcatttctaacctaagcaaaatatttgtgctaaatagaaacaaatggagatataagatttaaaataagcaaaacttaaaatggaaataaatagacttggttgtatgtgcattttattattttaggttttttttggatattcttggtgcatctcataataggtttcatatgcatgtcatttctaaagaaaactcctaaaaataaatcaagcaacaataaattgcaccaaaattctcataaatactaaacaacatcctaagtctacagtaattttagttttaatttatcacatcaattggtacctcaaatagttccaacaactcacctagaaatatggaaaaacagcatatcatttagcctactttacaccttcaccaaaatttaaccataacttatctagctaaaccacttggtcagaatgttaactgtagtatactctaccacctggtgaatgacttaattaaattcaaaatgtaaccatatgaaataagaaccacaagttgcttaaacaatatttagactgcagtcaacatagtaactttactaaattaccatggtaactcaaaaagtaattaaatcttgaaacttggcacattgaaccatcaaatccttgtccactttgcagcaaccttgtctccccaaaattctaaattaaatggaagagagaagagggattaaaaccacatattagaataaattcaacactttgaaaatttaaagcttctaggcctcttgttctatttctctctcttacaagtgggaccaagccattgtgggacccatgtgagatcctcatcacagccaactcatcatctacatacttctcatttaatttatttttcatttctcaaaaggtgagagaagagttaaaatacaattttcaccaaattcataccctacctcactaattcttctaggaagcatctacatggacccacttatcattcacacatcagctatacaccttagttaaaaacactccattgatctttcttttgtttaaatcaaagacaaagaaagagagagggagtataaatcaattttcaccctagaacctaaccatacctcacatcttctcctaggaaatcactaaatgagaccacatgacagtcattataactacattgggtaaggtataagtggtagcacagcctaaaccatgccaactcactcaaaatcgtgtcaacaccacatatggacacctagctttcaccatgccacctcaatcttcaccattaactaaaccgactagccacagcaatattcgtcacaccctcatcgtgttccactaggcaaaacactacgaaacctcggagaagcctagaacatctcattcttctctcaatccgaaggtgtttgatccaatcttagagacctctggtgagcttcgccgcacaataatcatggaaaaatgatctgtaaataatgcctaactcgttcatgtcctttgttttgcctgttgcatggatcgaacatcttgtgtcgagctcgtcggtgtcctcggtgtccagagcgccgccgctcgttgcgccgccgttcccgtcgatctcgtccatctcagagcaaaccgctgcaccatcatcttctccaaggttccaggaggaggccatccaagcgaatcgcgctgaagagccgccgacaaagagatccttactttcttcctcaactccggccaatcgccgccgtcgtcgattccttcttctccggtgagctcaaaacaaattcctcgcatatggagtatccctatgacctagctaacaccgagcaatcgcatgcatggcagctcgttgcgggaattaagctagcgtcgtcttcccggagtttttgctgccaccgccatgtctctacgttgtcaggacctccctagccctgtgcacggtttggtgagcttcttggacacccttaaacacacatgcatgcatcgatttgtccagggcaagctcataacttcatatgtatcgtagccttgaagccactgccgctcgcgctgcctccggcatcaatcccggccatcttcggcgacaaggcgaacatcgtcgggtgcgcaagagcctggcgcacttttctcattttgggtgcgacgtcggcctcgccgccgttcgccgccgacatcgacgtcaagccgccggccggtgaagctctgatgctgctgctgtttcctcctctgccgagcctatgacaggttgaccccacttcattaagcaccaataactgtaattagaaaatagtttaaatcggcggccggtcacatttagcggcggccggtccggtactaaccttctccggtcgtgtgtgttggcgctgtcggtgtgtgggtggtggtttttattttcctttttcctgattacgaccctctagggttgtaatcttgcaattttttccttctctatagaaattcgcaccgtcttgtgcgagccgttaaaaaaaagaaaatagtttaaatcatgtagggttctatttgtaaataactagagcatgacatgtgggacctgaatctaattataaatatacaaaaacttgagcactcttaatgaaaatagaattagacatgtgctagggacgtcgggacctaatcctagaaactccagggactattctgcacattttcctcactgaccggtggacccaatccttttaaaatctggaaaacagtaagaaaaatactcaaaccaataattgttcaacagaaaaatgaccaaacttgtaagatgcatataaaatccattttagcccattttgtgatgaatcaaatttctgtgaactcacaaacttatgaactttaatttagaaacataaaacttggcacttacagtagaagaaatagctctaataattcacataacaattaatgaacatagagcaatctctaacttagaaattcatataaaattcatcttaacttaatttggagtgaaccaagttccagtgtgctcacaaaatcatacgcttgatttacatgaactaaaacttgatacgttctgtattaaaatcatcaccaactatttaattggtaaaataactaggatggtgtaaattagaaactatcaaatccataagtaattcattttaactccaaatgggcaaaactaaaatttttttagtttcatggaggcatgtacattagttctgtaaacaaatcttagaagaaaacatatctagaaacatcactaaaacttgaataatgagttaatattaaagaacggtttagaaacttctgaaattcatatcaaaatgaatacaactgcaaatgaagtgattccagttctgttagattggcaaaatcatgtacttagtttttataaattaaaatatggcacttacagtacccaaaacttgtataaaatttgaaatagttaacaactactataataaatcacttagcttgtaaaattcataataaaatcatgctaactttaaaaattatgaaaccaattttgttgaactcctgtgagcattcccttcactgcagcaagctagaatttcacaaaacttgaccctaaaatgcacctaaggactactagagcttaattgatctagtgctagtattaaactttgaaaatttataactccctaatgcaaagtaataaaatataaattctttcacctaaattcatcttagaccagtacctaaccacactagtaaactcatgcattttagagcattttgaatttttatatgttttggcatttatcgttaccgttatttcttttagatggtgaattcgttatcagtgaggtgattggatttatagctaggaaggtctcatatcaaccaaggcaagtgttgccattcttttgaacatattgaatcctatatttttgggctaaatattttgattgtaaagttgcacgcgtaattctgattaacggtactttcaaaactatagattgtagttctacctttaaaagatgcatgaatcccctttttaaaatcaccccttgctgttttgaaccttaggattaattagattactttaattgtgctcatatgagtatgctatgcttttataaagtgtaaatgcttagccttgcctagtaataaataaaaacatggttatggatcacttattatacttttgaaaacccttttgaacattatggacagaggtgattctctgattatttgtgaaataaaatgagataaaatgtaattttagacttgggcggcaagtggtatgcatatggtagtagttgcataccgatagggggagtgttcgcctgagtcgattaaggaccaaacatgatatcatccattgtgtttaccgtacatccacatgtgtctttatggggggatcttggcctattaagttaagcacttgtctaaccttttattcgggaggccgttgtagtataggtaggggccacgagtgtactgtgggctacctagaggaactacccatgtgtgtgttgaaccttaggacgagtgtactgttcctaagtgtgtgatcgtaggatgataaattccctacgtgtgtgatttccatgaggggatgagtgtactgttccgcctcatggcatgggcgtctaagtctgtccaatacaacgatactgtgccacgttggtgggttcccgttgtgtccactaccacggcgttaagtttaaggcgtgggctcgccacttaatggttctcagtcatataacgtgtatggcctaggatggaggaacacgtatcgtgctcatgcaaggttagaaaatacttaatgtaaaagcctcgttgtgacctctagactagagatgaaaacggtcggaaatggtcggaaacggtacattattttattttttttttgaaaacgaacggaaacggtcgggaaatctccatatttatgaattcatctatttagtgccaacttcaatgccacattgacataaattaaaaaactaaattttgaaaacggtaacatcggtaaaaatattattattatattagttttgccgaaacggtattggtacggtcgggaacttttcataccgttttcacccttactctagaccgtactcaatgtgtagagtatagtggtaccgacgggtaccggacaaactagaccgattcacatcatgtgggtaaagctgtacaaactctgcagagttctaaaaactaatcgattagccgtgctcacggtcataagcgacatgatgatgtgttatgtgtataattttgtgctttctaaatgtttttaaaactaaatgatttgagatgatgataagattgatatatgtgatgtgattgccttacttcccgttatgttgtaagggaatgatgtctatctatgttgatatcatgccatgattaatatgctttacatattgcttaaatgatttgcttaaattgcgttacaaatggtttgccaactaaaattggctttatgctgaaaatagagaccacaaatagccttcctttgacttagagctttcatgtatgtaggttcgatagtgcccttgcaagtaatgtactgagtcttgccatgttttgtctaatttatgttttgcaggaataggcttagtttaagttgagtgatgcgggtttcgactgcttcttctaggatttgaacttaatggggtaaacccctagtcggtgtgcttgaggattgggtagtcaagcttccgctgttctctgatatagttatatttggctggtcggcctattgttggtatttcttaacgacatcactagaaatataatttccagcaatggcgcagaaatacttctggtatattatggttacagagttcatccgcaagcgcacggatataccattgtagcatttcacccgagagtattccaagggtatcgtatttattttatcctgtgggaagatcatgtagagagagcttgactaataatttatatattacttgtgataatcatattctaaacaggggttaagataatccaagggtagagtgacacaccagcattaactactcattctcataataaatcatctaagctaagtggaaagaaaagaggaagaaaatctattcctatacttctaatatacatagtatacatacattctagttaattgatatactagctaataccctttatccgatgctctcctggtacttcgagaagccatccctgactaccgagttccttacgacagcccgttatgaccatacaaccgaggctaaatacggaggaataccctccccagggaattaacttaggattatataccggcgcggaggaatacccgtactgagctgtcaccatcagcggcccacctctcacccacaatatataaccccaaataatgatatcccgtaatctagacaccacgtctaaactaccagatactactctaatatcatcgtcatgacatagagtaattgcataagcaaacaatatacccgcaccaaagcatctcccagataagctagccgtatatttagtataacatgaacataatataaagtaggcattcatatactcggaaagtatttcaataccataaatatatttagaagagtattctaataaaagtacaaagcttacaaaagagaagagaaaagctactagagccatacctgaactcttccgaaggcttccggactcctgatttctactctattcctattccaccagctagatactactaaactaaacttgagagaaatgagagagctattgcttgaggtgtgtgagtgaagtgagaatgagaactccttttatagcctcccaataacggttgtgacggttggaatggtcggaaataccctccaaccgccattgggggctaatccacaccgtccaggcgaagccctggatcggatggcgctggttcggtcgaacctggggccgacccaatccagtccaatttcggctggtagcctcctccgttgttcttctatgcagacttgtgaattttggcccagtttgtcacgtcaattctgagttcttggcccattcatacataagtctggttctcaacatcatccgattgatttatcatttctcctccactttattatcattctctacaaaaggttagtatacctaatactagtggaatattattattctaacaaacatatgcattgcaagcatcactagttctcgtctattttggtaatattgacggtcgaaactgaaagataacgaccgtcaacacctatgtatctatttagtagttgtaatctaaattttatttgctttagatgtattttgctatgtatattcatgcttgagatgaaagtgtgaatctagtgcacatcctgggaactagattcacatgagtatgagttaggaatatttgagatgttgtagatcttttgccatttttgtcaaatctcctgaatgtgtaacacatctggtcgccacctttgagtggtttgacgggcatatctcaggctgaagttgaccggcaggctaaaggcccagcaatgtctccaatattcctctctcgaggcgtcggatatttcattatgcttgtttgatgacttgaattattcatttcatctctcaattataatggaaggtccggagagcctacgacagtttggcccatttggaggtttttaattgggtttatgggtccaaaactccttaagttcggatacgagtttgattctcatcctccttcatgtatatttcctctcaaccttggtagtttatcacctgcatacgaatatacaccaacactcatgaaaatcgttagaaataaaccccaccactatgttggatgttttatatttattgtttatgcagatattgacggcgttaatttggtacttaacagccgtcaacaaacccccacacttagctctttactcgtcccgagtaaaggttacggattaatgtggaataaaattgtccaagatataatacaagtacaccaatcattctaagccatacctgtacctgtgaacttttgaagtgtctaacttaccatattgggcaattgatgaatggaacggtcgtgactcaagtcctccttattcctcctgtcaatcttttagggttttcatatattttcgcaaagtagctatactcctcaaatgaccttctctcaaatcactcatgtggttttatttgttgatcctcaccaaggcatgtttgccgaattgtccctattctaaaggctgtataggtggagctcggtagggatcaatcagggcatacatgcatcacatatattgcaaagccaaaataccggatccaaggagatagcaagtcatactctctgatcaagaatgtgcatgtgtgtgatatgtgtatggttgttttgtgggtagaaaaaggaaaataaaagatgacaactcctttgatatacctcctctaattttctctctttggaaacttgagagagtgcatggctatctcttttttttttctttttctttcttctttttatcatgcctcgtactttgtatgagcaatattttttttcttctctcatttttatcaatgctccatatttgtatgagcaagactttatttttttccctatttttcataaccatgcctttctctctctctttttttttctttgaaagaatttcggaggaagaggcataaatgacatggagtatttattttatggataatggataaaataaatgatagatgagagatgctaacttccagtgtagaagtttagcataatgtgtgtatgtggagtgtgcgtgcgatcttgatcatgaaagtatgaaaagcatctcacacggatcacaataatttgacaaagctcaatgtaatgacatgcagcctaaacatatacaaggtttttgcaatgataatcatatatggccttggaaggtaataatatagtcactgaggagtattgctcgaaaaagttttaattttcacaaaacaaaatcctaagaatcatgacagttggacaggaatttcttttatcataaccatatcacatatatcaattacttagattagcaaggttccctatgatagatggttgttcacaagtgacaagtgttagcaaagaataaaaagtatacatgatcaatcataggaaaattctatttgttgagagttaatgttttgaatttttatttggagtcaaactaaattgtattcaaattttctgccaagttaactcacaaacatgagaggataagggaggagatgcgcaaacatgaccacacgacagaagggtgacagagccgggccatgcaagggtacggtgaacacttagttcagccgacccaaccaggacctggttctgagtgctaaactttgtgcgcggccgtgggctggtgttcatcatattatcatgttgagtcgatgttgttgcgtgtcgggagttcgaaaaagactcccccacacttgttttgtaccttgtctttattcaaaaacatcgaaaagaaaaataggcttccaccggggtaaagtaccggtgagccaaattttattcaagtaactctaggcgtatgaagtgcctaaatttattttattttattccacttttatttttttatttttttattattttttatggcaacaatgagcatggtggattccctagcagggcggatatatgacgcaatgatacacagggtgtttgatatttttaccagatcggacttactaagctttgaaccgaatcgactgtaacaaagtattgcatttgctctgcttggttccctgtgcatctctctcataaaccaaggagcatggtatgggtgttagagttattgtatattgctccttagttgtctctttttatttcctgcaaaaagttagtggatagcaaatacccgagggactacaaatatttgaaaagattttatcatagcctcaagattagttgttcacatccatgctaaaaaggaattggattcaaaacttaataagcatggatcccataaaattgccataattttattttttttgttattatttttttctttttactcgagagacattttttttctttttctttgaaaacaaaattttctttttttttcttttttttaatttcttttttttgttgttcaccaaattttcatttaagcaaaactcatacagggctaaggtaaatttacataacatagcaaaggagcatttggcaatatacataccgtgcaccttgagaggtgatatgtttctcctttgtctgttttggcaattgatttgttcctggcccttggcatacctccagtgtgactcgtgcttgagaactcacccatcaaattgaaaaatttcctgcaggggttagtccacgaaggatatacatctgaagtccgtgaaagtactggctctagggttcatttaagcaaacttgacaccacgtcaaatttgattaaagcaggctatttatcctaagcatcatgcttaatttaaaaagcctatgaatgtcgacgaccacccaaaccatagcatacgaaaatagagtaaggacgcataaccatgtatgatcaagctagactcaattacagataagtatgagtaaaagaaatggtgaatcttttgctgtatacctgagtgtacttaccgccagtatgatgtatatgttgaaatcccttggagcgctggcatggtcacatgtgattgtcgatctctcctccgtcttgatgcggggtgtggaggaggaaggcactttgaccatgccaattcaagcgagtggttcggttatgcacacatctcgggtgcaaaaaccttgtgccttgaaggcgtgttccgttggcacaatgttgtagagatgtaggatgcatctcttcttggcaaaatatgcaagtgccaactggagtgtagcagcaaacacctaggaaagaagaggacatctcctctggcttaaatgcgtgtaggtgctgcgggagcgagacgttgtgcacagttaggagtggatgaagggtaaaccaaaccggcacatgagctcaagagaggggctgggtgcagtcaggcagcatgatcgctactagcgaggagtatagccatattttaaagactcgcacataatgcggtctttgatctagatgtagcccaacacccctcttgctctcttcctcttcttccatgtttcatttctttttttctcccgtctctcttttcttcttagcaaggtagaactaacaccaactacaaagcaagatggccttggttgatggaactcgtcatgcaagctcattggcctccccttacacttggacttttgtgtcgcaaaacattaaaaaccaagtgtgtgatgttagagtcttcataaagtgtgtttcaacaccaaggatcaccaaaatgtacagttgacgtagctcccgagttcttaggcatcatacatccctcgttcttaatgtcaacctgaaatggttattgaccaagaatacccgaaggtgcataatatcctaaaaactggttcttccttttattggaaagaaaacttaccaagataatccaaggtatctcccggcagtgctttgtttatggtcacaagctcaacctttgagacatctcactgcaagattagtgccacaaacacatacgagatttgcaatatttatgataaataaaagtatccacaaccacacttctaatcatgttagaaatgaggaccataaggtggttatggttctcgcacaaggaagtgatactattcggacagaactctgaggattctttatgtgagcatgattcctgaggaaatttgaaagagaaactttcatgctcaaaagtgtcgttctcatcctccagagttgatgtctcaaggttgtccatggcctgcagtttctccttctcaagagatgcatcgtgcaagaatgaggttgtttcttgacaactgtcgagaacaacatcttgatggcaagagggacaaggttcaggctcgataggaggttgtgatggtggttctttggagtgcaattcaagagtctcgccataatctttttgaatgaaatgaagatcatcttgttctagaatagattcaggggactcataaagcagaaccgccattacttcctctatcggcgtattattaggaagatgaccgtcaagattttctcataataggtatgaggatcatccctgaatttagaagcacaacccggagcttgaatttctttggaatccagtgatagctccagggaggactctttagtcagacccgaagctgttgaaggctcgggttcaggctttgcaaaagaaggttcctcccttcctggcacaaatgcctctagatggagttcaacacactgcccgacaaaggatgtattttccgctatgcgatcaagaatttctttgctttcgacgggagttttatgcatgaatgaccctccagccgttatgtcaaggtagaatgcagactccctatctaaacccgtatgaaaatgctgcaatagcatgtaatcgagtatagacagggttgggccagactgaactaaattagtgaatctggactaggctgcaccaattgattctttatttatctgctggaaactcaggatttctacacgaagagtagtaatacgggttactaggaagaaggcaagacagaatctgtctcgcaacttttcccaactaccgtttacacatccaacggtagaggtgtaccattgctttgctctctcttgaagggagaatggaaaaaatttccaccgcacattttcttgtctcatgccacgaatcttaaggcacgagctgacttgctcaaagtctcgtagatgatggtagggattttctagatcaaagccggaaaatggattttccctcaccatactaattagttcgggacgaatttcatagccagtggtataaatgggctccgatgaagaaggtggctcatagaattcgtcccgaggaacagacaactgttggtatttcttatgatcacagatagaatccgcaagtggacggatataccgatgtagcacttcccctacggagtattataagggtatcgaatccaagggaacatgtgtgctcagagcttcctccggttcatccaaggacaccaagcaaatgataggccaggatagagaggattcactagtgagaaacagtgtctagggaaagcttaattttaatcctaacgcaatacttcaggcactggcaacccgctgttccgagatgtcgctctactacatacccggacagggaggacttcagtgatctcgagggctatcaccacctctacacccacctcaacgtactgtgggatacgcaacaattactggataacaattacctacacaccacgtctaagcaattactatctactttagtgtttataactcaccaaagcaatcactatattttagttgattatagtgaacaataatcccgtatgctaattaggaactaaccaagaggttattcactgatgttttgatgaagttcacaacccctccttgtatggatgcaaaattctcctcactttagtctgattttcctcccaacaccaaggtttatcatctgcatacaaatatacaccaacacttgtggaatatgtgagattaagcacctatcactatgttggatgttttattatctgatctttatgcagatgttggcgggccaacacgcggggagcggatcacccggcggcggcgtatgcgatcagctccggaggtgcaagccttcggtcggcaacgtagtagccatcctacgcggggagcggatcacccggcggcggtgtatgcgatcggctcgaaggtgcgagccttcagtcggcaacgcagtagctgtcctgcgcggggagcggatcacccggtgtcggcgagtagtacccaggcaacgaggggtgtcaatgttggtatttcttaacaacattactagaaatataattcccagcaatggcgcagaaatacttctggtatattatggttacagagttcatccgcaagcgcacggatataccattgtagcatttcacccgagagtattccaagggtatcgtatttattttatcccgtgggaagatcatgtagagagagcttgactaataatttatatattacttgtgataatcatattctaaacagggcttaagataatccaagggtagagtgacacacaagcatgaactactcattctcataataaatcatctaagctaagtggaaagaaaagagaaataaaatatatttctatacttctattatacatagtatacatacattctagttaactgatatactagctaataccctctatccgatgccctcctggtacttcgagaagccacccctgactaccgagttccttacgacagcccgtcatgaccatacaaccagggttaaatacggaggaataccctccctaggaaattaacttaggattatatatcggcgcggaggaatacccgtactgagctgtcactatcagcagcccacctctcattcacaatatataaccccaaataatgatatcctgtaatccggacaccacgtctaaactaccagatactactcaaatatcatcgtcatgacatcgagtaattgcataagcaaacattatacccgcaccaaagcatatcccagataagctagccatatattcagtataacataaacataatgtaaagtaggtactcatatactcggaaagtatttcaataccataaatgtataaagaagagtattctaataaaagtacaaagcttacaaaagagaagagaagagctactagagccatactcgaactcttccgaaggcttccggactcctgatttctactctgttcctattccaccagctagatactactaaactaaacttgagagaaatgagaaagctattgcttgaagtgtgtgagtgaagtgagaatggcaacttcttatatagcctcccaatgaaggttgtgacggttagaatggtcggaaataccctccaaccgtcattgggggctaatccacaccatccaggcgaagccctagatcggatggcgccgaggagggttcggccgaacctggggccggcccaatccaacccaatttcagctggcggccgcctctgttgcttctatttgcagacttgtgaattttggcccaattcttcatatcaattctgagtgcatggcccatttatacataattctggttctcgacatcgtccgattgatttgtcatctgtgttgatgtcgattctcctccactttattgtcattctctgcaaaagattagtatacctagtactagtggaagtttattattctaacaaatatatgcattgcaagcatcacttgttctcctctattttagtaatattgacggtcgaaactgatcgataacgaccgtcaacagtcaagcccccgagccagtggcgaagtcggcgaagaccacccggacgatgaatgaggcgaagcccccgagtccgtggcgaggtcggcaaagggcacccggacgatgagggaggcgaagcccccgagtccgtggcgaggtcggcgtagagcacccggacgacgggggaggcgaagctcccgagcctgtggcggtgtcggtgcagagcgcccggacaacgagggaggcgaagcccccaagtccgtggcgggtcggcaaagaacacccggacatcgagggaggcaaaatccctgagtccgtggtgaggtcggtgtagaacgcctgggcagcaagggaggcgaagcccccgaatccgttggtgggtcggcgtagagcgcctggacaacaagggaggcaaagcccccaagtccgtggcgggtcggcgaagaacacccggatgtcgagggaggcgaaatccttgagtccgtggtgaggtcggtgtagagcgcccagagaacgtaggcgtgcaccagacgaagtcgagccgcgttagtcacgcgagggccgaagcccccaggtgtgctgcgtcgtttcccgggtgtagtcgcgtgcgcccggcttccgcagacggactggactttgtgcaggacacgctcgattagcggcacggccaaagcccactgtgctgcggtgaatggcttgatctcgatctccctttgtacatgcgtacaataggataaacataagactgaattagtcatagtaataatcaatctgattagaaatcaatttaattagcagcaaggagattagatgcatatgtcgtatcctggctccctgcttgtcccttggcatgccaggcatgcagatcgatctgacgcattggctgtgcatgctagggccagtgcatggctgtttcatgcgctgacaggtttgcatggctgtcgtggtgatgcaatcttccagggcagcagcaggtccatcccggccagtgcaagcgcgacggcggctcagtcagtgatcacgccgacgaccagcatgcaccatagctccgctcgcgaaagtagccatcgatgcccatgcataattatagatcaatctacgttagttacttaaaaaaacaagatcaatctaatatacaagaattcagaatgtcaaacccggcgaataagggatcatgcgacgaatgccgcatagccaaatccatgtgagctggccggggcaaagcccccggatatgcggtggaggcagtgtagccgaatccatgcgagccgcaccaaccacacgagggtagaagccccgggcatagaggatcgtagatgccgccagcgacatgcatgtcgcttatcttgtgcatggcagatcctccaagcatgcgctcatctcgcgcacgtcgctcgtctcgtgcatgggcatcatgcgtggctgtgcagggcagcgcagtgcggcgcacggggacgaggcggcagtcgacgggctgcgccacacactgtgatttcctgcatcgccttgcgctgcgcacgtcatcaacgatctcatcgaccgtggcacctggtaacgtcgatgattgaagccatctcctccttgaagaacacgatctagcgcccccctacctggtgcgccaactgtcgatttctatgatcggcaatatattttacggggtgcgcaagatcaaggagagatggtgatgcaggtgtttatcctggttcaggccctcgagaagaggtaataccctacgtccagtgtgtttttctctgtatttgggtggaaaaatgaactcagaagccaagagagaagaaggtagaagtctcggaaatcctccggcctagggaccccttccccctcttatataggatgaggggggagggttacaaggaaagtatctagttgattgcaactagatcctcctattccatctataaagatatgcatgatacccgagatttatatcttatcccggaaatctctctttctttatttacaagtatgccgcaggggcctagcacacttggcccaccccatgcgatgcggcccaaggtttgttgttgggtacctgggtatcgtgtaccccacagctgccacggcacacgcgatgggttgctgcttgtctgtgctgagagttctgtagttcggaaaaacacccccaggcagaaaaactgggccctgagtttgatgctcagctatcgtgccgtcaaccatagatttgatcatgtaggtcaaaggtattgaccagcattcccgattggttgaccaaagcatgatgaacggtgtaatcaacctggtcctgcaaaagcttgagtgcctcgagttcttcctcccgattgtcgcctttggccttgtcatcattggcggcacttgtttctgtgtcatccttgtttgacagaactaccttgtatttatgaaccatagtgccggagcgagttggtgcgaatgaatgcagaaatcggtttgcaagtcatctttcatcttctcaaattctgccttctgctccggggtcaacttgtccatcattatcgggatgacattttctggatcgagctctcctttcttgaggtttgccaacagttcacgaaagtcggtcccaccaagcgtgccaagaaagcgtgttgacatgaaaaacatgcactggcctaagagatctgcttaactctagtacaggtccaaagaaattgcctttgggctctgagcgtgccagctggtttgatcctgcaaccaaaaagatagaaaaagaggcaaagagttaaatccatcaacaatagctaatcggctggattgccgataacgtatcgtccgaggccatgcggatgtaacttgcaggtcccaagaaattgccttcgggttctgagcgtgccagctggtttgatcctacaaccaacaagatagaaaaagaagcaaagagttaaatccatcaacgatagccgatcggctggattgccgatgacgtatcgtccgaggccatgccgatgtaacttgcgtcagatcggcagaggcagataaaaacttggagattgttgggtctactcgatcggctgtagatgtcaacgatacgtaatccatccaatggaacatgcttagatagagtgattgggagatcggtcactgcaccaagacaagacagtataaatcacttaatatctaaatgcattccaaagtagggattatgtatgctcacagcatagccgatggggtaaacctaacgtgtatcggctaatactccgataccaccttataccaagataccagcgcagatgaaatatacaacactgaaaccaatctaacgagcaaagtaagctagcaaactgataagaagcttaacatactttaaacggatgagatctcgatataaggggcagatttagatgatccagaaccaaataaggaaacaagaagactaaatcaggtaagatcagctgaaactccgatgctatctctattagtaatcaaagaaagagctagatagaacgtttcaagacagtacttaacagatcgaacctaactgatgcaacattaagcatgaaaagaaacataagatctaatcaaattgatgaaaactcatccaagatggtagatacactgcatagtctaacttgatatcgaagccaaaacctatcgaccgttttcgatgatagaggctagccgataaagcttagatgacgagatcaatctagattgtgtggtatatatgataactcggcggtttgcatagacaggattagagtgtcatgaagatgtaagcactaatcccaagaacgcaagccgccatgacaagatttacctcttcgtcggagatcgaacccgatgcagcccaactcgaaagcaaaaactcgtcgaaacaacaaaaatagaaaagggtggcgatgcaccgaagtaaactcgtcgaaacaacaaaaatagaaaagggtggcgatgcaccgaagtattattgaacagtcgtcacttgatttcatggtatcggatcatatttatacccgaagtacataacatgtccttgctggatacgactcttatctctgacacaacttaaaatacgaatgagtcctttaggtggactcttaccaaaatatctctaaggaaactgaaaaatgtcctaattaatagatacaattgcccaattgcccttttaggactccaatccttcctaagactggttgcatcagcttggctccgctggatctgatgtttagccgatatgtagcagccgattcatgcggtagccaatgctgcttgtaagcgatgcgtgttctgctttctcgaactgaacttccccaaatcggctttgactctagcttcgaatccgtcccatggcattaccaaatttggtcgttaacatagacttcgaaagatcatattttgatcacacgaactctgaatcgacccgttcaagtctcttaatttttgttataacctaaagaaccatgtgcctttcttttatgtactgttattgcttctttataggcttgtagctttgcttgtgtgcttcgcgtagctcctgtcgttccgcaggttcctaaagcgtggttcgtggttgtcgccgaaggttcggaaggccgttctctctaagcaaggcaagtcgcatcatccttgagcatattgaatcccagtttataaaattattttattttaatttattgcattaccgctttatttaaattcccgcgttctcactcttttatttagcattacctattaatccttgttatagcctcatgattgatattgttagtatcaccttgtttaccttaggaaaataaaaccctaactagtgggaacactattcatggttccactagtataaacttaggtagatgcttggctggttaatcaggcaacactaggtggttttataactttagactttgggaattctcatatcatttggacattatggaatggttggcttatgtggaattggacacacacctcccactctattcaaaacccccaaaatggttctaggctgggctatagtagcacctcagccatcataaggaccggtcttcgggcctctgttgcaaagcactaccgtactaaccacatgtctaatgggtaaggcttaactcggtgctcagtctaatcctgaacaaaaaagacacagatggagatggctgaagtcgttgcgatggatatctctgaggcaaatgaaggctacatgggcgggtgttcggtagtcaagatgtcgtggcacaggtcacacccggtggatgtcctgctgctaggggctcaaccataacttacctgtccaaggggttccggccgtaggcgggtgttgggtcggtgcttttgtttacagctaagatgggtaaagggttatgtcacatttttatgacgggttccaaggccatggaatgcggcgtaaagatgtgtcttatgggtaaagttgtacacctctgatcagagtataatctattcgaatagccgcgccctcggttatgggcaggcctagcaatgtatccaagttagtggtttaattcttaaaacttacttaacaactaaaatgaatgtttggtctgggttggtttgggacaagctaggacctgggtttggttgtcagttcggtctaaatcatcgtaggccttgggctaaggcaggttcgtgtgggttcacggacttaattaataacactgtgtagctctaggattgtgtttataaaacagctttgagcaactaagtgacttttaaatgctgtttactgtaaaacctaattactcattgtaccctttgcattaatcatgcatcttccgggtgacttgctgagtaatgtggttgtacttattcttgctctatctttttcccttcagtaagataagctctggagaagaagtcctgggtggagtcctggcttataccccagttaagtgtctgtaaagataaagccgtaggcccactaatctgctgttgtttattttcgttgtcacggggtattttctagttatctgaacatgttatccctctcctgaaccccagccccctcgcgccgggaccttatccctctcctaaacccccaccccctcccccgaccctttcccgttcctccttcctccggccggtgcggcgcccctcccctctccaacaatggattcttgcgctctcttcctctctaccccgcgaccacctcctcctctcgtccccgcgcaccgccgccgacccctcgcgagccgctcaggcctccgccgccgggagggttgcccctgcagctgcgcctcctcctcttcctcctccggtcgtgccggttctcaggaccgcccgcccaggccttggcagcagaagcagcggacgcagcgtcccggccgcggcgaggccatcgacccagtcggcttcctcgccaagcacggcatctccgaccgcgcgttcgcgcagttcctccgtgaccggtacgttctccgagcgtctcgtatggcagggtgcaacctccggtttcccctctgctaaattcgttctaactggtcgactgatgccttgactgggtgtttgtacacatctccttccatatattgctgacagatttgcctgattttccaaaatggttgggatttttgtacgcattgactagctaattccccctaccgtcagaaacaggaggtggaagtggttgtgattttgtcaagaaatcgttgaattgcttccttggtagggtgggcttgatttgcgtgactagttagttatccatcagaaaaagaggtggtacttttttttttcccaaatgagcacagcctgtttgcatgcggtgagggaaagtgggcaacagctgacagccattccagcttcttggtggtgctggcgaagtggcaaaaaaacccagcttcttagcaccagaatcaggctgatggaagttccatagtttcaaattaggtgttgaactgtagatagaattatggaaggaggggcaaggtatggagatgaaccagaaggttgatgaagtacagccagaaaaacaaggagctctgatgaagtaacactgcgagaagggagacaaggaagccaggaaggagagttgctgctaagcatgcaacagaccagcctaaatatagcagtttgtgcattgattccatgatagaacccagcgtgtgcatcataaaagcatcgtatcagtaagatcatatgtgaacagattctctcatcttatctcgctttttattattaggtacaaagctttgaaagaccgtcgatgggagctgcactctcgtctaattgatctgaaagaggcatcttctgggtaattatcctaccatcttggcatctggttttgttgtcattcttgggttctttggtagtgtgatgtgcccattggcctgttcgtgcttcttcttcttttttttttctgtttttctttttgctgatataggtttgagttaatgggcatgcatcgacatcggcagcaccgtgtggatttcatggagtgggcaccaggtatagattatcttggagacaggtctgcattgctagtctgttatacggccataattaatactctctccagtcacaaaagaatgtcatcttaggatgcatgctctcaacacaactttgacaatatgtactgtttaaaatgtaggttttgggcacatgaaaatgatataaccaagtttgtgataacaaaagcttttattacattacaactgtcacttctttttagatttatgcaaaagaactaaatatttaagattctcattgacctttaaaagtccaaggcaacatccttttttggctggatggagtaaccttaaatcttgatatatgtgtatgaagataaataacagaaagcatgtttaactaaatttacaagatgatgtgaaaattgtcatggagctatttacaactcttgtgcgataatattcttaatcctttgctcttctgaacaaaatgatgattgcattttgctgctatgtccccagcagaaccagctttaacacacaaaggctgtcatgatcatctgtatttacaattgtaacacatcaacatgtaatctgttatggccctgtttcaaaggtcggaggataaaaaataggcagctcgtccttggttcgctggccagagcttctccctccactttgtctctaagattctgctgatctagactggactgggtcaatggtctaaccgatgggtcaacagtcggatctcatgagccatactgtacttttaaacagattttagagaatattagcctagttggttatccaatgcagtgtgaagcgacaggtcttggatttgaactgagcctcacacgtaatttttagatgctccacatgctgcatctgatattgtgggtcggcagaaatgacctctctgtttgcttgggtgaaaaaaaagccattggttgaaccgggattttcctgggtcaactgtacaaatggtcctgattactggactggtctaatccaggccatcatgttggtgtggctcttataactatgcctattagagcaggtataatagggccgtaccagtaggccacgtcgattttgatggtggctggaggggagagagagcacaagccggtgactaattagtcactggctgctcgcgcgctcctatttagacgcattaaattttcgcccagtgcagcccatgctgatgctgcaatccgtgtgggttccagccttccaggcagccgacgatgccaagtccgcggtgtcactaccttggactggtcctcgacgttggcaagcaacaagtgaatggaatctcattatctaaaaaacaagagaatggaatcttgaggaggaactgaagaagttgaccagtaaaagagaagatgcgctggatctgagataggaaggacaccacaggttgagggagctgggcaatccagagctttggagctccgcggctcacacccaagcactgtggcagcgtgctcgtcccacttgttaccgagctcggtgactgcggatggcccatgtcccacggaatctccagctcaatggtgctgggctcggaccctgagctagtctgtggcgttcttgtcccctgtctatcaagatccgtgctccaaaactgctccgatgagcctgtaacaatggaggtagaaaaagagaaatggaaggaaagatggagaacgtggtgaatgtgggcccataaagtatatgttggatttgtgctagagctagctgttggagtagttggctgtatgaatatctgtagctgacatggaagtatcacactgccacacagactattacagtaagcagcgggctatattattagacttgctcttagagaagtgggaaatactataggatttacattattcttttcttgctcaatgaaaaaagaaagcatcctgcatactatgcgatgcttgaccttactaagagatagaaatactagagggcataaagtttatgcaaaaagacgacagcatcctaaagaactattagataacttaatgatgtaaacgtcatagttttctttatacactagaaagcttgaaatgctcatttaagcaatacctactattttgggtttctttcaattgtcttatcctccccaaattaggttttccctttgtatctacattactaacaactgctcccttcgtcccttatacactctaattttagcctaagaatttctcccacaaaggctttattaatagagtgggttccactagaactctttaatgctacttcatccttttcttctcgttttagtcatcataccagtaaaactccttcctcttcattctctctgcactaatgaagggcatagtagtcttttaacctcctacttaatctgtctttgactagccgaaagtacaatcttttagtgatggagggagtatctcttctttcatgcaccgtttttatcaacacgaacatatctgccactttaagatataatcttattcgacaatcaagatgctactatgtgatttataattgatatagttctgggtattatgtcctgtttgtgattcttttttgttttaacattaactgagtatgtgttacatttatttacagaaaattgtaatgtcatgtaggtgctcgttattgttctgtagtgggtgattttaatcagtggtcaactactgaaaattgtgcacgcgaaggtcatttgggacatgatgattttggatattggactatcatacttgaagataaacttagggaagggcaagaaccagatgaatattatttccaagagtacaactacgcagatgattatgacaaaggtgataatggtgttgatgtggaagaattgatccacagaatgaacgaagagtattgggaacctggagaaattaagtcacagaagtctcggttagaggtggttgctaagctatatgagcaaatgtttggtccaaatggtccacaaacagaggaggaactaggtgacatacctgatgctgaaacaagatataatgagtggaaagccttgcagaaggatgattcagcaagttcgttgccttgctatgatatcattgataatgggcaggagtttgacattttcaatgttgcaaccgatcgagtgtcatttgaaaaatttcaaggaaaatcaccacctcttgcttactgggttgaaatgaggaaagggcgaaaagcttggttggagaaatatgttccagcaatttctcataaagacaagtaccgtgtttattttaacactcctgatggtggtttggaacgcattcctgcttgggctacttatgttcttccaggttctcccaacttatcattgtaatgatattcttctattattatagattggcttgcaatacatgtattgtcattgttactgtaagtactgcagtttgtctcagtacaatgctgacttaattgaaaaggtagtaaatgacgatacagatttagtaaaagatgttgtcacatttttttttattgctagatcttcataaatggctacaggtttattaatgattattatcattggtaattataaggtttgttgtgataagctgacatgattacacaagttgcatgttgttttcttgcaaagatttttctttagtttgtaatattaatagttctactttaaatagctcttgcactttgcacatacattattagattattttgttaaatgttaatgccatctttacttgtcgagctcacagctctcgtgttcaattttccaatccaggttaaataataattcaaaattctagtttttgtgtagatgctgaagggaagcagtcctatgcagtacactgggatcctcctccagaagaaatttataaatggagatttgaacggccgaaggtcaaaggttcacttaggatatacgaatgtcatgttggaataagtggatcggagcaaaaaatatcgtcatttcaggagttcacatcaaatgtatttcctaacacctgcctttcggtgttttgtggttactcttaacttcattatcaacttttgtttcttccattaggtcctccctcatataaaagatgctggctataatgctattcaattgattggaattgtggaacacaaggattactcttctgttggctataaggtgagaatttactgatttaaacagcatattgtaataatatacaatatttctctgtggtctttttctgtagcaaagattggagttcaaccactcggtagcaataatatcacagaatataaccccataatggattctatcaaaccttgctctcgaacccatcatgcttgtaatcatgtagattcacttatacttgggtggaatcttgttaaaccatccttttccttgttgccatgtaattgtttacccattcttggtaccattttctctgcaatgtgaggtaaccttgttcctgctgtcaggtaaacactttactgctttgagtaagctatcacaaacttcaagtcaactccactggagttccaacaagactataaagggctacccttgcccaaatggaagttaaattcaatgaaccattaaaatgctggctatgctgatcgctgataaaatcaaacgaaatgtggtgtaaccttgattctacaattggaaacatacttatggtttacacctttacacttaaccacactgagcagagtgatgtactttgtagtccaaaacttcaaatatatctaagtgtctgggaatatatacagtgtaaaatgagatttttgaaatatattctgctataccatacagtcagacaataataatgaacatcgtaaacttttacaaactaatatacatgggatctaatgatgcttcagataactttctagctttcaggaggtttcgggagttatggaggaaaaaaactattcgttgtaatcagagaatttatgttgttaaaataactgccacaatgatttttctccgatgtagaattacatccagaagctacactgtaaatgattactgcatttataaacaatagaaatcttccactgtattcaactctttttagaatattccatttctgtatagttgtcttagaaaaaatgtgttgtatttgcaggtcaccaattatttttcagtcagtagcagatttggctcgccagatgacttcaaaaaactagtggatgaggcacacggtttgcttctcaaatataattattttgagcaacaatggaaattcacacagtaatttaaaaactcatgcttattcatgtggtagtcctgagcttactgcacgcgttatatttgaggcaggccttgcacaaaacgttctttgcattaaaatattttctgttttcttgcttttggcaaagttgaatttccaggtcatagtaaaaagagtatcgcattttggtatgtctaactgtgctactaggtagtgcaaagtgcaatttactctaaaaataacaatgaagtctttgtgtttgatatcttcttggtgcttttcatgcattctgttatgcatgcaagtttgaaatatcacaagtggcatatctgtagcaaattgtcctataatttggtagcactatattatgaagtgaaacagtcacaagaattaacatctgtgccttttcacacccttgtggtttgctcaggccttggattagtggtgcttcttgatattgtccactcctatgcatcagcagatgaattggttggcttatccctctttgatggttctaatgattgttacttccacagcggtacgtaacattatatctactgctttttgttccttattgtaaactttgttttactgaggattatatgtagaattatatgtaaactctttttctgcttttttattgtattgtttcaatttgtaaataataagttttcattcaccatgtttgctctatggcaaatgtcttaccacgactaaatgagttcaacttaataaactcaagaaggaccatcatccttgctcataggagccaaatttacagttttgtttacaaacatttataggtgggttgaactgcttaatatgaggaaagcatcctgttcttgtagaccaagattaacttgataaataattgggtaaattggatccatgcaattgtaaatttgcctattcagataaatggcattaccatcgtctatttgtagctgtgccactgaaattttacaaaattaagaccgtgttactgccatcacattttccatgcttctccttttttttttttagttttcttcctttctcccgtcgtcttccctctcctgtcctctcttccttactcgcgccaaacaacgctcggtgtagcgagggccaaggaggcgacggcgatggccaagggcgcggtgacaacgtcctcccggatctggggtggccggggactaggaaggtggcgctcgcagaggcctggcccgcccgagcgtggggtggtgtccagctcaggttgctagaggcggcggcttcaaggcgctcgtgctaggtgccggtgacctcgaaatccaagagcgacaaggtggtctcctccgcttttgtgctcgttggcgggtgactacctctgcttccatgctcgttggcgggcgacctattgtagcgtcgacaaggaaggggacgttccggacctcatgccgcggccgctcgtcttcgatcttatcccgctggccggagaggacggggttcgctgtctggatctgccggtacaaatgggagtgagtcgacgacaacgatgacgatgatggctcttgagccctcgcgcccccagcctactcaagcacaagctcgccgccacctgccccgagctccttccgccggccgaagaggatggaatttgcaagatctagctcggtggagacgccgacgccgcaggagcagagactaagggcaatgatccccggccccatcaaccgccatccttcttgctctaccccttccccttcaacagtcattgctgatgccgtggagctcctccccgagggagccagagcttgccagccagcgtggtcaacgcaagaagatgggaagagagaaggaagaagatggaaaaaggagatggaggaaaacgtgatggcagtggcacggtccgtcttatttgaaaaattttgaaaaaaattaaaaacaaaagtcacgagtaaattactattcatattttatcatctcataacaacaaaaatactaattataaaaaatttacaaataagacggacgatcaaaggtaggcgtggaaactcatggttgcacttataatgggacggaggtagtaatattctagtggcacggctacgaatagatgaattgtaatgacatttatctaaataggcacatttgcaatggcatggatccaatttaccctaaataatttggtccaacagcagtagtaaaagttaaaacaatagcagtcaacatctagcataatatatgataggttacgttggccatacacaggaaaaaaatcgtgcaatttcctctcaacttgatattcatattgtatatattgcatgaatttaatgattagttggtagctgtttgacctgatttgtgccctgtgtacttgcctgttcatatggacaactgattggtagaagtaacatactgatactattaagtaaaaggcccatgaaatttgtactgacatgcctagcattaatgtttgttgtcgaatggacaactatgccacgtcgaaaggcgtggttctctcaacagcagttggaatgtaaaagcaattgtattgattcgtgaaatatttttggggatccccccattacatggccctagaggtttatttatagccttagcacaagcttgcaccttctagtgtttagggttacaggggattttacatggttgcccttatgaaagggacatttacatgggtatgcagtgtcatttgcacatatgggcctttaatgggctgataggctgggcctggtctatggcaaacgggcctaaaaggccgggggcagcctgttgggcctccttgatgccgaactcgtcatggcgaagtctttgtagtttgcccgagatgcctttactttcggaataccgacgcggctttccagccttcgccatcttcgcttatggctttcgccatagggcttcgcctgaatggccttgacgtctttggcttgaatccttgatggtactatagtttcggcaggtccggccgaagggcttcatggcatgcctccaacaagcccctcacgggcaagagtgagtaaggagctttggccgagaccgtgcaaactatacggtatggcatgaggcgtcccctttcggccgatgttcctgccgaaacctctttttagactcctgcagaaaaaatatgaacactggcgttcgcctttcgagaatggcgaagctgtattatgacactgggtgattatattttgccaagtttgtctgctttgcgcgattcttgacttgtatttttttctttccccttttccctattgttttagcggggatttcgccgaaactcatgcgttcggcccccttttggggattggcgaaaagatttgttgacttttcagctttcgacttccgttttcgactcgtagcattttgcgttgggaaaaacgcttgtgttttgcgtaagttgaatgtaacggcgttcggtatctttattccgaaacaagctgtcgcggtttcaacgttcggcgagcgatgcttcggccgattcgtttcgcccccctggcgttttcgtcgatcaagcgttcgccttttatgtagctatgtggttgtcaaaatggcgaattggaggcgaagacatcctggtcgaaccttagaggattacgaccggtgccacatccagcgccacgatgccattgccttactttggttagacttcgaaatgactaatcatcaagttgttatcgcttgacgtcggtgtgtatttcgcttccttccccccttagagtcgtgtatagtatagatgaagaaccgtgttcgcgggacttagtaggggcgaggcaaaaatgttctgaaacggatgatgtaattttttgctcctttgtataacacgtatgtgcttttgcccgacggagcttgtgcgtgtttttatgtttcttttcgctatcattgcattttgtaacttgtacgttcggaagggcaaggcctgtcggcccccttgcgtgttagcgaaaggaattcacattgacttttcagccctcatcattcgctctcgacttttggcatgtgcgtccagaaacgcttaagtatttgcataagtcgagtgtagcgacgatcggtatgttttccgaaaacgagctgtcgcggtttcaacgttcggcgagctgtgcttcggccgattcgtatcggccccctggcgttttcatcgatcaaatgtttgccttggggtttttccacgaaatatcatacacaaaaatggcgaagacacccatgaattttatatgactaagcgtcagtttgccattgcccagcgtcgacgcagcattatccccgtttttccttcttcaccgctaaatttttttttgtgttgatctaacaactagcgatgaagaagatgctcaagggggtagtccttcgccatttgaggactgcttttgttaatgaatcggatgtaaagtccaaatgccttttggcgggcaatggaatttatctgtaactttgctttttggcaaataaatggggtgtggtgcgtgttacggctgttcggctcgtactttcccctttttgccttttggcaaaggtatttttaggtactatgatcgttttgaccgttgccggctttcggtctttttagcacttcgacctttttaattgttaccggcttacggtcatttctttagtgctgctagggttttgtcgttcgtcccttttggctgccccgtttgtctgcgggtgtgcaaccgatgcgaactcgatttcaagttttagcccctcgcacatttccttggacttctcggagtcaaaccgcttgttattgccggtaatgaactctttcggcataccgaatcggcagaaaatgctttttcgaacggatttttacactagtgccgaaggtactgccttagcccatcgaaggcggcttgacactcaggtgtccaattgagtttgccggccccttggagcatcttgaaaaatgataaatctctttcggttgctcttgggagcaactccttaactcattttcgcccctagcccttgtcgccgtacctcgctggtactgtggcgaaaggcgtgggtgtggcgaaacctgtttgcccgcagcccttggcgccgtaccttattggtactatggcgaagggcatggcgtgtggcaaaagctgttcgcccgcagctcttgacgccataccttaatggtattgtggtgaagggtatgggtatggcgaaaggctccagaggctagggtggcctcatagcccctgagcttggaagcaactcattttcgtccccagcccttgtcgccgtaccttgcgggtactgtggcgaagggtgtgggtgtggcgaaaggctccagaggctagggtagcctcgtagccccccagcttggaagcaacttattttcgcccccagcccttgacgccataccttattggtactatggcgaagggtgtggcgtgtggcaatacaccgtgcctcgtgtggcgaaacctcttcgtccgcagcccttgacgccgtgccatattggcactatggcgaagggcgtgggttggcgaaacctgttcgcccgcagcccttgacaccgtgcctcgtgtggcgaaacctcttcgtccgcagcccttgacgccgtgccatattggcactatggcgaagggcgtgggttggcgaaacctgttcgcccgcagcccttgacaccgtgcctcgtgtggcgaaacctcttcgcccgcagcccttgacgccgtgccatattggcactatggcgaagggcgtgggttggcgaaacctgttcgcccgcagcccttgacgccgtgccttattggcactaaggcgaagggcgtgggtggacaaaacctcttcgcccgcaacccttgacgccgtacctcattggtactatggcgaagggtatggcgtgtggcgaaacttcttcgcccgcagcccttgacgccgtgccatattggcactatggcgaagggcgtgggttggcgaaatttgttcgcccgcagcccttgacgccgttccttattggcactatggcgaagggcgtgggtgtggcgaaacctcttcgcccgcaagcccttgacgccgtaccttattggtactatggcgcaaggcgtgggtgtggcgaaacctgttcgcccgcagcccttgacgcagtacgttattggtactatggcgaagggcgtgggtgggcgaaacctgttcgcccgcaccccttgacgccgtacctcattggtactatggcgaagggtatggcgtggacaaaacctgttcgcccgcagcccttgacgccgtgccatattggcactatggcgaagggcgtgggtggacgaaacctcttgatgccgtacctcattggcactatggcgaagggcgtgggtggacgaaacctgttcgcccgcaaccaacctcttcgcccgcagcccttgacgccgtgccttattggcactatggcgaagggcgtgggttggcgaaacctgttcgcccgcagcccttgacgccgtgccttattggcactatggcgaagggcgtggcgtgtggcgaaaggtgtccagaggcttgggcggcttcgtagccccccagcttggacttaactcactttcgccccaagcccttgtcgccgtaccgcgcgggtactgtggcgaagggtgtgggtgtggtgaaaggggttccatttcgccttttcggtctgggttccccacggacggcgccagctgttgtcgaatggacaactatgccacgtcgaaaggcgtggttctcatgtaaaagcaattgtattgattcgtgaaatatttttggggatccccccattacatggccctagaggtttatttatagccttagcacaagcttgcaccttctaggatttagggttacaggggattttacatggttgcccttatgaaagggacatttacatgggtatgcaatgtcatttgaacatatgggcctttaatgggctgataggctgggcctggtctatggcaaacgggcctaaaaggccaggggcggcctgttgggcctccttgatgccgaactcgtcatggcgaagtctttgtagttcgcccgagatgccttcgcccgagatgcctttactttcggaataccgacgcggctttccagccttcgccatcttcgcttatggctttcgccatagggcttcgcctgaatggccttgacgtctttggcttgaatccttgctggtactatagtttcggcaggtccggccgaagggcttcatggcatgcctccaacaatgttgaatgctgcatgtggtttgacatgttgtattatttaaatttcatatgttctacacatcttaaatttcgtatttccctaagactgatttttttttatgcttctttgctactacaacatccttgttgtaattgatccttggcaggaaaacgagggcaccacaaatactggggtaccagaatgttcaaatatgatgatattgatgttctacacttcttattgtctaatttaaattggtaaaatctaagcatatgctttcatgctgctgtcttatgttccgaatactatcaaaatttgattcttttctgttctataatctaccagtaacttaaggacatctggctaattttactaggtgggtcactgaataccgtgttgatggattccagtttcactcactgccttctatgttatatactcataatggcttttctactttcactggtgccactgaagagtaagttctacgctttcactattttcctaaaacattagtcactacatttctgcagtatgttgatgttctacaattttccagaaccatatctgctctttataatcttaaattcttaattgtaggtattacaatcaatacgtcgatgaggatgcgctgatatatttaattatagcaaatgagatgttgcatgagcttcatccagatattataacaatagctgaggatgtaagttgttgttatacttggtttcttttcctgtaaatttatgttcacgtcacataattatcagttttagatatgcagtttggtattgagatatagttatcaccaatgtgcaacttggtactgcccttcggttgcaactattgtaacactgagatgcctgtctaacagagtcataggcatacatgctttctatttagtgactgtaggtcgctatctctacctattaaaatggatactagttgcaatttccaaactaatattgtgttagtttggcatgtgttggtccttcagttttttttacagtgttttgtttatacaggcaacattttatcctgggctatgtgagccaaccactcaaggcggattaggatttgattactgggtcaatctttcaattcctgaaatgtggttgtggcatcttgaaaatgttcctgaagcaagaatggagcatgaataaggtctgcatgctatctaaatatttttgcatgccatcgtttgtgtggcaagatgtcttgggaattcagggtttcagtttatgcattattttccttatggaattccatcttgatgattatatgccaggacaatggttttccaaatctccaattatagtttccctgcatttgttattgttgaagtatcatatttcttatccaatgactatcttggactatgctgtcacagattatgagagtactagtaaacaacaacagtaatatgctatcttacgtcgaaaatcacaaccaggtgatactatttgtctaattttgtctgttgctactaattatatcatgttattattactgtaatctcttcttactgaaagaaacagcacagatcctgcacatggttgagaaaacatataatgttaatatgtattatatcatgcttagaaacagcaaacttctatttcaccatagtgtaatattcttttaccaagtcactttctgagaaacttgaccaatttgattaactgtgtatagtgcattttgctactagcatatggtagccatttttatcctggcatattgggcttaatcgcaataaaagtctcaattatttcactagtgataattcttgtatattgacactgtacctcatttccttaaatttagagatttgttcaattatctctctagggcatggttttttccctgaacgtaccttataatgacatatgttggtgctcttttcttaagatgcatattttggtgctctctgcttagacattgctgaatagctggctgtatcataatattgtgagattggtttgaacaagggcatgggcagatgtgtaaaactcatgcttcattgtcttttgtactgatactatgcttgcgtaatgcatatatgtccatgaatttcagaatcctagttatgttttctggaatcctaatcaaatatttttggaatccttatggagggacactctacgtggttttctgcatgctgcttctttactttataggaatctttagatgtgtattcatgaaagcccaaacttgggaaaaaaaaccccaaatttttttttgagaatatattcattatttattttctcaccaaactttgggattaggttctcacatctaatattttggtacagtcaatatcagggcggaaatcttttgctgaaataattctttatgaaggaaagtgttcaaatagttctgttgacaatgatttgattttcagggcttcctcattgctcaatgtatgactatccctaacttgtaattttaatattgtatactttgattcattattgcacctcttaatttctttggtatagcccctgtaggaaatgatgaaaaatatttagtttacatcgtcagttctttgcatttggtcagttctttgcatttggttatggtagtgtcatgaacttagttcatgacagggaaaacattagttggaggtaggtcggatggcaagaacatgatcaggtggcttctcatagctgcccctaacatgtgatactaatagatatgctaacaaacaagagataagcatttgatctgaactaattttaagatgaggaaatatctagatgagaagcattcttgccttgctgcgtggctggcccagtaactagggatacacataggtcgactcgaggtctgacccatggtacccaaggtgataaattacaggccgggtcaagctgacccacgtatctttgcttgacccattgactcatggaacctcatgcattgacccattgaccctgaccccttgtgcattcaggcgcagcttgcaaatcaacgcacaaaccagcagatcccatgcatgcgagcaaaccaattgatgcggcacagagaaatgcttctgaaaatctgagcagacaaacacaatccgagcatataaactcatacatagcaaaccaattgctctgaattttttcactcaagaatggatctgaatacaatcagatgaaaatcccacacttgacctatagcagatggagaacaatctgcgcgcctagcagtgccaaatcgatccatctgagccaaccctttcttcagtggtagccaggaacaatggcgcagggccgagaacagcgcagggacgaggtggtaggacaaagcactgggaggtgatgcagatggcggcgacggctgagcatctgtgcatactcagtaggaggcaggtgggtcgacccacctctatatggccatggtgggtcgacccatgctgacccatgaaggccctgtttagtacccaaacaaaaatttttcaccctgtcacatcgaatttttagacacatgcatggagtattaaatatggacaaaaaaaaaactcattacacatattgcatgtaaattgcgagacaaatcttttaagcctaattgcgccatgatttgacaatatggtgctaaacatttgctaatgacggattaattaggcttaataaatctgtctctcagtttacaggcggaatctgtaatttgttttgttattagtctacgtttaatacttaaaatgtgtgtccgtatatccgatgtgacatgccaaaaattttcattcgcgaactaaacaggcctgaaatttgatgggtaaacccatgtgagtttgaccccatattcccacgtgcatccctactagtgacctgctacacatagagcccatgctccaagcctatgacagtagcgcactgctgtgtgtcagtgcagatggtgaacattattggccacatgctggtcaggtaaggttgcctgaattattttggccaactttaatcttcatagcctcaaatccaacctagctcatcctctaagcaagctgtagctcagctggactggtatgagataagggacctctgtgtttataggctttctgtatttattttattttatgacattccttatcataggaattgatgagcaataaattttacgttctgccaaaaataatcttctttcacatgtttcagataatcaaactaattacttttacaacaagtggtggtgcatatctcaacttcattggaaatgaatttgcacatccaaaggtgaggtacctacattacattcagaatttgatagccttacttcaatttcaattttgtgagcttgatctctcattttttgcagtagaccttctaagcattttttgttattatttcagagaattgagtttcctatgtcaagcaatgactattccttctgcctagctaatcggcaatgggacctgctggacaagggtgtccataaacatatattcaactttgacaaggtatgtaattacaagttaggaggcaaggaaaacagtctttgctgaaaacatgtgacatctgttaacatgtaatctctgaatcagtactattagtagttcttccttagctagtaagcatagtataggtcagtagaactttttctttctccaataagctagacctgctagtaagtcacgtatgttttccttggtcagcaagtcaagtagtcttacacagtaagctttcttagccaacaaggtggtgtttgaatctcctgaagatgaagattaagtgtttcacgcaaaatgaggtggtaataacgtgtgattaattgagttttaattattacaaacttgaaaaatagattaatgtcatattttagaacaactttaatatagaaagttttcgcccaaaacgcaccgtttagcagttcgaaaagcgtgccacttttatccaaaagtttatctagtttttgttggagaaaagtctagtagctgctgcctccacatgtactatatgtatgccaatatgcaatgcaagctaagcttttcagcagcacataatcaggttttcagctagactttaggttaccaaacatccagttttatcagcgggtcctaaaatatttggatttgtatagagaatcaacaccctttattacagaaaatgagctatacatgttgaccatagagacatttttgtgtttttgttgcattttccccaataaaacaagttctgagttgaaaacttttgaacaaaatggtctgatttatttgtcacaagcgtcaagggtgaccccccacaccccccccccctaaaaatgcactgtagatagtagatattgtacgactcatagggcataggaaaaacaagtcctggatgtcctttctggttcttgataccgaaaataagtttttaatgaatctgatgtttcttcagaatttgttttctattacaataacaaaagaatctcttttatatttcaactattgatggctggctcaaaacattgttgtgctatgaatgtgaatgatttgaactaacacgtaccaatttcatcccaggatatcatgagcttagatggcaaagagaggctaatttctgggggttcacccattgttcatcactgtgatgacactagcatggtatgtacatcttttgttaacagaagatcaaacctattttacaaactaataaaggtgatgctttttttgttcttttattttggtaactttatcattttaatcatagtattaattataaacatgcataatgttggattagggatagagaaagcaaatgtgtgaacaattgtaccttttagccccaaaaatacagtatgttgtcataccagtttaaaagtaggcaatatcagtagaagagaagcagaaaggtggggaaactctccctatacttaggccttgtttagtttgcgaaaagaaaatttttgggtgtcacatcgaaccggatatcggacatgaatgaaaaaactaatttcataactcacctggaaaccgcgagacgaatttattaagcctaattaatccgtcattagaacatgtgggttactgtagcacttatagctaatcatggactaattaggctcaaaagatttgtctcgcaatttccatgcaaattatgcaattagtttttcattttatctatatttaatgctccatgcatgtgtttaaagattcgatgtgacgtttttgggaaaaaaattttggaactaaacaaggccttaaaatgccctttaacaactatcatccctctaaaatgcgtagcatattgcaataccattgcatttgatagggtttccaatcaacataaacaatccgtagtccaaatcttgaaaaattgaaattgttgttgttgtgtgcaactcttagaaaaatttcatgtagatcttttccacttcaaagattattgcagaaacaaacttggtgttatcctagtccatagatcataataaggtgttttacacactgatttactgaggagagtgtttaacatatgctctgctttctttaaagcttccatccataaattatctgctaaactagagtgggttagtatactccgtaccaagtccataaggttataaagttatacctttcagctgctccatattattgagatttgtcaggaatggaatattaaaccactattccattttcttcaagatacttagtcaaagagccaggaattgttcgtaaggtgcattttccaatgacacaataaaaaacatcaaggcctgaaacgggaactgaagctaaattccttctcatggatgggacatagagaacattatttagatgaaggatgaagccgctttccaaactcaatgaaagttatcca

SEQ ID NO: 61618 - DNA, 728 bp, Oryza sativa
cttcctcacgtgtaaccacgtgccacataccaccacggtatacagacggaagacgtgacatagtttctaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaacggtccttatatggccgaggtgctactatcaaaaccatgcaccccgagcccagcctaaaaccattttggggattttgaatagaaggagcggtgtgaagccaatttcacaataaccaaaccattccatagagtccaggtgatatgaatattcccaaagtctagagttgaaaaaaaccacctaatgttacctaattaaaatagcgaagcatctacctaaaatcatgctagtggtaccatgagtagagtgcccactagttggggttttgtttaatctagggtgaacaaggtaataataacaataacaataataataaggtcataacaaaggtaaataggcatggctagataaaacagtgataacgc

SEQ ID NO: 61619 - DNA, 3158 bp, Oryza sativa
tacgaggcttacaaatatttgtggcgaaaatatcgcgggtttacgtttataccctacgtagcaggtagcactagccaggggtggggcccgtgtggtgcgctttttgtgggacccacgatgggtgtactttgcactttgggggtggctggtggggcacacctgtcaggccttatctgcgacgtgattggttgacggggaataccccatccggcaggaaggcctgggattgggcggagccggatttttggtggggccacggcgttttgctacgggacgcccggagtcctgtccaccgtcgccctcgcggttgatgcggctcgcaacgccgctggcagtgggcccattctaggcctgccgctgaaaagtctttctaggaatatatagggcctatttgggggagttgttctgagaaagaactggtagtgcttctgaaaatccggaaaagccgggtttttcagcttctgtcttctagttcatttttaggattttacaactacagcttctcagaatctggaccaaaagctgaactgtttgggagagcttctgattctgggagaagccgcagcagctagaagctcccccaagcaagcccagtttctttttagatataggagtatatatatatatataatatgtagtagtaataatgaaaatattttgttttaaaaaactactttgagacactactaataaaaataggttttgcattcttgtttataaaacatgttcacaacttgggttgccatttatttatttattttgtttactgaaggatataaggtaaagtcgatgcatgatgaaaatatgttgtgcgatgctattcttttgtacctatcacaatgcatccaaagggcccatccacaagcttgcacaatcatctcttcattttaggtggaaggtgcactggtaatggcgattcatcggcaacaactcttttacataacgttatatggtagaatgtaagaacatcttttggggacacaacggcaaccatgctccatgcattcagtagtcatccatcaggcaaatccgcttcctcgtgtgtggtttgcaagtgcccttcttagggagctatggtggtaaagaaaaaggaaggaagaagaatcttaccatatagggttatatgttactttttctttttcgacaaagaaagcataactagggttctatgttaccattgccttgaaaactaggttttctttatctgagctttacttttaaaatatgtttgtaagctttggtcaaatactactttgcaaatagacttcatttttagatagtcagataagtatatatgtgtgttcgctagattcgcatacaatcggtgttttggatctacattgtatttatttatttatttttgaagaaaagacaagaagatctacattgtatttatgaaatgttagtacatccaagtgataacgattgggtcactattcaattattggcacttattcggcgtaaaatttcacgatatataagtgaagtaaaatcagcatatatacatagttttcgccgcgtcctggtatatggtcccggaagaaagttgttgtgctattagccatgcctggatatgcaaccaaacaaggaacctctctcacacccaaatccgaagaaaatattgcctggggtccccaggcctgtgatttgtataccctccttgaaaagttgatgttgtggaacatagcggttgatgagcaatttggaactttgcagggaggtcagcatgggcttacaaaacactcggactcatggtgatgctgatgtgatacactaaaattgtacaggccttatccacttaagataatgccatgtaattaagtatgttcaaaaattaaaatagataatgcattctaaatattttcttatgtggttagtatccaagaagaaaagggaattatttgagaaaagttggcgtccattattaccttttttttaattccttttgcatagggaattagcactaattatctttttttgaaaaaaatgaataaatttgtttctatgcatggacatgtatgcaagtttatttggaagtatataagaatatacaaatttttagagatgtacacaaaatattgtatggatgttacttgccaactagcacgtggccttgcgttgttcagaaatatcattgctgctaatttccaaaagctggaaatagcattttccaaaagctgtacacaacagtggacctgggtggatattcataagctttatgcttaagtgttttcactcaacattgtattttaggatcccatcaaaaaccactgtattttaggatcaagtactaccaccccctccgatcatatactacgttttctaaaactaaaattggtgttaaaatgtcatatatgaatgaacgaatgaagtattttgttagttgtttattttaggctaggaccaatggtccaatacttagtaataataaatagttgagtgcatgccttatgcagaggtcgaagtaaatttattctattatcttaaacaatataattgatggtaatttggtagagctctgctctattttctacactgaaaatttggtagaggtccgccctagtatttcctttcagagatctggtctcctaattcaccgtggatctggaagtgtgtttaacaaaaaaaaaaagattgttacaagtaaggtctccttcggaacaaaggattcgtggaggaaatctgtagaaaatttttaggagactaattaaagaggtttccaaggtgaattagcaacaaggcccatgggttagcatccaatgttttttgcagcaattttaactactctagcataaatttcacattggcattatagcaaggaactggtggcacaaatggatttttttttaaaaaaaaatatagctcagctctaaaaaattattgggtgttgaattggatttggatcagctctgaattttctattaagatctgctagtgcaaatgtgacattagctatacgccttgttaggagagctgcaattactttcataatctctagcttctccaaaaattctagattctcactcaaattttgaaactcagttatagtcctagtcaccaaaagctaggtaacctcaactcccccaaattctcatcagctggttattagaatctccagctctcgcaaaagacaataaaatgcaccatccatttgaaat

SEQ ID NO: 61620 - DNA, 2352 bp, Oryza sativa
tcgggcataaactacggctcatcacttatatgtgtcatccgtgacgggtctgagttatctcaatcgggtgcttttttggccgattgagatgacttccttgtgacggccgctaattccaagtatgttagaggccgtcacagatgtaaggttctgtactagtggaaactacaatctttgcattttattttcccctccggtttctatgtagttatattaaacctcatctagaaaaaagatcagatactaggagatttttgcatggtgacgaactccagctgttcggtgtcggtgattttgacagatttcatttaatttaaataatgtcaaacccttccctgttcaagcaaatatcctggaaatttctcgtagacgtggttttagcatacatgcaatcaaacttcaaaaatatataactatattaagaaaatatttatatatgatatgtaaaaattatattaataaaatcataatgaagaaaaatactctcacaattatattttcaataaatctcgtagataaaaatgattgattagaaagagtttcgatcacaactataaattttttagatgtttttaggggaaattcatgtgctgccgttatgaatttataatatatacttcgaaaaataaattttctaaaaaaatcacgaggataaaatttagtaaggtcagaaacttttttttaaaacatagtgtaaatgtaaacgctcacaacacgcacatactcacatttatgaatacacatatgcataacctacccctataaatatctccgaaagacctggttggcttataaatatctccgaaatttgacacatactcacatttatgaatacacatatgcataacatacgctcgctatgggtatcactgaatgaatagttagccgtaaatagaaacacatgtgtcaaatttagaacttgaatccaggtgagctagttccaccgcaaggaagctaactcattgagctacgctcacttcacggtaatgtcaaaaatatgggtgcgtgggctaaattacgtgaacctgtgtcaaatttgatttgacatgtgtatgtgggataaattacgtatgtgctgactctgacttgggctatatattgatgcaaagtttaacgatagaaaggccatggacaaccttggtggcaccgccaaacttatatattgccacgaatcgttcttctacattagcaatgacaaaatattattgcgaatgatccttgatagtaccaacggttcccagtatttgttgctatatctaagactcgttgcaatgattcaggtcgttgcaatacctaagacagctttgcaaaaatatcgtttcgtgttgctatatacaagagattcattttgcgacactacagttttgagttggaataacatagactcttttgcaacacatgatgtaactaataacaatgatttatattcattgtgacatggacaactcttgcaaccattataaaagcgccataatcacgtcgccctaattacaaagcaaatatatttgttgtgatatatctgacttattgcaacatgcgttgtatatattgcaacgttgcgatatatctcacgacgacggtgtgggttttgcgaggtgtggatgcagcggtgggcgacagcagatgactgcggcagggaggaccgacggcattgggcttcaggccatgggggatctggcgctggagagagcttgccgagcgaagatccgacggtcgggatcgatctagggtttccagaatgcttttttgataaaataaaatgcaccaaaaaatctttttgtgtgtcgtgtgtcgtaacgtgcccgcttatggtggtaagtgcgacccccaatctcgtggataagtcttgatttccccctcaccctattcctccgctagtctcatccgtctccatgccatgccttgcgggagatttgcaataatgatactgcaaacattaatctttgttataatgacactggacccatatttcatagacacagatggactcatttgtcacccactcaaagtgttaaaacagcgaagctccaatgtttgcagtcctaatattacaattttctccatgccatcatgcatggggccactggtggtgtcgctctgaactccttcctccgcactgggaggatgccaagcatcgctccgacggcagtgaagaatgtatttttaccgacgatcatcataagcctgtccgcatgcgaagaatggatctcgcaggtggccggtgttccgtcagtggaaaggctctatttttactggcggtggcaggttagtcgcatgtggccggcaacgaaaaccgtttcgcccgtcagtgactggctttttggtattagtgaactacaattagctctcatg

SEQ ID NO: 61621 - DNA, 866 bp, Oryza sativa
cccattaacaacaaattaattactggagaagtcaaaacaataacgatgtcacataaaactgtctacatactttatctagctaggagagggtaaattagatgggtaattttagcatctttgaaaaagtatcgagatgtattatatttttagtgtaaaatcttttataccttcagctattatatatcttgaggtattaatattttggtatagtacttacatattcttcctaagtactgtaaaatttcttagatagatttttgctcacttgattttgctccagcacctcccagctgctggcttttgctactgcttatgctgttatagtagtactgatctgcagtcttcgacttgtaatcagaagattgctgcgcaggcacccttcctgtcgtgcttttcgatgatcctgcagacgcacaaaattagtggtgtgaaaaaagagagcttaaaaacacctggaaagttttctgattaccatcatattaattatatactctttatatataactaggaaggtagcccgcgcattcgcacgggcatgcttgttatttcttttcgaaaacaggtctaacaaaatgaatttaaattaaagttatgtatttcccttcttaattgaatgctcattgtttattttttcttaaaaaatcttaagaaactttaatttctcataaatatagttttctaccatcctgctgtctttaatttattgattttgtattgataccttagaagcttatacatgcaagtcatggaatttagtaaattcgtttaattatcattgacattcatttattgatgtgtcaaagcgaaatatggcttgtatgtagagaagcataaaaaaattgggaaagaataaaaccgggggatcc

SEQ ID NO: 61622 - DNA, 2104 bp, Oryza sativa
aacatgtgcaaagaatgcccgtggagatcatttgtttatgagtgcgatgaacacaattgttcattcaattaaaaagttggataagtggcttaaagttgacattttacattgattgattatgaaagtaatggtacatacaaatctttgtgcccgtataactatttgccaacgatcaatagaacttgatagttactttcggtgttccttttagtatgtagcaaattggctacatattttacaacttactgtatctttggtgagatgcacctgctatttttttctatatgttggctagattgtttcattgttattaatcgataccttgggtgcatgtgacactatatatatttcaaacaaaaaagccttctcgggtctaaattgatttcgcagtgtgggagacaattcatttgttccgtgcactgtggtatgattgttgtcatgatttaaatatttttgctctaaaatttatgattaaacattagaaatttacgtgatccaaacgatcactgtttgtgattttatgttagctaacgtgcattgggcatttagtgacaatatttatattgcataatcttaaatgtgaagcctaccatgcttaccctattttatcttttttgtttgaaagaattagccatttatacaatcatagtagtttgaatactaaatagtttttatcttttaagtttctaaaataattggtagataaagctcttagctcggtcatctgtgatatacacctgtactcccaagctaatttggcccctatcacacatgtagtcacaagctaatttggcccccatgctgatggtgttcccattaatgtcgatgggggcaaaactgtgaccgatcaggagtcttaagcgtttctaggatgttcacgtggtggcttgagagttcttttaggaggtttaatggacttttagtatataatagataaatataattatattattttgacttaccatagttttagaatgcggggaataattttttttaacaccactcatagttaagtttattttacttttaccgttgttgatctaatttaattattgtgaatacgttgataaaaatatatatgattattttttcatattttttatatttatctaaatgacacatataaaagtcagaaattataaccaaaatgtgacttttttgaaagttgaaatataatgaatatgatctttaaccatatatttagtcataaattatctaacgatataaacagataaaaaatatcaatttagatttgtggtttctaaccaacattgcataaaaataggaataagagagggaacagagaaagagaaaaagagggaccgcggataacatgccgtacttacgactccatgcgcactaaaatttttaattacatgaaaaaatatgtattattatgagtattgtgcatatctaatgtgatgaaaagatatgttcgagagcgatgaattctagactaccaagagtgatgaattctaccagcatgtagaaagatgcggtgtttttttttctttttcatggagataattacaaataatccacaactttgcacgacaaaggcgcatgcacattattctggtgctcataacaatcatatgcgtatactgatagaatttgcaacaacagtagagctaattaagtcgttttaccggacagggagtcagcaatgccattggcaacgcaatacgccacggactgtacggtgatcatggggttgatgcccactgcggtgggcagcacgctgtcattgcacacatacagctgctccgcctcccagctctcgccatgggcgtcgatggtgccgttgcccaccgtggtgcccatccggcagcaacccatgtggtgcatcgagcagaagaggccccacgtctcttttagagattgatctaatggttaaaaatattaggtccaccggattaaatgaaattcaatagtttttgcctttttctaagagattttaagaatttctctaatttatcagagtgccacgtggtggcttaggagcatttatagggtatacgtggcagcttagaagcgtttgtagaaagtttcatggacttttaatgtataatattatgtaccaaaacatggtcaatatggatca

SEQ ID NO: 61623 - DNA, 1762 bp, Oryza sativa
ggcttctccttgtttccactgcctagggcatcctcgcaccgacgccgccgtcgtatctcgccgtcgtctcggacatctacagaaaatgttacatccgcctccctctctctctcgacgacctcgatctctctctctccccaaaccgccaccggccgcctcgttgccgacgccgccgccgacgtcgacgcggtcgaacacgactccgcctcccgccgatgccgaccccgacctcgatgcggccgccatcgccgacgacgtcgcgccggcagtgccaatgatgccgccgcaacgcctccggaccgcgtcacgcccgccgtgccatgacgccgggccgcgccacaccgccgcggcacgccaccgccgtgccacgccgacgccgtgccgccacgccgccgccgcgccaagccgcagccgcgccgccacgccgccgctccgctgccaccacactgccactccgctgccgccacatgaacgaacgaaacgtgacttaggcgagaacttaacgacaacgtgaacggtaacaaacgatcgtgaatgaacgaacgtacgtgaagttgaacgaacgtgaacttaacgtgaacgtgaacgaacgaacgtacgtgaacatgaacgcggacgtgaacaaacgtgaacttaacgtgaacgtgaacgaaacgtgaacttaacgtacgttaacgtgaacgaacgaacgtacgtgaacgatacgtgaacttaacgtacgttaacgtgaacggacgtaaacgaacgaacgtacgtgaacgaaacatgaacttaacgagaacacgaacatgaacttaacgtacgttaacgtgaacgaacgaacgtaggtgaacgaaacatgaacttaatgagaacgcgaacgtgaacgatcgtgaacggaacatgaacttaacgagaacgcgaatgtgaaattatgttactttgcgtttagcctaatacatttttttgtatgttgcagaaaagacgtcgtcgtcgtcgtccctcaagccggagtggtagctagccctcgaaggaattcgcgcaggcaagtgatgtaaatatatgattatctagggttctaatatacgacacttaggcttagcatatatgactgttagagttttaatataagattattagagttttaatacaagattatttgagttttaatataagattattagatttgtaattagacttagcatatatgattgtttagggttctaatatacgacacttaggcttagcatatatgactgttagagttttaatataagattattagaggtttaatacaagattattttagttttaatataagattattagatttgtaattagacttagcatatatgattgtctagggttctaatatacgacacttaggcttagcatatatgactgttagagttttaatataagattattagagttttaatataagattatttgagttttaatataagattattagatttgtaattagacttagcatatatgattgtctaggtttctaatatacgacagttagacttagcatatatgactattagatttttaatataagattattagagttttaatacacgattatttgagttttattataagattattagatttgtaattagacttagcatatatgattgtctagggttctaatatacaacagttagacttagcatatatgactattagatttttaatataagattatttgagttttaatacaagattatttgagtcttaatataagattattagatttgtaattagacttagc

SEQ ID NO: 61624 - DNA, 1284 bp, Oryza sativa
tcaagaaactcatttttctaagtagaatattcaaaaggtttaatgagctgtagaaaaaaaacactaactatatatttattggcatatatgtatgtaatggtgataggagctgtatttatggggggggggtgataatgtacccaacattttagtctacaaaatatgaggactgagcctgaaaagggttaggctaagatttaatagatttttgagttaaaaatatttaaaggctgaggtgggttgtgaaagagcccatgggctctgacccattaccttccctagctgtattctacagagattctaaacttatatatatcttggcttgcacatatgcagaaattctgcagaaatttgtgaaaggtaatctttaagcaaccaacttgtgcacatatgcaggacttgaaggttttagtacacctcctcctcggaacaatggtcagggtgctcacagcctcgtataccaaatcaaaacactagcgcccaaagcaagtcaaatggacttcctattccaggtaaggacttacagggaattctttttttttttgtatgttcatgttaaatatatggtgcatgcatggtaaataattaaggccatgttaaaacacattgacaagtcgaattcttttcccacaccaggtaaggacttgaccggattggccatataattaaggcatatgacagaagaagatgcagtgattgtcaacaatggttcatcgttcgagcctgtgtgttactacaatatcatgtacatatgtatataagtagtacatatagtaaagaataatgtaaatagtagttgtcaaggtcaacgcatgcatgggaaggaaacaattgtagaagtacatgtaatttgtttatttaatttgttcaaatttgtttgtatatataaaatgtgaagctgtatatattgatacctttgacaataatgtacagcacaataatgttgaataactcaaagtgaatcattttatgtttccaaatataccaacgaaggctgtattcgaaactctagtttggctcagctagtcaatggcacgcaaaccagagctagtgattagcgtatacttagttaagtattactccctcggttccaaattatagtgcaccttattttaaaaagaatcaaactcggtaacttttaactaataatcaaatttataatagtaatttttgtataactttaatgtgataataattttatatttgttagaaatataacataaaataattaagagttaaagtatgtcatttgaaaccatgtaaaaaaatataggttttataatt

SEQ ID NO: 61625 - DNA, 2461 bp, Oryza sativa
aacgatatatatttttatatattaacatatacttaaatcaagtgattgggatagatcggtcaccatgccgagatagtataaatcacttatatcgacatatatattaataacaggattatatatgtttatagcatagccgatcagatagatctagcgtctatcggctaatactccgatactactctaaatcaagatattaaaacaggtataatgtattaaacaaaagcttaatatatttagattgcgacgatatcttgacacaaagggcggatttaacatgtcattgaagcatatagatcgaatatggttaaatcagataagatcggctgaaactccgatactaccctaatcggcaaccaaaggacaggctagagattgatattctaagcatgacttaatagatcaaactcaactgatgtagcattaagtatgaaaagaagaacaatatctagacaatcaagccgctgggtgtttcataaagtggtagatatctcatataatctaggacaacgtcactatttaacctaatcggctgccttctattaacggatgttagccgattgtaggttagatgacgatattgccaaagattatgtaaaatatatgataacttgacgaattatatagacaagattagagtgtcataaagatggaagcactaatcccgagaacacaatccgtcataacaagttttacttcttgttgaagatcgaaaccgatgcagctcaacccgaaagcaagagctcaatccgtcataatgtgtgttaaaaattacatagggctcggggtctatttatacccgagaattacaagatatgtccataccggacacgaccactatctctaacaaactctaagataccataagtctttgcggcagacttttgcccaaacatatctctaaggaagttacacaaaacatcctaattaatagatacaattgccttctcaggactatccatgtgcggcaatcatcttgaagcacctcaattcaatccaatgtcatacaccaaattatactgtcagaatcggctgcatcggctcacctagtccgactcagacccagccgatcctaatcgtagccgatctggacttcagccgattcttgctctgttctcggatcaatctccgccttcgactccaccttgacctaatctccttttccgatgctaatatttccaaatttggtcgttaacatatacatcgccttttgatgaaagcactttgggcatttgagaccaggtcgtccaacagtgttgctaacctcatcgcgagaacctttgatatgagctttgccatcaagtgaattaagcttattggtctgaaatcgtgcaccagttgtggcgaatctttttttgtcagcggacaacttagcacatgacgacatttaggttttacttacctattagatgctgcaattggcacattacccggccgttgaggaagtgaagaatgatgtgcatcattctcatttgtactaccatcctccatcagaacgatgcaaccctcagtctataatcaatctgtttttttgtaagtatggcactcttgccagtgggttaatggtaacgaagatggagggattattttggtgccaacagaggagtaaacagaaattatctcccgccctcaccaccagtaattacggggctatttaactaataatctgttgattaattcacagccgttgctttcgaacggaaagagtggaaggaaggaatgtcacagcgtgacattaccctgtaatctaatgtcagaggatacgattccagtgatattaccctgtagtgagtgatgagtgttcattttgctctattgtatccatcccataagcctcggatcagtaaatcggttgggaaatgggtgcatgcgtagatttgctctgaagttggttggctttgtaattttatcccatagttcagtgccagcaaccttctcttttgccaccctaacatatgaaataccaaatttacccttgtctttctcctaaatcatcttcttccctgattcatctccaagctccgtccataccgagctccgactgtcatgcatcaactccggctgctattcctgtgcatgagctccactgccggcccctgtgcctgagctccagtgccctcacggttgagactggtcatggaagaattcagtggcggtggggaacgggtagtggatcttggttaggggtctaggtgagctcattcgggaggcagagctcaagctggcagatatagtcgatgcagctgcacgggtggagaccgaggtgcatgcatgcatgtgcaattggtttgccgcgtgcgcgcgagataagcatctgtcgcgtctgcgcgaattagcatttgcggtcgatgcatgccaacagttggagctcgttggtggacggagctcaggtaatgaacgagggaagaataaaagaagggaggaagatgagggcaagttttttgattaccttctgtaatct

SEQ ID NO: 61626 - DNA, 3253 bp, Oryza sativa
tggcacggcacgttggcacgccacatatgcaaaagtggcaaatacttaagaaattacctctctccagtggcaaattattaagcacaaacctaagaggggtatttggataattggcaaacctaaaagtggcaaatagttaaattcccaagtcccttgggcactggcagcatcaacctctgcttattcaacaatagtatctttagtctccttgaactctaccattttgtcaacagcgtagatggcgagctaagagtaaaggtgttcctttgccatgtcgtggccctgatgggaccaatataatctgcaaaaggttccgagctcagttcggacgtcattcgtattctccaatatgccatcctccgggatacgagggagcttgctggcatggccgtacctgcttgcccataggcaagaacatcgacggcagccttcaagcgcacccaccaacgatgatgccagcggccccacgtactaccatactccattcagaatacgccacggtagggacgctttcggcaggaagggctgtagggtatgcccaaggtcgctcgaggcaaagttgtagtacattacttgcctgcacagtgaattcccatgcctaaagttgtatagcttgagcacgggctacctcttccagagcacacaagcagcctccttcttcagccgtgctacttcaccctagctggtacgaagctcgccgtgatcaactttgatctacccttcatgtacatcgtaatacttgcgaaacattactttgtccgccgaagtctctttcagctattcctcatgttaccccattccttctttggaattcataagcccctccttgagaatctgttggtccttattgaaccgatcgacctagttcgtagtcttgcattggcaaagtttgatcttgtcaagttgagtgtgggccatcaggtcatagctattggctcgcataaatattgtaatacaaagaaatatgtaagaactttgaggaataaacaaaaaaagggccaaactaattgaaagggaaagacttacgcaggaagtaaggcttcaaaggaagaagttgatggcgtcatggttgagttatcttcaaataccttctggacggacggtggcgaatcaacctgagtgagcccacccacaaaagctgtaagctcactccagctctcgaattccttcaatgtgaaattgaggtggcaaagaacgccctctgaggcagaaatgtcccacgcaacctgtttgattgtttctccacccgctaggtaggtgggccaaataatggaatgatatccttcctttactaagagggatcctactcctggcactaaacctaccaccttggctcttacgtgtacctttatgagattcaaaacttctcttccttcatagccaaaaggaacaatgatgacggtgtgtggacccaaggaggccttggggttgatggcggccaaaggagttcacatgacaaggttgggcgacggcggcgaagaagattcactatcgctgaaaccagtaggacatttaacataatatactttcagttttgtcaaatccatgtaggaaggttgtacatggtgtaaagactggtaggtctctaaatgggttcattccatccgtgctaaatgcaaaccttacatttttcagatccttagcaaattctggatgtagtgaatcaaacgtcttccattggtgagcatcggtggagtgtcgaatcataccatctatcttacggttcagttgatgccatctcatcaactcagcatcattagggtttcacaacatgctcttcatgcgatctttgctggcaggtaccacatcaccatggccggaatctttttctttgtatgcaccaatgaatctaggtcgacaacctcagtatcagaggacctgttacctgttgtcggtatttattacgaccacagaattatctgcaagcgcatagataccgttgtagccttcacccaacagtattccagggtatcgtattcacagggaacatatatgtataatctaagaacatgattcatccaaggacaaaaactaaatggtaggctgggaatagagagtgttcctacggattaattttcttaattacgttatggtaaaactctatcaattgcttcaggcgccggcttacccctagtcttccaaggagactccgaatgtgaacgattacaaaggacgaatatggctgtcaccacctgccgcctacctctacgcgtcatggtgctcatggtatcagcggtgatggcagggcacacgggatgatggagggagctggctgcctaccttggcttggttgtgccatgcatgcaagtggctatctggcccagatgggagggtgtcaggagtggtagaaggaatggttcgattgggaattttagcccatgaaaaatacgatgtcttttaggaatttgaagatgataacttttcgaaggttgaatttatggactattttgagtttcgaggctgagtgtaaatgaagttttataggaatttttgccgggatgaatagcattgggtttgatggaaacaaatttcaaaggaatgaatttggaattttgatttggagcttattcgaaggtaaagcaaaagggacttaaaggagtaggctaaggatttggttgaggagtttcatgggtataagaatttgaaatttgtgtggagcaggatataaaataattagtttctaggaattaaacaggaaagagatgtgcttacagaataaggttttaatcaaagataaattgagatgtttataaagttagaaatgaatttaaatggatgaatttgaattggaaataaaactataggaaatttataaaaagagccaaaataaaactttcttcttgcctacaattttcccaaaaaccccataacaaattccctatatcccctctacagtggcaattcgccgctatcagcaccctaaccctagtagttgttgcagcagtagcagagttgcaattgtcatcgccatcccgtggactagtgaatgcaggatcaacgcattagggaccagcggccactggatccgccggcccatgttctcgtggctacctacggatacatgcacccaggactagcagccagcattgatccactgctccaaggacttgccgtcactagatccactcttcatgggcacgtcgcgtctatcgacacgtgtggttccatccctgagctacgttggaccaagctgttgtcctcgcctccaacgttgtcatcgcgtagccccatcggatctagactgagctgtcat

SEQ ID NO: 61627 - DNA, 526 bp, Oryza sativa
taattacatcaaaatattttttttcataaaaacttaatcagtaggtaaccctaatcagacgggttctcctcaccggcgacttcaaccagacaatcaccgtgacggctccaaagattcctgggttgtttttgttttaatttgatgaatagcctagatttctgtcaatgtcttctcagacaatcctgcttccatagtgccaatattggagaagtcacagctcagaacacacaagccgacctgccactgccagaatgagcccagctgggtcaacactagactccctagtccctagcacaccatgcatctctcaatggatctcaagcgtcaattcagcgtatctgaaaaagaaatggaaatgggaaaagagggagtaacagatgctgtgtttagttcatgtactaaaaattttttttttgacgcatacggacacacatttaaagtattaatcgtagattaataacaaaacaaattacatattccgcctgtaaactgcgagatgaatctattaagcctaattaatccatca

SEQ ID NO: 61628 - DNA, 27612 bp, Oryza sativa
catgaggagtatacatataatttgaattttagaacataggatagtatagtactatagttacattcaatctacctattggaaagaggtacaagtacaacaatatcttaaggggcatactagctaatgtcagctagacacagaatgcaatagccaagtgggagatgaagactttagtatgtgaaaattgtgccactgtgggggcaacaaagttgttcatttttaagttcttgatcgtcccatttggctattttgtggcatgttcagacctccatgtgaattagcagctacagattccacgatggatattatttctgcctcttgtaacaaaaatggaatgctacttagtagtcgatgggcatgggacttcagctattatgtagtacgagtagagggttgtatataacatactaggacacaaggacagaagatgctgtctactcatggtgattccaattttacattggcagcgagtctgagaattatactttattactttaaatacagacctctgttcattcttcaattacatctggatctaaacaatcgagataagagtgaaaaccttaaccatgatattaccatttatattccatatgcttgtggaatatatgcattgaattttataacaacgtataattaggtcttacattagcagacttcactattttattttttaacatcaagtcctaatatctcatctatcttcaatcttgacagaaaaatctgaacagttggactgggatgcacgtattaacataatacttggagctgcaaaaggcctggcttatttgcatcatgattgttcacctcgaataatacatcgtgatattaaatcgagcaacatcttactagacggcaattttgaggctcgtgtatcagactttggactcgcaaagctattagaggacgacaaatcccatattactacaatagttgcaggaacatttggctatcttgcaccaggtatgttaaaactgttctgtttcattcattgtgggaaaataacagcatataacaaatgcttaccaccttattgcatctctggattttatttatcaatatataatttcatatgctctgagctaatttgcaaaattcaaaatccagagtatatgcaaagtggcagagccaccgaaaagactgacgtctacagttttggagttttgctacttgaaatactaagcggaaaacgacctactgatgcatcatttattgaaaagggattgaacattgttggatgggtatgtatgacctttatgtccttccatttcatatccacagttttctgatatgaattacgtatgccttcaattgatttaatgtattcttgaaataatctacttgctctgtggcagttgaatttcctggtcggtgagaatcgggagagggaaattgtcgatccatattgtgagggagtgcagattgagaccttggatgctctactttctcttgctaaacaatgtgtaagttctttgccagaggagcggcctacaatgcacagggtggtacagatgttggagtcggatgtaattacaccatgccccagtgatttctacgattcagaataggcttcgacttacggctgctcttgaaaacgccacactgccgctggttttcctgtggaggcacattccatttattctttgcagattatgtaaattcattcctgcggtgttcggctccaatcggctagctcaatggggaggacatttttgtgtctatgtatctatgctacgtacaaattattactactacatgtcaagttaataagaaacttaccaggagattactgtacttgtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggttttaccgttttacatagcggagtagttcgagcggcaacaacacacttgaaaggaaccagagcacaccaaaaacaccagtaattacacctcacataagtgatcgatacacttgaagccacagataaatcgttttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctcaacctccaccttgacctcctccttcttcagccccggcacgtccgccttgaacacgtgcgcctcgggcgtctccttccagtcgatccgcgcgccggcgaaggccgccgcgtcggagttggcgcgagggaagaggctgccgctgccggagccgaaggggaagccgtcgaaggggtcccagaggtcgagggagaaggggtcgaacacgttgctgcggcggatcatcgacatcgtcggaatagctgcgaatttggaggtggaacgatcggacttctctgagttcttactctgatgtttgcttggtttgctttgcgttttcttcgtggttctgccggtgaaggggagcgcggttttatagagggcagcgagagggcatcgtggagcttggaataagcttctagaaacttccagtttgcccccgcatgggctagaacctagtacgagatagcttgggctagaagtttacaccaccggtagcggggtgggctgtagcccatagcgtccaggactctccagaataatctaggccataagcaggcctagaacaatccagaagaccacttccaatttcggcccaaattaacgaacaaacgagaactatccggaagcaaaacttccagtagaacccatggaccatcacgaactgctatataaattgttgccaccacgcagcgacaggtgccaaggaaatcagctcatcgatcgaaagatcaacaagctctcttgagaattgagatcaccctctttccatctagaacacaaaccagacaaccaaaaaacagcaagacacaatacacaatgtcgctgatccgccgcagcaacgtgttcgaccccttctccctcgacctctgggaccccttcgacggcttccccttcggctccggcagcagaagcagcggcagcatcttcccgtccttcccccgcggcacctcctccgagaccgcggccttcgccggcgcgcgcatcgactggaaggagacgccggaggcgcacgtgttcaaggcggacgtgccggggctgaagaaggaggaggtcaaggtggaggtggaggacggcaacgtcctccagatcagcggcgagcgcagcaaggagcaggaggagaagacggacaagtggcaccgcgtggagcgcagcagcggcaagttcctccgcaggttccggctgccggagaacaccaagccggagcagatcaaggcgtccatggagaacggcgtgctcaccgtcaccgtgcccaaggaggagcccaagaagcccgacgtcaagtccatccaggttaccggctagtaagaaacttcgggtgtgacatgcacggtggagagcttcgattcgagccttcggtttgtgatcaattgcagtaaataaaagcgtcaaatctggtcctcagtgtttatgctgtgaaaaagttcaaagctatgttggaagtgagcaataaagacttttcttgttttgtgaacgaacctgagattatactagtcctacacttgtttgtttaatctaatctccggtatattctgccatttttatctcgatgtttcagtacttttagcctttggttcttgaatccttctgtcgagactggagagttcatttcggaaattgagagctcaatttccacataagtcccacaaatttcacttgtttcagcattttcacagcaatcgattcgattccaacagaagtcccaaaaatttcacttgtttcgaaagatgcctataggttttacgttttcagatcggactgagaaaaggcctataggatttccgttttcagatcagactaaaaaattattccaatgctaggccatgactgaactaaccaaatataacgaaattgctaatattgtgatttgcgattcgtacttcatgtgttttttcttcaactccaataacctcatttatttctacaacactgataacaacctaaactccggcaaataggtttgggtttaggttggggctgagagagaaggggaaggtggcttagagggatgattgtggaaggtgatggcccgacgatgtacagcgggatgagtgggtggcgaggcaacgacggcaccgccaaagccgtagggtcgataacatacggtgggtcagtgttaggggcaaagtagagcgacgggttaggagatggcgtggcaggggcacctcaccaccattggattgaggtgacaacagaggcagcgatgacgagagccattgagcgttgttcaaggacaaaggaacaaaagataaaagataaaaggattagggtttggatatctgcaccaatccgaaagcgatctaatggctcaaaaattataagaatttttaagtggtgttttctgtcaaatgtgtaatagaaagtctcaaatataaatatgaagctctgttatgattaaggagtttctacttctaataaatccataaaatagaacttttatttatgcgacggtggtagctcatgcagaacatgccatgatattcacaactattaaatctctgacgtataaaaagtggatactttgctatggacacaaacatcttagattttcagccaaaaaaacgcatggccgcatgtctaagggcaatcccactccgaaccttcaatcgaacaaataagggcatcatgtcacaacctgttatagatcaactaatatgagggtattgttctttagcacgagattgtttctagcgcactttctttttctcaaaactttgtttaaacttttttcatatgaaatgattttattgaaaaattcatctgaaaagttttacatgaaaactttcatgttacgaaagcacgtaggctaaatagcaaatccgactagggtaaatagatctaattgtcctaatcctgttccgggaccatgtgcagatggttcactctttgcccaagagaaggtggagcccaccatttggtccataaacggagattgagatcctctaccttcaaaggcaacatgccttatgtcactgacaaagacttcatccatcaccgccaccatccctcgcggcctcgccggcgatcaaatcgcctgcacggctggttccggtagccgttctccatcttggatgctcaagcgggcttggggtcctgaagaggcggcgccaattattttcttctcctccccttccgttctctctcgtggtcccacggcgttggcagaggccagggtgcctcaaccctcaagagtcaagaccctatgcgcctcgcgcagattgttggtgaaggggctcgtgtgcccctcttcctaatcccctgttgtattacttcttggtatttctgtgcagagattaatgatcattgcgctttcgttgggttgtggcaatggcattagtcttaacgctggataagtccatggtgatgcaggagaatgaatccgggaagtgtgccatgccatcagccaggtgcgtacattgttcttgccgcttcttcgtttgtccatacctttgtgattgcgttggtttatgttttgctaattcaccggcatagtattgtgacggtcgattcggattctgctattacgtctcttataagaagaaaatgggagagattcagcgtatattagttatgctggataataatcagaactgatccttctaaatcaaccgagctaccagaacaaccaatgttgtagaaccgaactggccactcccagtttccattccaaaaggctcaagaaaaactcaaacattggtacattaatcaagcttaaagtttatttcccgtacataaacgcataggagacaaacacatttgggacccttggaggagaccacacattcataaacacatgatcatatcacacacattttggactgtgtccctcacgacacaagcaaagtaccaaaggaggagatcaattgcagcattgaggagaagcagcagaataaacaaacggggctctagccggagatctggatggacttgacgtcgggcttcttgggctcttccttgggcacggtgacggtgagcacgccattctccatggacgccttgatctgctccggcttggtgttctcggggaggcggaacctgcggaggaacttgccgctgctgcgctccacgcggtgccacttgtccgacttctcctcctgctccctgctgcgctcgccgctgatctgcaggatgttgccgtcgtccacctccaccttgacctcctccttcttcagccccggcacgtccgccttgaacacgtgcacctcgggcgtctccttccagtcgatgcgcgcgccggcgaaggccgccgcgtcggagttggcccgagggaagaggctgccgctgctgctgctgctgccgccggagccgaaggggaagccgtcgacgggatcccagaggtcgagggagaaggggtcgaacgcgttgccgcggcggatcagcgacatggttgacggatttgggcgagaaggaaggctgtgtttgtgaacactaaaacagtgtgtgcttgggaagcttgggatgtgagcacaagggatcgcgatttgcgagttgctttcgatctttgtctgggccgcagagcgggaggggaggccggatttatacgggctgtgggcggcgttgagaggtgggatcctgataattctcgtcagttcaagaatgcactggaaaacacctgatttggagcctggccgcctgggccgaatcatcgagtgccttccagaacttttggccctgtggatccaaacggcatgggactctggttacagatttacaattgccgatttccttctgccatgttaatatagaaattgccatgtatctattgtgaactatagttagatttgttcctatttctatttttaaaaaaatatttaaaacgaagaccttttaaattttggtaatatcaaaatttaacaaggcagcatactaaacatactattaccaatgcaaccatattttagtaattcgggaactttctactctagctactacacaatttagtaatgtgttaaaccaaacatcgtccacatccttaccttattatcttactactaaacttcgattctggtaaaattactaaaatttgataagttttttccaagtgaaaaatgaacaagtcctacatctcctctggcctatagcatagaaacccatcactcccaatttctactttgagtacgcctaagcggtcaaaaaaggagaccgttcacacgttttacaatgtaagcataaacttatatggtcatttcataataatcactaaccttttgtcgataaaaaaacatccccaaatcttagggcctgtttactttaatgccattttcaactataccattttttaataaagttgtcaaaaaaaagtatctacgtttagtttgttgccaaatttagtcaatacataagaaatcatgccaaaattttagcaatattgccatcttgccaaaattttggcattgctaaaatttggtaaggtttattttagctacaatctaaataggcccttatagttttgggtcactagatgtgctttgcgattcgtgctgtagacccttatcttgtagctctggtgatctccctttcttctctggcaccggtgacactgcaaactctagtggagtagcaacggattagggccccgggggttgggtggcagtggaaggaggagggggaaaaggggatatccatgcgtttagatggatggaagtaggaggcggtggacacgagcaggcgacgaggcaacaatgacgacgctggagctgtggggatgaaagagagtggtatactggagcaaatttatggttaggaggcagtgaggagccactaaagacgaggaaaagggcagagcggggcacctcacggccggcagccaacgacttgagtaggagaagaggttggtaacggggaggctggctagggagggaggggggattgggctcgccagtgttattaacgccttccggccagccggcgaggccgggctgcagggcggtggcgacggaaagcatcgagcgagcgggtgattcaatcatgtctggtgacactagagtgagaagggaggagaggaggggcggggtaaggtttagggatgtatgcaccaatctatacctatacttattataaaaattgaagatgtttccgcggttcgtcatctgtgtttgtgtcggttataaaaattgaagatggcatcatccgtgtttgagtcggttttaattttatgttttggtttatactattataaaaattgaagatgtttccacggtccgtcatccgtgtttgagtcggttataaaaattgaagatgtttccgcggtccgtcatccgtgtttgagtcggttttaattttatgttttggttttaatctgtatatcttctctactattataaaaattgaagatgttttcgccggtatttttgtacgtcatccgtgtatgagtcagtttttaagttcgtttgctttcagtaatacagaaggaatcatataagaaatctgtttaaaaaaactcgcatgctaacttgagacgattagactgctaactgcagctcatgattttctaaaaatatatatatccaagggaattcccacagtaaatttcatcttaactaaaccatataacaataataagattaaaatagacttcacccgttgcaacgcacgagcatttttttttctagtcttaaagaaattcaactgttcaaaattcgacagttccctttatatattgtaacgtcttacatatgcgatttttatggttcagagtttctgacatgagtttcttatgtatgtctcacatgaattgtctgttctgatcgatacatgtaagttttcatcctaagggcacccgtaatggttatctataggctctctacaagatatctatgtcagcatattttcctacttgaaagagattaaatgaagagatagagcaaagctatctactaacctggagatagtctatagagaaaaacgaggcaatgaattagagagctatagatacccatgtagacatactattggggtagtttactattaatctagtctattgctgagatgtacatgttttatagagagcaccttactttactattgcgggtgctctaacagttccattttcaatttccaatattatctttgttttggcctctaccgtttccgtgaaaaataaatggctacagaaatgctttaggctgtttgtcgactgttttcaggactagtgagaaggagcctcgacctatcaacagtagggatgaaatccttcacaatgggtttaattaattcgccatcagaaaagaaaatttctacaaatatattataatttagttacaatacttttttttttagaaacacccccgtatatgaaacttgcagtcaagccaagaacttctcgaccttctccacttcctccacgctcccgatgtacagcggcactctctgatggatctgcacggcacattcacaaacgaatcaattatatagacacatttcgatttctaagtctactcgtagattaatccattaataacactgcgcatataatgtgtgcgcatattttacctccgtaggcatgatgtcaagtatcctctggtggccatcggagcccttgccgccggcctgctcgacgatgaagctcatcggcgcgcactcgtacagcagccgcagcttgccgttcttgctcttctggtccctggggtagccgtagatgccgccgtagagcagcgtgcggtggaagtcgccgacgaggctgccgatgtagcgcgcggagtatggcttcccggacggcccgggctccttgaggctgtccatgtagctcttgagcttgtcgtcccagagcgcgtagttgccctcgttgaaggcatagatcttgcctgccttggggatctgcaccttctcctgcgtcagcacgaactcgccgtacatcgggtccagcgtgaacacgtacacccctgtcccgatggtgagcacgaagatgaccgagctcgagtacatgcagtagccggcggcgagcaggttgctccccggctggcacacgctcacgatgcacctctgctccacctggtcaagctgcaggcacacgcgcgcggacagaggcgtttcgttctgttagcaccgtgtcagtgtgtgcatgagcgattgctaggcgatcgataacgcgttacattttggtcgtcggcgatgtcggctaggcactcgtcgttggggctgtagatgccgaagatggagccggtggagacggcggcgtcgatgttggaggagccgtcgagcgggtcgaacaccacgatgtagttgcccgagtagctctcctccacggccaccggcacgtcctcctcctccgacgcgatcacgccggtgcgcccgctcgatttgaggcagttggagaacacctgcggtgcgcatagcgctcagcttatggtcggtcgcgcttgttgcggtggttcgcgcactaaccacgacgagctactgataatttagtcgtttacctcgttggagacgacgtcgagttttttctggtcctcgccctgcacgttgacggcgccctggacgccggtgaggttggagatgggcgcgcgctgcaccagcgaggcgatctgcttgcacgccgtggagatgctggccagcacgatggtcatctcgccgtcgatggtcccggcctgctcctgcttcagcagccacgtcgtcagcgtggtgatctcgtagctgctcttcttgctagcctccgtcgcggcgggcgccgaggccgtgtcgacggccgccatgcaccgcacgctcggggccgacgacccaccggcgagcctgccgggctgcctccggaaggagaggccgcattggagcgaggccgccgcctgctggcgggagagcaggagcaggtgggaggatgtcgtggctgcggcggccatcgctgctgctgcttggttgcttgctctgctcgcgctctcctctcgctgcggctacctggtcttggtgccgatggcttcttgttttgttccattggttttagccgcggtttgtgtggccggagagagggcgggaggtgagtgtgtggattgggggagaattgtgaggatggcgttgcctcagatactagcctaattgcaactccttgtccttcagccagcgtcacgtacagtcacatacaagtagcatcgccttgctcaggggcagtatatacttgtgcttttgattaggcagatctattattcgtacctatgaatatagatggtcatatgacccagcccaaggccaggtgatttgacccggcccaggcatggcaggtcgggccatgccggcccagcctaacagccatgtcgtgcttgggctgccacctcggcacgttgggtcggcatggcccggcacaaagttcagtgtcgattggaacgatgagcccagatccacatagttccggaggacaaaggagcaaaacggtggtcagctgtcgatgatgaggctgctggctcatatgggtttgccagtagaggctcaagcatcagtgacgtgcgtggcccaatgagagagatggtgtcagaccactcccctaccgggatcacggacggcaaggtaggcagcgactgtgaaggactgaagcaggcgaggatggggaagatgtctgaaggggaagatgaggaggggcggctttctctgccgtcatcatcgcgccattgcctactattgtccccactcgagctcgtgtggcggtgtggaaaaggagaggggggtgagaaagagaggggttgctcgcaacattggtagcgatggcgatgggaggggaggctcatgtcgtagtgttagagggtcctgccaacaggatgaggccacagagtcgtcacctccatccctagtgagttccacaacctcctcgagctgttgttacctatcggcctactgatacatactcactgacatgtgacccccacatccggttggaccaacttgccacgttggtgaaaaccatttttaaaatgggacaattgcatatatgcccccaatttcaaacccaattgttgttttaccctcactttttagggtttgcggttttagccccactttttgaatctgaaccggccgtctacccctacttgtaacaatcgtttggtgggtcccacgttttgtgttaaaggaatacaaaaggaaataaaaaaaggttttaggaaatatgaatttacgtttgtacccctgagagaatgggtagggactaaatcctctcaacctgtgcgtgcgtgaatcagggactcgagggcgggcggctgcgagggcgtacgcgcggcggcggcaaccgtggagagggcgggcgtgcggtagccaggcggccgtggggctttgacacggggattcgcagttctagttgccacacgagttcatgctctccccgatcgccgccctctcccttgccgcgaggtatgccgccatcgagaggtctgtacgaccgcttccccctaccgcaccctcctcgcactactacgcagccggcgacgaccccatcctgctcgacgtcgatggcaatggcaacgccgccttcatggcggtcctcggccccacccacccaagcatactctccccggtgccctccgcgctgccccccatggcatcgtcaccgtcgaggctcttctccccgctcgaccaggcctccgtctcctagctcagcgacctcagccccttcgtccactccgccggcgcaacccctcccccccaacccatgccgccgttcgcgccgagcacgcatagcctgctgctgtccacgcccaccgtcgccgatgaccttctccatcaaggaattcttcagtagcaacttcccggacctgtcgaaatgctgtctaaattttgttcaaagtttggtcagattatgtacttggctagtatttgtgatttttttattaaagtacaaaaacatcacaagagatgctcatatttgaattatttataacaatcacacaataggggcaaaatcacacaagctgaaaaaaataggagcaaaaatgcaataatcactaagggtataaatgtccttttgctgtacaactaacaccgttaaaccggatgttagaagtggaggtagtcggatggttcaaattcaaaaagtgggggtaaaactacaaaccctaaaaagtgaggataaaacaacaattaggtttgatagtgggggcatagatgcaattgtctcatttaaaatagtcaagataattaagttacatcaattttaatagttggggggttagaacatcctctttcacgaatgaggaatagaatcagaaggactttaaaggaaaggagtgccatccaacagaaggccctataactacttacgttcagcaaatcctgatatgtagcctgagccgagctgctctttcttgggcttcttacttgttatactctgtgggccgtggcccaatttgacaactccttaccgttttacttttgcttttctatttctctaggggtataaaacagctgtaccaaatcaatagaaaaccaatgctgcatttcttgtgtactagaaacaaaatgtccatgcgttgcaacatttttttctttctgtggtacgacggctaataggagctaagcaatatattgaaacattggaatcactatacattgccccattcctttattttcagccccagcccaatccacgcctcatatctccctccgctcggcctgcctctctccagcgcaccctacaaatggagttgcaagagcccagctagcacaatcggttgcctcctccaaacactacagtagcgtcttcaaacctctagatgacagtcatgtgcccgtatcatgccggagctaatcatccccatcaagtccggtggaatctttctcgatctctcaaaattggttgagggttttaatccactcgatctcgatcctctttccatttctcccaaaatcagagcgtcgcatccaaatcgtcgtagcccaattttgtaaaacttgggataaaaacacgcgcacggtagcgctacggacattgacgagcccaaaaaactacaaaagccttacgtatttttaattaagatatataaaaaaaggaatcttggtctcgattagactcttgatcgtgtcgcaggtgcagcgatgatgaaacgaagcggagggacgaacggaagccgaatctcaaagggatttaagggaatcattgatggatgaaaatttcaacagaagctttacgcattttttaaataggtatatatagatatatgaactacttgtacaatacttttgtatcatctaacattttatgcaagatggacatgacgcagacatcagaacatattcttaaaagaacatatcagaatactaacaaattaagcaataatcacctcctccagcttaatccttttttttgctctttccacgacaccaaccttttgaacaagaaatacaatatttttgtagaccaaataatataattctcttgcagagtccaatcctcgtattgtttaagctttgagtttagcaaactctactcttaatttgtaccattgcgtggcaggattccaatcaaatactagtagaaaacaactcctatgcttacaaaaaacaggacattccaaggcaacctacctattcaggcgcgcacgtcgatgtgctatgctttacattgacatgtccagcaatcttgtcctatcctgttccaagacggtggcaatttttgtcagctaccgattgggcaggggagcacagctacctcctgcctcatcggagacagaaacagagtcgtaacccatcaaaagcaaagacaaaatacacttgtcgagaactcttggtttgtttggtttctcttcacgggcaacggaatcttcaaggtgtcattggcagaatggcaggcatgctaatttgttcagaaggtctctaattcatttgacgagttagcgtgtatactagcaatcaccctcttgattatctcatgctgtgctcgtcgtcttaggaaatgccatgtctggtagggtcaaagccaaaccgagtcaggtcagtatgaaaccaaatgcatttcggttagtggcgggagaaaaatatcgatgtcacaattagtcaacgagcaagcctactctgttctatctagcacatggaagaaatgggacctaacagtagacttctgattgttcttctagctctttgtgttttataatacatatctgaacgctcaaactaacctgtagctatagtcgtcggttcaaaccagtgtttgattcgaccacactctatgaacccaactacttccaccactccatctcttgatcctgaaagtgttaacatttcataattaggagatcatgctgggagattctgccaaaccacatttgcataccaacggcctagattttctatagcttaccagctgccactccaagcttgacttctgaacccgaataggttcacaacaaaggctgtatttagatctaaagtttggatccaaacttcagtctttttccatcacatcaacctgtcatatacacacaacttttcagttacatcatctttaattttaactaaaatctaaactttacgctgaactaaacacagccaaagccagattcgccgcgcttgccctctccggcaggcggcagcttgaccctacgcaccaaattaaactgaacagataggataggataggatgacctcattggagcgccagcatgaataacacagtaacctttttttctcgacacgaaaggagccaatgacctatatgagcgcttgcttttgctgaaactgtactttcacacggcagattaacctaacgtagatatatcctactgaaaagcatctcacgaccgacctgtactgctgctgtcctttctctatagacgatcactccgcagcaataattctggtccagtcggagacatcgaccccccacacacaatagctagatcgctagctagcccaaggacacccaagaacagcgagatggggcagatggcgatatcgccacgttctcgtttcattcgtttcagcggccgtcactttcactgcaaatttttcgccgcagatcgtgcagctaattataaaagctgataacaatcgatctgaagccgcctctcttcgtcccgttcacagaaattcatcttacctaattaccagaggagacactagctccttttgactttgcgtgtcgctgcacctgatcactctctctcacacacgcacatccattagctgggcatggctgctacttgcagctgagtgcccagctcacgtagcacgtcgcatacagtaatacacttacaggtcatgggctcatggcagtgacaaaaacaaggccgtcttcccaggctcgcacactggcaccggcagcctcgcacactggctagctaggtgacggagacggcatcgctttacaactcaaaagggcctccgcacctcggcacgcctcgttttctattgctcggccgcctttgcgcaccaaccggccgggtcggacaaaacacgagggcgtctcgcggatgattgggaggcggtctcgcagatgattgggagggacggggttggttgcgcgcactcgcgcgcggggcagtggccggttgtggaggaaacggtgctcctctcctatcccgacgtccccgcggcagctgatgttgaacgggctccaatccgatcgatgcgatgcatgcatggcttgactgcatgcgacgttaggtaccaaggctggctcagatcaggaccgggacgtactgtctcctcgcagctgtaatgaaaacttgcaaagcaacctggtactactaaatttgtcccaagatacaaaaatttttagagataatacagttattaagaaaataagtaaaattaaacggaagaggttatgattggatgagaagtgacggtagattaagaaattaaatggtgaacagttataattggttggaaagagaacgttgatagataagctattatattttgagacaaattctgaatactaaaaattattatattttggtacggataaagtaatagtagtacagtaggttattaagctgctagtaacatgatggattggaatcgccgtcgccgaccgtgcatgatctaacatcgatgccttctttgttttcaaaaagagaaaaaaagggtagaagaggattcggtggttctgttaatttgcagcccctgtcgttttcaggttctgtggaagcatagaagttatttcctagatattgactttgttattcttttttctttgacctcttacagctttcaatactttggatccattccaccacagctagcctaactccaattccttcgttgtataaacctattgcgctcttgacttttttagcatgagaattaaacaaactggaagtcttagcttagctgctgaacagcagtgcatcaccacaatttttttccgttattgtggtcattgatagtagcatctttgatctaagggatgaattgtcggtaacgtacaaaggaggcccattttccatgcagatgtgaccaccggaaccaccatcgtcagtgggcacggcaagccaagcggtaataagattcgcaagaacgtggggggtttgcctcccgtacgtgaagacggtgcgagcgtcagcatctgacaagtccagtggtgtcgggccttggcgcgaaattagcaagcaatgcttcgatcagaaattcagttatactataaacatgaaagaatcaccctgctcaccgggttttattttgttttgaaagggaaatctgctcaccggatttcgatcgcagtgtcaggttgttggggataccacgtcgagcaaacaataatattcccgtctctgtggcaactgcttccaccagcaagcccaggctcaccaatcgtgaaagcggccggccggcggcgatcagtctcctgtaaaacaccggaggagcaacatatatggctcggcactcacccactcacccagctcagctgtgtaacctctaaaaatactagcaatacttttaatttggaccatatcttatctgccttcactgacacctcttatccagtacttatgcgtatctagatcgtgctaatcattgacgctccgtaataatgtctgtgatccggccatttgattggagagtatgcaaaatatgcatagtattacagacggatggatcggatcgaatcagtgtactgtaaatgatgagtaaccctggcctgattgatccgtggatctcccatgtcgagcggcagccgggcaatcacaatgatgagacccgatctcacagagtggtacgtggtgtccatggcctttcgatctccagcagcagcggcagcggcagaaacctggttggcacgtcggaggaaacggacaggatctccacccccacgaacgcgaatacaataatcccgcgcgacgcgacgcccgcacgcacggggcgggggcggagcggacgacgctagcgtccagccacagcgcagcgcagcgtggacggaaccccgacccgccgatcaagccgtccacccgcgccggcgccgcgaatggcgcggcccaaccaccgggagcgtgaggataaaccaagccgagacaccgggaatctggcgcgcggcgtgcacagcgaagcggcccgatatcaagcgacgatcatggcggcaacctaacacgggggcccgggtgcacggtgcgtgcgcgcgaacgtcaacagcctacgactacaactagtactgttcgcgatcccctcctcctaatcgtttgaagccagtgccgcgcacgtaggcgccctaccggttatggaaagggactcgcgggccgttcggaacggattagctagtcgtaactcgtacgtactcaggcgtcatgcctatggttcgtgacttgtacgtactgtgttacatctcactccacggatgcgcgatcaggatcgagagagaaaaaaaaaaggcaatcgatcaattgcttcccaacaactccaggttcccattatcaatctgaacgtgtcgatgcttccatcgaattgactactcgtgcagcaacactccgtacgtagtatcatcttcaacagcgaagaatcggttaaatgcaagtttaactgataaagtgagtgtgtgggaacactgcagaacggcacaaaggctgaaagttgaaaccaggaaagggcaacgcatgatcgtgcgtatatgtgtatattactgtttggacgatgagcacaaggatatctcttgagaaaagaaatgttaaacaagatcgcagagtgcgtgcggccacgaccaaattttgggggggcaaaaataatgtaagagcaaatcttggaccccacctgccagctgcccgcacgactcatcaaaaccggtacaaacccaccgagacagggtaggcgtcataacgcaacacaaaaggaaccgcgcggcggcaccaaagcgagcagaagcagcagccgaaggcgatcggagctcgcgcaacaggagagctgtctccatgaggaagctgtgcccgaacctggagcgcgatgacgcgctggacacggtgctcgaggtgcccatcccggaggagatgttctcacgcggcagcggcggtggcggctcccgcggctccaggttcggctgcaccaacgtcaagtcgtgggtgcggccgaacgcgtccgaccgctccggcggcgccggagagccgtgctccatgagccgcggcgagctgcagctcatgctcggcgtcatcggcgcgccgctgataccgctccccgtcgaccacgccaagcagtcgccctgctccgtcctctgcgaacagctcaaggccgatcccattgtacgatcgccatcatcggattcttctccgtttcgtttgtccatcgccgcgcgctgattggctcatccatttatggcgtgtcccctttcaggagtcgtccacggccaagtacataatacagcagtacatcgcggcgtcgggcggggagtgggcgctgaacaaggtcacgaacatgtacgcgatggggaaggtgaggatgaccgccgcggagctcaacagcagcgacgccgacggcggcggcggcggcggcggagggcaccgcggcgggaagaagagcagcaagaacggcggcgaggttggcgggttcgtgctgtggcagaagaagccggagctgtggtccctggagctcgtggtgtccggctgcaagatcagcgccggcagcgacggcaaggtcgcctggcgccagacgccgtggcatcagtcgcacgcctcccgcggtccgccgcgccctctccgccgatcgctccaggtataatataaaccgcgagttcttcgttagttccatataaacgcttaccgtattcgcacgacttgactgcaatactgcatggtcgcgtagcatcatagaaaacacgctcaactctcagttaaagtttccaacgactaggagaactgcgtactgaattggatcctgtttatgagacggacgactacgagaaccaaatttggtggcacatattttcttttctggttcgacgtcaaaacgagtagtcctttgtgtttgggtcgatccaacgttgctgttggccgaacttacgtagcgagtccattgttgtcatcgttcctagtggtaggtactaataggcatcggtatcatgacatggaacgcatacgtccaaagtcgcaaagttctcatcttaatgggaacttactttctgtagttctttgtcccaagaagctctgtttttccccttcgtcctgctcaaaccggcctgatttgggtactaggtggccatcagtacgcgccgtaccgagcgtgcgtagtacgagtagagagtagagcatgcatggcaacttggccagtgtcacgtacctggatcttccctgcatactgtcggtaggacaggacagatcggtcgagtacccgcacggccgagcgacatgattacgcctttgccgcactcattgggccgttggcattagctgtggtcaaggtcagtccagggcggtgtcgggatagggctggccgatcgctcgctcgtctcatcatgaggcttgtacacttgtgccgttgcgcgagagatctggtccagggcacccggtacacacagatatgggggacgtactcatcatccatcgtcagtagcggtggctgcacgctgtcgctgtggagtgggggcgaatcatggcaaggggagggcgattagcgggaacaaagcgcggagcagcgggattaggggggacgggttttcaacaccgtcaccgcaacgtgccgccatgtgctgcagcaacgcggcgggacacatcacgtggacatgggcctaaaccgggacgcgacccacgccatcaatcggttggtggctcgcggtttgtcacccggccggttccacccgactcttgaactctccccgctaatcgcgctgcaccaaccagcccgatttaatttgaccgcggtgtcaactatcataccatgttcttttttcataacagctataaatagtactagtatatagtgtccacgtggattaaattaagtgactggagaaattaactaacttgtgcatgcatggtgtgtttggtacgcagggacttgacccgatgctgacggcgagcctgttcgcggacgcggtgtgcatcggcgagaggagcgtggacggcgaggactgcttcgtgctcaaggtggaggcggaggcgtcgagcctgcgggcgcgcaacagcagcagcgtggagatcatccggcacacggtgtgggggtacttcagccagcggacgggcctgctggtgcagctggaggactcgcacctgctgcagatcaagtcgagcggacacggcagcgtcttctgggagaccaccatggagtcgcacctccacgactaccgcgccgtcgacggcgtcaacatcgcgcacgccggccgcaccgccgtctcgctcgtccgcttcggggacagcagcgacggcaacacgcggacgcgaatggaggaggtgtggaacatcgaggaggtcgacttcaacatctggggactctccatggactgcttcctgccgcccagcgacctcaaggatagcaaggaggacaaggacgtctccgccgccgtcaagcccgcgcggccgccgccgataaggataccggcggtggccgtccgcgtcgggccatcgcaggtcgccgccgtcaacatggacgattccgactcgctcattgcgaggtcatgacatacatagcgggcagtgttacaccgtatgagtcgtgtgtgtttacgtgccttatcgccataagttacttatggtaagatctgtaaatatattgcaggttgagatatttttgttttcggggagtggattttacctcagatagatgctcaggggtgagtagtaaagcgagtaatccgggatagatgttctaattagcggtattgtaatttgcttatgacgccccttcactgtaaagttgaaagaatctccagttctgctagtcacacactgggcttcagcatgttttccacttctcctgaacatacttgtgctacaggtggctgcaatccaaaacgcacataacttgctgcaagtgttttcaagagtaaaaacttaagcctcagtcctcagattaacacaatgcagttccaggctttcagcccccagaacatgtacagagagtggcacaaacgtatcacaacatcggtgccatttctgcaaggggttgagtgacagaagctttgcgaggatctgctttgcttgcatataaaaagggtagctaagcactgagatgagccttgcagcaacacacctagtcattttacatgtacagttagctaccccgctaaagccgattccataagattcatcacatttcgatgtgagtcgcatatggatcatggcataagattccacgacgcaactcgagttacagaagaaaacgaaaagaaacaaagaaaaacatacatttttatcacaggaagctaggctcgccctacaggagatagcggcggccggtgtggcacatagcttgcctgagctctaccttgactagctgccatgatcttgttgagcttatggtcagcgagggatgcgtgctcttgcgatgcgtgcacacctgcttgcgtcctggtagggcgcctgccgtgaagcatcactatacacatagcaaaagcctgaagtaaagcaatggatgatctgaattcaactgtgtataacccttctctgaatgaaaccatactgaaagcatgcttgtcttctcgtgatcgaccctacaaatacagatttatataagcatcaactgattaggtcgtcatagattagatacataaggacataggcaagaacagagaagcacaaggacgcacctgaacaaacaagtcaaaccgttgacttccatccgtcgtctggtttgcttgagtggatttatcacctttgttttctcgggcgtcatcgctgaggacactgagcatgcagccttcatcccacccaccacagtcacacgctcctcctgatttccacctctcaatcagaggtagtggctgtcctgaggttgatgtaccatggaagccattaggaagtacggcaagaacactggatgatgcacaactatcatccctcgtattaggatggaaatttcccaatgggcaagaacagtcggttggtgttgacatgcttcggctggaatgctgtgaggatgagtgacgagaagtttctggttcttgctgagacaccgcactaataaaagccgcaaactctctgctaacatgtgaatcacctgattcttcagaagatggtagctgctctgagccaaccagaacaaattctctatgcaaatggtttttttctgcctggtagcatcttgattttcgatgtgaaaccctcatttccccaacaatattataaacaagctgatctttcttgttcttattacctgccttgatccaagccccacctcttttcttaggttcttcaacaccaaacagagtgtatgtgctctccagatcattgttatcggagatgcccttccttctcacggtagccaccaggatatcagaaccacaagaaagcatgaaaaaaggcaggccattcttccacgctagctgcagaagcgcatgccttgttgttgttgaatctatatcttgctggaggtacctttcactgttcaggacctgaggaggctggtttgtattagtttctgttcggcaatttgaatttaccactgaatcaactgacctacgttgaacattctgcaaagcagatcctcccaagctcagagattgcttatcaatatggccaggcagatgacactttggaacaaatgaaggttgaattggaccagaagtggatgactgacgtggctttaatattggatctaacatcctcctcaatgggctgcgtctactgcctttgttgcctgatgacttatctccatttatcttatccacagaggtgcttgcttcaggttgtcgaggacatggtccatccttcaggcttgaacagcggttcactcgattcagtccagaaacaagatgtctatgtggtgacgcatccatatcactgaactttgcactgatccgaggagttctctcagaggcacccctggaaatttgcttttggttgcgattttcacctatagttacagcagcaccaacagaatcaccttgagtcccagttctgctggtgccaagctcttcagatgaatccatgataggaagtggacatgagtatggaattcgaggaaattcatggtgttgcccaatatcttttgagaaaccaacaggtgacaaactggcatttctttccatttccatcaccgcactagacactagagtctcaaaaacctcaccagtcacgccactgctctgctgaaaatcaccacatgcagaatcattgttatgtgaggtgaagaaactttggccaatgttatcatcatctgtaaaaagcctgcgcgaacaatgatggacggcctcctctatattccttgtagtctcctcatcatcaaccatttcatgtcgcatggaactcccagtggcagtaagaagagggtccgagagtggagatatgtttctgagattcaagtcaccgtatttgccagtgttctctggaaagtgttttccatgaacaggcaacaagttcaacactgcagaatttgggctaggtgaatatctggccttcccatggtatttatcctcaagatcactttgctgaaactccatagaacaatgctgatggtcattgagtgtaggagattgattgctttcaagagatttgctgctgggacttgcagatgactgggatggagaagagaatatcagggacctactagtattagatggagaggcaccatggctgctagaaaactcatgcttttgttggtgagaccacctggctaggaggccccactcgagaactccaacattcaatgccttgtcctgaagatggcctgatgtctctttacgctgcaaatatgaaggaacatttgacatatgcttgacaagctcatcaaccgtagtggcctttcgaccaggccatggttttgagcctttcaaggatccacccgcatctgcactccgaggttcccgttgccttcgaaacttctcatttttcacaactctgattctatcttcaaattttccatcaatgttcccaccgactactgcaatcttctcttttggcacttgtacagattgatcttgtgaatttcccctttgacgtccatcacgacctaatgtggcctttacattcctttctctgctaaactgtcctttcgttggcatctttttttatggtttaacatacgccaacaagcagagcttttcacttgattcaaattgaatcgtcaagtttcaacaggatactacacttccttgaacctgcaacttcaatattagcagaaaaaaactcagatatgtagcttctgatatttccaccagagcactaatgaacagaaagaaaatagcaggcagcaccacagaaccaacataactacagtattgcagtatctcaattcagaactaagtatttgtcggtggacaatggcatcattttgtctcccgggaatcctggatttatgaaacattatgtttctacatgtacttagtggggttgggagttggccaccgacagttttgacacaataatgttctaattaggatatgtcaataaccatgcaaacaagactgaaaaaaaaagggctcccactaatgataaaaggtgcaaataattatagatatttgccctgatgctataccgtgtgtggcttgtatataaaaatagtttgcacattgttaagggcccagccatccataaatagttcagtcagtcctgataaatgtatatcaactatggctatggggcatctttccccgtttccctcaagaaaaagggcacctttctccacttgattttgttgggtggcttacaaaatgaaaatttagccgtgcaagcctagctactcacaaaaaaattaaaggtctaactacaagcaagaggggaaaaaactaaagttagttgcccggcaaaaataaaataaaatctggagttgcatagacaacaaatattttaccatatggattaggttgaaaccattttttccctttgcaaattagcctacaaaatgcatcatcatcaacgatggtcgttatagcggcagaacgggggaagttggagaaaacttgctgaactgaataagatggaacaccagctgcggcattaaacccaacagaaacccaccactcttcagcatctctctccaatcgagccaaccaaccacattacccaaacattgaaacagaagaagaaaagaaaaaagcacacatacgacgaagtcacgaagataacataccaagatgctcccaagaaccacttcaagaacagtccccccagctcatcgagatcccatatggaggtcacgcacccgcagatccgccacctcccctacaaccagaacacagatcagtgaacctcgaccaagcagagaaagaatgccaccccaagaaagatgcgccaccttgggggataaagcgagagcgagatggaacgagagcgcgcagcagagtgggagcgaaagaaagcttcggaggtggactggactggatagagacctggagcacggcgacgcgcactcggtgggtggtagtagtagtagtagtaggattgggagtgaggcgcggtggtagctaggagcctcctacttcttctactactcctgtcccctctccgtgacccgccaactggttaggtgggtggattggctttaggcgggtgagcgcccagtcgccagcgttctcgcaccccccccgccgccgcctactcccctcccctattgacagcccccgctttacttctaccgcgccgcggaggagggggagccggttataccaagaggagg

SEQ ID NO: 61629 - DNA, 956 bp, Oryza sativa
  unsure (1)..(956): unsure at all n locations
ctgtgncttgnatttgaattctagctcggtacccagatagttaatgaatgtggatagcccatcgaaacatccatttacatgagtttatgtgattatgtaatagttgcaatgcaagaaattcagataaaattagtaattcagatttcaaataattaacagctcccaggtacgacaggaaataacatggaggctcaatttgatgatatgaacaagatttacctgagacccagcagatatatgcaagtagagtggcttctcaccatcagtttgtccatttggtggatggtatcttcccctggttaggtcaaagcaagtaaatatcaaaagggaccatcgcagtcacaagtcacatctacgttttgcctggcttacctagtaatgatgacagtgcttgtacatctctgaatctgttaagtatccagcaaatcattattactgctatcacaaagtgatctacgcaaaaatggtgtttaaccctgtacaggaagcacataacaattgtctcgttaaggaattttacctcctcctgagtttgccgtttcgtaagcttatatcgcacagacggatcggcgtcatttataacaatttctcttgctattagctcatcaggcatttttgcctgaagaaacaagatgtacacagacaaaattttagaaccgtgtgctgaattgcctaatcaacacatattgatatacttacgaaaaatacatcattgtcacacctgactcaatttctggaccgctgccgcggcggtctggagcaccgaaggcgccagatgcaccggcaaagtatagggcacagcgactatattccccaacggaccggcggctcccgggatcgacacgccggagagggcaccgatgttcaccacgggcaaccccgccacagcagcagcagccgccgccgcggcgacgacatcctccgcgggctgatcccactttcctttttttctacag

SEQ ID NO: 61630 - DNA, 15114 bp, Oryza sativa
ctgtaccactagtatggaccaacatgagatgccactggatcgaaaagaccaccatttatggtggatgtactgctgcaaatgttactttagaagtgcaagctttggactttcgattatgctactccttttattagtgctagtatttttttttccatccgtcaaattggcgcgtacggtttgattagcgaaaggggcgaggtcgcgtccttaggcagtgttataaatggattattcgtggatgaaagttgatggatttgctatctgattatacaggggaaattaagtagtacctccgtcccgtcccaaaataagtacagctatataaatatctgtgtttagcgctttgaccatccgtcttatttgaaaaaattatgaaaaatattaaaaaaattagtcacacataaagtactattcatattttatcatctaataataataaaaatactaatcataattttttttcaaataaaacgaacgatcaaacgttgaacatgaatagtactaaaattgcacttcttttgggacggagggagtatatattatgaacctaattactccctcattctctaaatgtttgacaccgttgacttttttaaacatatttgaccgttcgttttattcaaaaacttttgtgatatgtgtaaaactatatgtatacataaaagtatatttaacaataaatcaaatgatagaaaaagaattaacaattacttaaattttttgaataaaatgaacggtcaaacatttttaaaaaagtcaacggcgtcaaacattttgggatggaggtagtaacaaataacttagaataagttgtcttagcaatacattagcatttaccaacaattcagaataaagttttttgaaaaaaaaatgttttttgttttaaacgtgggagtaaataattcacccaatagtccggtaaatgagcataaaagaacgtgcttattcgcctagagtaaggttgaagtttcatatgttctctatgcttaaagcaagtttaatagtatagcccactactagctccaaatcatatatatagccaatttatataatagttgcttactatactattaatatctggtcccacctatcatacgcacattacgttttggagtccgtaatgcagctggctacagatctgtagctcgctgcttttctctctcttcctttgtgtctttaaaatatgtttatagttggcttatagcatgctattttacctgctcttataattccctataattggcttactcttgctataaatccaacaataaaatgtaaatcaagtaggtttattttctatggtggaactgttcttgttgacagtacgcttgagagtgattaatgcagaacttggaggagtaccatgataatattaacacatcgagtcatatcaagctgtattgcttgagaaatactcctacttgcattttttagggtgagaatttggcccctgcagaggacagttgccctttgctctccacatggagtcatggacataaaggtctacatttttcacccagggaggtcttgcaatttatcaaaatgtatactaaatagtcgggatatgtgcttttgtaaaccataaacatttcaaacaaagttgcgtgaaatgtaaagcagcctcggttatatcattttcagtggttctttgggagttctggtataacctgagcagctttaaacttgtgttctttttaggtggagtggcatgaaagtacaacgatgcaacccaagcttacaaatgcattccacatacatttcaaatttagttgccgtacacgcatagcaaacattggatccgcactttacatctaatcacctgctatcttcggtaatctccggccggattacggacattatgacctggtggttagcaaaaagccccctcaagaagtatctttcaagcccagcaaatcgattgctctcgctgggtgtctgttgtttctattatttcatggcttgatggggactccattggtgaggaaacggcagacctgttctggctacagatatatcatatccagctgacagtgccttccggggtcatatacaaagccgtggccagtagccccttgcaaaaaggaagcttcaacatatcaattattaaacagaacttcaacgctacaaaatatttaaataaatgaatctcatagctgtcaagctctaataactactatacttaaaaaaaccaatgtctcattttgattttagataataacagagaaaacattccttgtggtacggcgtactccctcccaacccacctttgtccagcggtgttgacgcctcccaaatccaaattaacggtccccaactcccaacgatgctgccggaccacgccagccagcgtaacgcaccaactcgctcgccacgatgaatgctcctcccctcctcgctgcctcgctagctcctcctctccccctaccagcaagcacccaccaccagtccactccacagtctcccacagcgccaccacggtgtccgaccgtgcgagagcccaagagcgagagcgaccgtgcgcgcgcgcgtatgtggctcgaaatcgcgagatatccacgtgagattgcgcagcgagacgcgagcggtcggcgcggccgtgccagccagctaagccgatgaaccgatccccctccctcccacagcccacacgccgccacccaaagcagcaatccaccaccatcatcgtcatcataacgatcgtctcctctacatagcccacaaccgccgggccgccgctcctctctcctcttcttccaccaagccaccctggtcccacccgtccgcggctcgagccccccctcaaaatcccccaaccccgtgcgtgcccgtgcccgtgccccgcccgcccgcccgcgtgccggatttcgccgtaaatcggcagcgtttccccgtgcgggggggcagcggcggcggttggatggcgctgtccgcgtcggcggcggcgtcggccgggcggggggcgcgggcggagaaggtggggaggatcttcgagcggttcgatgccaacggggacggggggctggaccgcgacgagatggcggcgctcgtcgtcgccgtcaacccgcgggtgaagttcagcgaggaccagatctccgccatcctcgacgaggtgttccgcacctacgccgagttcatactccccggggggcggggcctctccctgccggggctgctacgcacctacgacgacggcgccggggacgtcgaccgcgacttcctcgcgctgtcccttcccccgctcgagtccggggagtcctccccggagatcgccgcgggggacccggccgccgcctcgtccccgccctccggcgccgccgccgccgcgtcgctcctggacgaccacatcaagccgcttggagcagccggtggggcgccctcgtccagctcacgcgccgcggcggccgcgccggcgtgggcgacgtcgcccagccacgggattgcgttcgactcctcctgggcgctcctcgacgacctggagatactagtgaagcgcctccgctccaagcagctgcggagaacatcctccatcgacacgatcaacggcagcggcggcgcggggaacaacaatttcgactccttctccgaggccgggtggtcaagggagatctccggccaagcggattcggcttcgaccgccgcgccatgggacgagacgagccgcgactacctcaccttcgtcaaggagctcgccgtgctccgcacgcgcgcggacgcctcccgctcacgggaggaggccttcgacaatcacatggtcatcggcagggcgctctccgagcaccgcctcttccgggacgcgcttagcagcttccgccgcgcctgcgagctgcagcccactgacgtgcgcccccacttccgcgcggggaactgcctctacgcccttggccgccactcggaggccaaggaagagtatctcctggcgcttgaggcagcggaggcaggtggctcccagtctgcggacatcctcccacagatccatgtcaaccttggcattgccatggaggctgaggggatggtgctcggtgcctgtgagcactaccgagaggctgccatactgtgtccttctcatgcccgggcgctgaagctcctcggtagcgcgctctttggtgttggtgagtaccgtgcagccgagaaggcactagaggaggccatcttcttgaagccagactatgctgatgcacactgtgatcttgggtcagccctgcatgcgatcggggatgatgaccgtgcggttcaggagtttcagaaggcaattgatctcaaacctgggcatgttgatgccttgtacaatcttggtggattgaatatggatgcagggcgctttgtgcgggctgcggagatgtatactcgtgtgttgagcatccgaccgaaccattggcgtgctcagctaaacaaggctgttgctttgcttggccagggggagtctgaggaggccaagaaggcactcaaggaggcatttaagatgacacaaagggtagaggtgtatgatgccatatctcatctgaagacactgcagaagaagaaaccaaagcctcccaaaggaaaagatgatagtcaaggagaggaggccttcgttgtagtggagccatccaagttcaagagggttggaagaaagactaccttgcggcaggaccttgctaatgcccttgatataagagcctttgagaaaacgacaaagcttggccgctgtgacgcggagcttctgaggaaagagatgaacgagactgatgtccccatatcctactcaggcgctggcaacccagagaagtcaatacggaaagcagctctcgaggttattctccacaggctcctatctttcctcaagccagatacctttcagggttctgtgaaggcgattaacgaaagaatcctctccgtccttgatgcctctggttctggccgtgttgaccttgggatgttctttgctattatcgccccaatttgttctggtcctgtggataagcgcaagcgggttgtctttgatgcacttctttggcgtccggcaagtgaaggaagcaggggtcagattaggaggagcgatgcactgtcctacatcaaacttcttcgtgctgtttatatacccacccatggggctagcgacatgcttgaaatgcatggggagtctgaccccactatggtatcatacacggagttcctcgaaatgttcaatgatcccgattggggatttggaatcctaagcacattggtgaagcttgaggacagcgatcacattcgtcacggccgccacacctgctcaatttgccgatatcctatcattggttcccgattcaaggagacaaagcactcctttagcttgtgcaatcgatgctacagtgaagggaaggttccatcagcattcaagttggatgagtacaggttcaaagaatatggtaacgagtctgaggctcttatcgataagtgcatgtgctttaatttacattctaagaagctcgaagctgatacttgatcattcgatctttggtgtcgattgctcgagcatgaatctgtgtatcccctttctaggtgcaaagatctctagatagtctcctgccctcttgtaaactaaggtgctgttctgttcggagttttctgaatgtgttccaactacttgaaaatcctaatcaattagctattgttcgtccaagtgtatgggagtgagaacatgtgaattccaaacacactgttgttacaatccccaatgctcttgtttaatagagatccttgctgatatccatgaggttttatttgaaccaaacaattttgggctatttttttctttaatcacacttgtatgatttatagcttgggttgcaggaatagatggtaaaatcactatgtacattcagttttaaacttctttgtaagttggtctaacaaagattattttctaaggcagtcatcatgctggccactcttcatcatttcattccggatcgcttgcatggcaccacttgagctcattgattcttttctgatggctgttgccgaatactacaccctatcttatacggctcatatattgatcaagctgagacagatcagacgaagggaggacaggctggattatctgggtacgcatatgcattcgaatatttatcatgccataccgcccctgttcctttttcctggtaggttgaactatggaggtgtttttctgactccatttgactgctcttcaggttattgtttctgcattcttgtgcttccactccgtaccgctgaatgctgaataataatcaagtccatgtcacatgcgtctcaattcaatttgtcgccttcaagcatcccagctcttgccgcaaccctctcaagtgtgatatcgatcttcgctgtcaaagcagttgtttaatagagattcttgctcctcgcatgctttccttctcgtcagaaagtgccctgttgcgctggtaccccatgctgtccaagtaggtctcccccgtcaaaccgcatgaggtccaacccagcagtgacttctgctacctttacactgtcttccctccttgctttcacagatcggtccctttttctgccttgttcccccgcggccaactggaaaagcagaagctccgtggcacagcgtcacgtgggcagcgcgggctgcggagacgattgcagcgagccaggcgtcacgccgtgtttggttggctgcgatgggtggtagcaccggtgtgtggcaggctggcagcgcatcgtgcccagatagcagcaacagtgcgaccgggcggcaatccgcgattttgcgagccacgcgcggcagcgctcacacggggttcgttcgtgtgagcgctcacaacgtctttggcatgggcgcgcatcgcatctcgggtatggcgcgtccaacccttctcgggttgttcagagttgataagtaagattaggttagcaataaactggacatacatatgttcatgttgataagtaagattaggttttttttttggatggaggggtaggtctgaggtgtttgttcttcgctgtaggcaatctcagctcgagggattgcaaccgcgtgaacacgatagcttaatgatgtatcggccagcggttggaagtgttcatgaaatgatgcatacggcagttggcagtcttcaggattcaggaaaatatgcatgcgctttagacatcaggagattgacatattgagttcgatttgatgacagcatttttaaaggggatgtggcacaatgagcttgctcaacagtttgacttttacagttgtaagacttccaaaagattggacctgtaataatttagcacacatccaaacccaaaattgagaaaacccaatgctgtccaaagaaaatgtttgcagctgcatgaaactcttcacaccacatgacatcattgagatgctagccagaattactcctggtagaaaaaatcaatttattcccatgaattagaactaaacctactcacagtcaaagtatacaaaaacattgtacagaggggtctgtaagcattgggagaagctacagaaaacgacctctcatgcctttttctaataacaaagaaagacggaccaaaaattatgaagggatcttcaagtaagttgctagctatacccgttatgtatagaacctgctctgttcttggtctagccatttctgataccacagggcaatatacagaggcaaatctttcttatctatgctccaagcttgccaagaccaaaacaatttagtaccaaaagcaggcacagaaaagtatcagcaatgaaatggcacacatcacagttgtcaaagaatcgctccatcactcttcatcctcagaatctgcattatgatagcatccgataattttagtgataagatgcagtaagaaaaaccttagctattagaattcctggttcaatgaatgttcgattttgtatgttcttgtaacggaagggagctcctaacatttgcaccacaacgacttgccacagggtgatctaatcaacatgtgatttgtttatcacatattgcccatgctcatgtgaaaaaattgaaggccagtgtttattatttcaatatgtaagccattgggatctcccctattgaggcagattctcttattttttatttatggatgaaaaaaggtaaaacataaaataacgaatatagatcaccaacgagtgattaaaccaaaggttttcttacctgatcgaacatcctctccaacctgtcctttattgttcaattgtttcattatcattaagcatatgagtttccaccagtaaatatggaacacaagtaaagtgaggagcattgtgttgaaaatgtaatacaatgttgttgggaatttctccagcttcctcaaagatatgatggactgatagctgcacattgcaagaaaagacacaaaactgtaagtttgaaccttagttggtaaaaggaacagaagatattatgtcgagaagtacaaacagaccttgatgttttgattatccaaaatgggaagtaaatcagtcgtaacagaagccaggagagagcaaaaaggccaaaaaacaagctagccccgagctccttttctgtgtatttgcacagtttggcggtctcaagaaacacatcactcgcatcatgcaaagccagaataattgtcccaatccgaaaaaatctacaatataaaaaggatttaattgtcttagagccatgcttatactgcccttatgttttatagtgcaaaaggtaataaatatgttgcttaatagctcagaatcaacagaaacatggtgaacaggactaaaaaagaacatgtctaataaagcaaagtggtttcaaaacatctatgtattgttagatgacatagctatgctgcaagcaagaagggtagctgatatgtcaacactacaaatttcgtttttatatctatgtgttttcagataatcttactgttcttcaatttatccaaggaatcaaactactagattgcttttatgtctatgtgtttttttcagagataattttttactgtttttcgaaccactaggacttaactcagtcacagaaagatttggataatcgctgtagtccagtttacatccgaacataagagaaggaagtagttgaagtgcaaaactagcaaatatatcatcaaaggggcttgaaagaaattacccagtcagatatgcatatccgatcagaatagatgttacaacatgatgagacatcatcacagcaaaatcttttctgcgggtctcccaggcaacgagagcaaaaatgctgtagatataaaatccacactggcacatgtagaaaagcatcaatgaggacctgcaagaaaaggacagcatatatataaggaaaatggaggtaaatcacttactccctccgtcccaaataaaccaacctcgtactgggatgtgtcacatcctaatacgaggttggcttattttgtgatggagggagtaaccccaaataacaggtttatgagaactctaatcctgggacattttggtcagcatagcgatgaaaacaggggtttggtattactacaagtgcatgattataagtaattaaaatggctcggaatatgagtttcatgtataaaacagaaagagcaaaactaaagggtgctgacaacaacagttttatgtttttttccctagctaccttccttctgcagtatactagcaatgtatcaggcatagagcgcatgccatacaggtatgctcatagatatgcagaacgtacgtaagagtagtttacactcacgtcatgtattgatttggccagccctcgaagtattgcattgtatctaacgaccagggttcctgctttattatcaagaggacccatgcttgaacagaaccatagtatgtcagcttccaaatcgactcagagaacttgacaatctttgcttgcctgacctcatcattcatcagcttagaagccttgctactgaaacagtaagctgccagtggctgaaatgaaacatacatagggactatatgtaaggcgtaaattctcaagtgcaactgatagttattctgaaatttcaaaagcataattttatacaggcaattcggaaaattgtggacagaaatgaaataaaaaacatacaggaaccaaagctgtggttatctaagggcttagctatatagctaccactttatttgcaactgtacatatttttagctaaaacatgttataaggcttttccgaagttcaaacaaaagagaagccaataggtagccaaacaacatatggacatatggaatttacacttggatccaaaattgaaggtaaaaattaatgtacaagcctaatgtgagtatcaactcccttgatccgaaagattgtgagagagtacttcaaccaccataagacaccataagagttcaaccaccataaaacaccataagaggacataggaaccaagggtggcagacaagctcatgtctttaaagtagagtactagcaaatgacaaccacattgatcataaatagccgccatagccaatataatgcaattaatgacatttctattttggaaaaaaaaagcagggcacagacagcacttcacatgcgcatcgtcgatacatcgaattgtccggatcaaactgatcgggtacgagtacggccataaaggctcgcagtgccagcgagatggacgagcaccgctgccacccagcaccttgcgtcacccccccgggggagagcattggggaaaccgagtggagaaagagatctcgcggaacccggcacgaatctggcagggggtccgagagctgattcggttttaccttgtagacgaggcggtcgaggaagaagcgggcgcagaagaagccgacggagaagacgagcgtgagggggaagaaagacgacgcctccgggccccggatcgccatcgccgacaacccaacagagccccctcgccgtccgcaccaccacggcgaactcccgcggcagggcgccccccctctcgcgcgcgcgcgcaccgataatgtgaagggttcggcggttggggagggggagcgggaggaggcccaggcggcacgcgctgctcctgtttcccttcctatttctacctctcgcgcagggcgaggcgaggcgaggcgagacgagacggggtttggctttggtttggacacgatggaggaggaggagatcgagccgagggagagggagagagatggaggtggtgggggtgcgtgctactgttcctctcctctctctcccttgtgtttgtgtacgcgtgtggaatatgtgatattgggatctctctcggtgtctccgtgtctcggctgattcggttcttttaatcgtggggttcagatgggaactctctcgatctgtagttatggacttatggttcgaattaattggagggtcttccaagtagtcccaacatccaaagaatgttggcactggtagtgtttgtataataattttttcaacccataaaaaaatgtgtatacgttccgatcacaatttcctttcaaacccaaaattacatcatatacaagttctaaagccggcatgaattttataattttggtgataggattataggattgttttgtcttttggtcaatggcgtggcagatattcatttggttttaactaacgttagtttgaactcccttttcttcacggtgcatcctacctcggcacaccaaaagcgtgatgtctcctgtaggttgcttaattggagagaaaaaaataaaatcaatgaatttgccaactgtcatccgacagaaagaataaaatactttaactgagcttagtttatccaatctttcttgtatttgagtaatcttacaaagcttaaagcatgttcagatactgcttcaaacatagaaattgaattgattcatgtaaaattactacgttggaacttggaagcgactgacttagccaaattgagttaggccctatttattttgggagcatatcaggtggaaaccagggagcctgtgcaaccttggaaactctcaatcacatccacaggatgagcatccgatggctagggatagaggtgggctaaatttgcaaataaccgcccgccagcccctctgtctgttttgcaaaacaccccctgcgccatccgcctcccatcacttttacacccgagcccctacgccagtatcgtctccccacgactcgcgatccagccaccgcctctgatccgctgcgccgtctcagatccagccgcgccgtctcatgagtcccgcattgggcttcgccagccacgcagtggtggtcggaggtggccttgctggcggccgccagggagatgtcctcgacggtggtggtccggttcaggatgtcctcgacagtggcacctctgtccagttctgtagggcacgaattggagccacgggcagcagcgtggcgcatcatcggcagcaacgcttcaccggcacctgcgcatcaccggcaaaaaatgagaaggggcttcactgccagcaattactaggactccatcagcagtgagaggcagcatgacaacttcctacaggtcaggctcgatgtgtggcaggatgagtacctcaaggttcatggtcagtggtttgctattgtcacacatgtgcagcaggcacccaagggcagtcctgccactgcttcagtcagtaccggatcagaaactgagtaatggcaattgtgcctgaacaaaaggcgtcctcgtctgggactgtaatgcctgaacaaaaggctctgcaatggcaattgtgcctcctgtgtaatgaacttgtgtgtggagcattgtgtgtaaaatttattgaaaaattgtatctcagttgtttgtaccagaagactcatatcattgaaaattcatgctaattttttagtgattcagcaatggtgcctcctatgtaatgaacttgtgtgttttaatgattcaacaattgtgtgtgaaattgaaacactgaaacattgaaaaattgtatctcagttgcttctactagaatttttacaaggtgtttacaatcactaaaatactgaaacattcatgctgttttttccgagcactgatcagcactgaaactgagaaacattgaaaaacgtctcgctggcgtcgcgggcgaggactccatgccgactcgctagcgtgcggctgtgacttgagggccaggtcggcggcgactcgcgtaccacggcggcagccactcacgggtgacacgcggacgatggcggcagcgactcacgggcaactcgtggacgggacgggagaaacgaacaggcggcgtgcgcgctggggattagggggagggggtgatttgaaaaaagcaagattagtatggctaatggtgggcgcttaagtgcaaaattagcctacctctatccctacccatcagatggtgattatgtggtcttgattgagagtttgcaagtttgcacaccttccctggttttcacatgatacgttcccatttattttagcttaagattattataatctagattattgagctagattactgtaaactgaattataataagccgacataaaataaattgttagctgtttgtttatctggattattagctgtttgctagttgttatccacccaataattaaaaaaagcacatttaggccctctttttttaggcttataagccaacttataagtcgaaaagtctaagccaaaacaaacaagcagccttttcatttggcttttttgaagctataagccactctaacactattaagccaaaagctagattggagaagcttttttggcttatatgagatagatatatgactccaccactaaacttaggacattaaatccactggcttataaatcatataagccaataagctgacttaaaagtctaggccaataagcctaagcctaaacaaagagtgccttagagtggattaccatattatagtaatctggctttatagattgtaataatctatcgtaataagctatttgtttatttcagcttactcctaataatccagattataataatcttaagctgaatcaaacagagctatactcccaagtttcattatactgaacatgtttagacactgctacaaacatataaattgaatgaactggttatgtaaaattattttgcattccaagcaattttccgtcgcaaattgagttaatactctcattttgtaatattcattaatatagggcaccttcattacgttcattaggccgtgttcgacaccccttgttaccacccctctccctcgttttccacgcgcacactttttaaactgctaaacggtgcattttttttgcaaaaaaaaagtttctatacgaaagttgcttaaaaaatcaaattaatccatgttttgaaaaatagctaatacttaattaatcatgcactaatggatcgcttcattttccgtgcatactgtttcgattgggaagaaaggatgccgaacacagccttagtgtggttttggaactggcaccaagtctataaagggttgtatcattgttggtttttatatgagccaacactcatgtttgccatttgtgttgccttttatgtttaactagtaatgttgtgactgtctagtatatataataaaggaaaaagtacgaattactccccgaactatcgcggtcatccgaattacccccatgaaccataaaaccagatattctccacccccaactatgcaaaccggacgaattacccccccgacccaatccacggtggtttggtctatgtggcgtcaaaaagtaagaattaccccccccccgaactatcgcggtcatccaaattacccccatgaaccataaaaccagatattctccaaccccaactatacaaaccggacgaattacccccctccccgacccaatccgcggtggtttggtctatgtggcgtacatgtggcatcccagtcagcattttttaatacacaaaaatggtgggacccacctgtcatactctcccacctctctctcttccccactttcctctcaatctctctctctctcttcccctcttcctctcaatctctctctgtctcagatgtggccggtgctaggcgcggcggggcacggcaggcgtggtggagaggcgggcgacgtttggcggccggcggccggaaatccactgcgagcggcgggcgccgtcgccctcgcgcaccaccgggagcagctctagctccacgcgcaccacgggcaccacggacacggcggggtgc

SEQ ID NO: 61631 - DNA, 713 bp, Oryza sativa
cttatatggaagttgattttgtcgatggaactcgggataacaagttcggcaagtggtcaccaaattgggaaggaccgtttcaaatctttaaggttgtgtctaaaggggcatatatgttgcaagggcttgatggtgaggtttatggatgagcgctcaatggcaaatacttgaagaagtattacccaagtgtttaggttgacgcatgatcggctaatgttgctgatgcatgacagccgatgtgttttacatcgtcttgagatggccgatattgttatatcgctcttagtcatttttctaattgtaatcggttatggtttgccgatatataacggctgaaattgttatatcgcccctagttgttttttagttttatcaatgctgttgacattataaaattggggggcacatatatacaaaaaatgaaaaataatgaaaaattagaagttatgttaatcggcataaaggatagtgaaaacagcagggtattaaggtatcttagccgattacaagaatttctaagtcctattacacaaaagttattgagacaagtactgctggatagccgaaatatctctttgcctaatttgttcgacttcttcaatggcttgggcatcttgagcatcagtcccgagaatgatcttcagggactcggttacgtcaacaacattcttgatagccgattggagccttgcttttgctcttgacagattttg

SEQ ID NO: 61632 - DNA, 5970 bp, Oryza sativa
aagctagctaacaagtaaaatgtgctaatttttgccatctccaccattagatgtaattcaaattccaaataagttaccattttttaaaatgtggttaattatggataattcaccaatccatatgccacaattctactttccatagattattgatttgttgggatcttagatataggctataccggctagtgaatgttttaattctctctttttgtgataaacgtttttgtttgttctgagtgtgacaatatcacaatggacacaactacaccgagagtgctagctggatagtgctaaaaagagacaccattctttccaaaaaaaaactactagtacactcaatatctatgtatttttttcttcttatagaagtttctcttaagttactcatccgatttaaattccgattacactgttattgtaacaattaaaactttacaacaagatctcacatgattatattttgatgaaaaatcacaaattacttttatgatatgtctaaattacttctagatttcactaagttacttcttagacatataaaagtaaattaagtaaagcttaaaagtaatttaaatatattatagaagtaacttataacaaaaagaaagtaactttaatttagaactatatctagattcattaacatctatataaatgtgggcaatactaaaatgacttacattatgaaacggggtgattaactctctatagtagaaataactatattgtgagtgagctgaaataagaaactatatagagtaaattcgcaagtaaagtgtagagaagatttataaagtccacaaaatatagaattaactaaaaacagtaataaaaataatcaacttagagcattatgaatgtatataagtaatttagtcaaatctaaaagtaacttatatatatatatatatattataaaagtaacttagtttataataaaagtaatttacaaatataaatattttttcatcgtaatataatcatgtaagatcttgttgtgaatatttaattgtaacgaacacaatgatgtaattggattgtaaatcggataagtaatttgaaataaaactttataagaaggaagaaaaagacacacatgtctaagaggaaaaacagcacgcacatcagcacgtgtagcagtaattcttctcacaattaattcgtcgttggttaacactaaaccgagattttacctatcacaatatacgtgatgttggtgtagcctcagccatattgactccactttactgtaccgggcattgggcattgttaaatgtcaacgactaaagcaatcaaaaattcaaaaatgtgcattgaatacttgcccaagatggttgacaacgtcctccctcttcatagatcaacatgagaaagaaaaagggcatgtgttgattcaaagcagagctcattggtccccctcagtaatttatttgagtattacatgatatcattagaacacgagaccaaaccatttagccaccgccatctatcaggctaccacatgataggtgatgtgatacaattgttggtttcggtgttttggtacaagcacaaacaacattcccaacaaatattgcgtctatccgtagtgtaacttctaacatggcaatattttccgtcaccttagtgaagatggtagtgcctctcatccatacaacacggcttcctcatgcaatacgatcactaggccttctctcgttgaggtcaagcagccaaagccgtcatgtggcataataaggtaggaaatcaattggagacttcgagcgagatatattggggagactgggagagtgagtttgggtttgtcttaggtaaagagttagttattgtggtttcgatccgatccctgctattttatctttgctccttttatctccgtattttgttttaatgctgctataaaatattttgtatagtacattaatacatgttgtcagattatgactacctcaaattctcatacgaaatgaattaggaaaccgcaagcaagcctaagatgggctggcccgccagagcgccaggcccggaaaagctcggccttgctggactcgtggcgatgggccgttgcaccgagcggagggatctatcgaccctcgcgcacgatctgggcctctcgatccagatcgaacggccgccccgtcaccgcgaccgccgcggcgaatctggcacaagccgccgacgacgcagacacgagcccagcttgggcgaagccaagcaggcaagcatccatcatccatggcgcgccgttcaaaaccctaaaccctgaggcgaacctcgaggaatcgcagcggcgcgtcgtgtcggcacccatggcggcgtccccgtccgctcctcctccccccgccgccgccgctggagtcggagtctggagccctgctccgcaatcgccgtcgcccaacctcgctaacttcttcggtaagtgcttctcgctcgtttcattgcttcatcgcacggtggcatcggctccactagcctcagctaaaatccattgtcgcgatttgggggctaggagagacgggcatgggatggagaggtctcacagtggcattaaaaatgacttcgatctgatcaatgatgtgaaccatctcttgttctgttccttgcagaagaagagtgctgtttatgaactcctagcaagttacctgtgcatatttgtatgttttggcagttagcgtagcattgaactgtcattcagtaaatgcaatatgaatggacacacctctcttcagatttgagcttggacattgattcaccctattctcttagcccactcaattaggccaacaaatagttcagagttctgataacaggttatagatttcaattactctgtgacatatcatggtttaatttcatcaatttctttgcactttcaagtttcaacagcaaactatgtgataacttgtattagggttttacacttttactgcatctgggcaatgcattttccagaagagaaacatgcattagattattgctaagataaaccctgtaatgcagtatggagggaatttgtatggggagcaattgcaggcgcattcggtgaaggcatgatgcatccagtcgatactctgaaaacacggcttcagagtcaggctataatcacaggggctaaggtatgagatagtttactttacatgtgcacggacagtaatgtttcttgctgcaattcgtgatttgatacatggatactgcatccttcttttctttgtgctgagcaggctcagaaaaatatattccagatgatcaggacagtctgggtctctgatggtctgaaaggttagccattctctgttgtttgtttactaaacaaaggaaaaacaacatgaagcaactttgtattagctctgaccaaaaccagttacttcgtatcagcagcaatcttgatgaaattcaatactcacccattttcaggtttttacagaggaatcagtccaggtgttactggatcacttgctacaggggcaacatattttggtgttattgaatcaaccaagacatggctggagcattctaatcctaatctaagtggccattggtctcactttattgctggaggaattggtgggtagctattttcttatgtctcttgaatgtttagtattgtaaatatttatgacgttacctaaacttttttatactaggttttatcaactgtgatcaatatttatttttagaagtatgccctttttttccacgcaatgtaaacatttctggctgatggaattttgccttctcattggaatttcgctgctggaaatttgccttctgattggaatgcatggaactcgagaaaaattcttatgccgcttcattgtgctcattgcaggagatacacttgggtcttttatctatgtgccatgtgaagtcatgaaacagcgaatgcaagtccaaggcaccaagaaatcttgggccttaactgccacaaaaggaaatatttctcaaactccaggggctccgatgtataactactataatggaatgttccatgctggttgttctatctggagagatcatggtctgaagggactttatgcagggtattggcactgtttgcttgttgctagcatgcctatcgttattgatagtgcgtttcatctatttatagtggaggggaagcttttgttttaatgaattattattttctagacactctaaaatcacatccattgaaatatgctagaaaactatttctgctcgaatactgattattgaattatgctcgaatactatttctcaacctttgaatacaattattgatcattaaaaactacattttatatacacatttctggacgcgtaagtgtacagttgttgattgaacaaacctactatcagtacagtttgtatgtaaagagacaaactgatactatcccttgcgtgatgataggctagttatcattcatttcctttttctttaaactgacacaatcttttgtcatacacagatactggtctacacttgccagggatgtaccttttgctggtcttatggtaagtgagaaattcagcttgcacttttttctcattgttctagtaattttaatatacattttcatatctcaaagcaataggtttggggccctcctccttcatgcagtaggcatgtcttaagagctaaatactgaccacaacatggcagcctcaagcatatgaatttttaaaatttggccaggtctcatcccagattgcacatgtcttgataaataaatatgttttgctagagggctgtcttcactctttagtagctttcgactattagagttcggatttgaattgagcctttgagctcctgtaccctacctgttctatcttctatgcataattatctctaccatgaccctaattcttgtagatattcatttcagcttacagtctgattttattgacagatctacgcatgtaatgtacactttaagattccttagctgcagacagtaagagagttcctttttatccttttttgatgagcatgatcttttgcattttcaggtcactttctatgaggcaatgaaagaactgactgagtatgggaagaggaagtatttgccagagagtaatttgcatgctagcagctccttcgaagggcttcttctaggaggcttggcaggcggtaggtctggtccaattttgttaatacaccaaatgttgcctatagtattacttgattatccgaaaatgcttaggtctcttgatatttacttattttccaatgtttttctatgtcaggttttagtgcatacttgacaacccccttggatgtgatcaagacaaggctgcaagtacagggatcaacaactaggtaactggaaaatctcacctatctctccttttctgctaggccaatatgacagtcatgaaatgaacttttatgataactgcgatatccaatttatactctcccaaatcgtcacacgcgtcattttgctgtttgacaaggtactgattattcttttgtttgttaatcagttacaatgggtggctggatgctattacgaagacatgggctaatgagggaatgagtggcttgttcaaggggagcattcctagaataatatggtacatacctgcatctgcattcacgttcatggcagtggagttcctcagggatcatttcaacgaaaagatcgatacagatgcccgtgaactaaccggcctgtcaatggacacaagatcagaagttgaggaagctgcatgaagccctgaaggcctgaagtagttccctgttttgtaggactgatccagaggaatttctgatttctccgtcaagtaaagttcatttcacgaatataagtgtgaaaaatgcaatgtcagccaagtttcaacgtttacaagcgtagaagagataaggaaactgatcatccttcatctactcagtatttttttgggggtgttggaaaccaggattgttggtgggcagtagttcttctgggtcttcaaagcccatgtttggacctaactgatgca

SEQ ID NO: 61633 - DNA, 4577 bp, Oryza sativa
catctaaaataagcgtatatgaagctttttccatcattttgactcctcatatggatatagatttaaaactaccacggtagcacctataacccattataagtgccttttcttaaaaaaaatggcaccaataatgtagccgagccgacggccacgcagggtagccgagtggagcacaagatgggaaagaaaaattctcgctcttatcccctcgcatgtcgagccaagctgtactcctctccctaatcctcttgcaccttctactcttcatccatcttctcctttgcctctcccactcccttgcacggctggccgacgctaatccctcccccctgcgtggtcccgtggtggtcaacgcctctccttctcccctgcgcgcatggcggctagcacctttccctctcgcctgggcggcaagcaggtgcctctccctctcccctagacatcgtcgccggtcggcaggaggtcaaattgttcgtggcaaggaggtccgacgacgcactacaagataattgagctattgccaccaaattatacaacaaaaaatatttcgtagcaatatattgtactattgcaatgataatttttctgtgacaaataattatattttattgcaatgattgtaacgatctacaatcgttgttttatttaaaatacatgttctatagccacaattttaattttttggcaatttacataatacatggtactttcactattttttgttgccacgatcaacaaattcgttgcaataaaaaaattgtcgtctcataatttagcttaattttttcatatggatacggattgagacaaattttatatgaaaattgtagctctcgacaagatctataattttatagttgataactttttcatttgaaatcttttagatattcaaatctatgattcaaatatcagttaggtaggctcaaatggaacgatatgcacattccaacagaattgatgcataggtgagttggtaaaggagatcatgcgtgaagggtaggtcttgggttcgaatctgagccaagacatggtataaagaaataaatataaatagataggatgatagattaatatttgaactttcaatttggtacgtagaactaatgccacatatggagtggtggcaataatttttattacaacgatgtaaagtgttgcagaatgattttttgccacatccattccgtggcaacatctaaatttattaccactaaataaaaatcgttgcaataacctattaccacgctatttattaccacggctagcaacaatttaaaattgttgcaacatgtatttattgccacaattttagtattgatgccatgattttttttgtggcaacaaatgatttttctagtagtgacgaggaggtctggcaaggtgttcatctccacccttcctttcctctcctctcctgcgaggtgtaggaggaggcacgccggggcaggggctagattcgccagtccccgagctcgggactgccacggaagcaaggaggatgatgaggacagcgtgatgggtccattggcaagggttttcttgaatttgcgttgggttttcttgatttttggggaaagggaaatatggatatgggttcctgtttgggtccaaacgttgtttgcaacatgatgaacgttcttgatttgtttaatttttgagtgaaatgtgaaattgttgatttttttttcttctatggcttctccatgtatgactttgatgtggatcttaggaggtgcattgactcaattcatcaagacaaatcctttttttttctcgtcgtaggtgtcataggagccggttcctaaactggcactaaaaatgtggcttattagcgccgcctgaggagtgcaggatgggaaatctgatagttatggccgattcctaacgggcatcaatcactttttctgtactagtggagggaggaggtaaaaaacaggaccggcactcctaagacagatccgcttcgtattttaagtctcttcacaatttacacaatcagtcctcattagacctcacacgtagaaaatcgatttttacaggcgagatctgaataagatcgcctgaaatatattaggtaggtttgcacgtgatctttaaatgaaactcctaattggcgtagacgcactagctaaataactggcacatgtttcggtttcggcccattattagtaaggcccaattacactttttgactttcagtttttctgtccgacagtgccgggcacttgcacgtgctaataggaatcaacgagaagtgaggcaaaccgtttaatttgaaactgtttctccacgattagcaattattattagttctaatttttgttttttcaattaggtgacgtgattaacgaaaactttcaacccattttttgaatcttttaactcgaatttgaaaatttcaactcaaattattgaaacttttgacctaaaatttaaaactatcagctcaaattttcgaaaactttcagctgaaaattcaaaacttttatatgaaattttaaaactttcaactccaaaattcaaaaaattccaattacaaaattcaaaactttcaagtccaaaattcaaaactttcaattgcaaaattcaaaagtttcaactcggaatttaaaatttaaatcctcatgttaagtatttattagcactaatcacattattagtgtcagcacaaggaaggcatcgtacgcgggttaattgcatgttttttccattcgctaactaaaataggaacttgcagaaaggataatacgaaaccaccgattcttatgtgcacgcatattaggaggccccctctttaaatcccatgtataaaaaaagtcgatttttacaagaaaaccgttattatatttttacgaacgggttttctagtagtgcgtcgtactttcccatcacattgatcgtaatatcaagattggtactaataaacgtggttggcttattcagtactccgatttctgaactgacgtcatgagaaaaatccaagatattttgcacggacaggtcgtcggcctcttcaagtcttcatggtttgaaacaagaaacggcgaacattttctttaatactgctctctaggacctggactttatgggcttttgatgcaaaataaataaataaataaataaataaagcccatcagtactgtggagcagtgcaggtgcaggcgtccagccatctttcacagtttggagttctaacgacaaaaataaaacacaccttgaaattgaactgatctttctgccgttctttgatggaaaagggaaggaaatcttggccgcatttttgaaacctcttaacttgaacgtttggactttaaagtcggtcacagcatgcagatttaatctcggtgtacatgtcgacgtcgaaattaaacttaactagaaaatcagcgtgcttgttagcacgctggctagttcatagcccgtacatgaagtttcatcttgaatataaaaaatatataattattaaatgagttggagtatttcaattgctataaactccaaataccccttcgaactttggaaggaagtccgtctcccgccctaaactttaaaactggacatccaacccccttaaagtttgtcatacatccatattacccctaaaatggttttgcatattttggaaggagaattattttatttctttttgtcataggttgagagaaatctatataattatatatgctggtcaataattttgttagtttgacgttggattgatatgctacttttctttaccgtgaaaaaataggggagaaaaggaaaaaaaaagtatatttgcaacctgcaatttttgcatataattatctagaatgcgtggtatttgtcaaaaatacatattttagaatatggttattctctcatttaatttttggtctttatattctagaaatatatcaattcgtttagggtagttacctcaatttcctatttggcccttatataatttataaaaaatatttcattaaaatgtttttacttctttattatttttaatattttccttattttttttccttgttcatgcggcgattgtcgatgaggtgggttagcgacatgcttgcaccgtcacgcccaagagcgggcatacgtgaacattgtgaggggcatcgagtgggctggctatggtgcgtgactgggctaggcccaactaagtgctcggagctccttatccttttctcttttttttttttcatttccgctcgtgtaacgttcgatagattggtctagaggcttccgttttttcccctcaagaaccacccccgcattcaccaattcacatgctattcattaagccacgtggaccattcaaattttggcacaacggtcagctttagcttagtagatactcacgcaggggagtatctctgaatcatgacgcgccacgtggcgtttgtctccggccgggaacgtgcatggaattcgtatatagagattagtactacgaagcagctgtgttggacatcatgcaaaatctcctggattgagttcaactgaaacagtgcagaaaaataactgtaatttctgtagtaacttagcccagctttaattagtcaaataattctatacgctcg

SEQ ID NO: 61634 - DNA, 6568 bp, Oryza sativa
  unsure (1)..(6568): unsure at all n locations
catgtcnattgttaactcatacnnctgccgcagcccgcggtcgactctagaggatccccaaacaatcataaaactacagatttaagacgtatcacaaaactacagatttaacaccatatttatcacaaaactatagatttaaggttaagtatcacaaaactgcatatttaatatttaagttatcacaaacaataacttttagagtttaaatccctagcaccactattatgctggagctataaacattattgttttatgactaaattggttctaaacctatagttttgtgataatttagttactaaaaacatgtagttttatgacacttcatcttaaatgtgtagttttacgataaacttggtgttaaatgtttagttttgtgatgcaccgagttaaatatgtagttttgtgatagattggtcatagtatttgtagttttgtgaaatttagaaaaaaaagatgaatacttgtaggcttgggtgaagcatttgtgttcgcattagaagccgccgaagagctcagaatatcagaaagaagcctggtctttggaaacaaacgctcctctgagctttcgtcccgttctgttactacctgcactagtacagctgctaatatcagctaaacaatgaatatatcattcaaatggaatgcaagtcaatacatcgtgcaaggcacaaagacagaagataattggaaactataaaaatgcattgtgaagtaggaacacaaatatatggctaaaattcagcctctgacttcacatttacttaaatagcataaactcgtcttcacatttactgaagataactttttttttactcgcagaattttttttaagaagcaaaacatggctatgattgaagccacaaggagcaaacaacaaaataatacctaaattttggcatttcaacaaaagataccctgcttcattgaaagtctgaaacaactattagaagagatgtaaaggatttttgaagggtttcaatccatgaaaccgcaagtaaactatcatcaggcaaatcaagaaccaaaagcctcagaaacatttctcatcatgttttgaacaaaaatcagggagtatttttttccatactagcagcagcttactggaatgtgattccatgagcaaaacattggtgtgaaataatgcacaagcggagcagtacatatgcacacatgcacttaaaataattctgaggttctgccattaaagtattgggaacacattgaacataacacaacacggcttactagaacatgggacaaattggcaatggttggtaaaggacaataaaatctcgtttaaggaaaaggaaattaaagataatttagaaagcatgggattattaaaataattaggatgggaaccatgttgtacctcatcctgcttacttttaatttcatcttcttttccagttgatgccttctctgtggccatacagattgcaggcaacccaggctcttgtttcactgcaagcagtttaataaatccaggaatggcttctgtttgtgcaacccttggaacattcagagtgaacttaatgaggggtttcttttcagaaacaacagtttcagatccagcagtagatactatgggtagacgatgggctttagtaaatcccggaggaacatcaagagaaaatcctagaggggtgtcccaagaaaggctgtgactgtgagaagggtttatgtgagactcagtagtttctcctgtatgagggagataatgagctttcataaagccaggagggatatcaagagaaagccctggaggtacgcccaaattaaggcttggagatgagtctatgtaaggctcagtggtttctcctgtatggaggagacaatgggcttttgtgaggcctggagggtcatcatgaggaaacccgggaggtgtgtccaaaacaaggtcagaaccagcatggaactctatgagcagattgacaagtaaaatctgtaactagaggaagtataataagcaaatcatggatgaacaaaaaacaaatcagttgaataacaagatgtgccggcccatacaaaaaagcaattgtacctgaagagcttgccgcagcatttggatcaggagtcagcattctcatgcattcgttgatcctatctctttctctgctaactgccgaatccaatttattaccaatctccccacatttttccttctctgtttttttgtcttgtgtctccaaaatcttgccagtttccttatttttgtgcctctcaatctctttgcatcctgttgcatcaaatgacatacttgtttgattataggatctgtgcagcgcccggaaaacaccccaaaagtaaaacttatcacattttcctgttaaattggtaattatacagaaaaggttagatgataaatttgtacatgcataccactttttaaaacatttaacagggactgtacagctatgctcatgcaaactccatgtgatttcatctggttgcaagagaaactactgcgacgaatcaaaaacaggtatcacaaaaaaaaatcaaattaaaaaaatattcatacaaataagattaccaaatagtaactttgagatatgcatgcatcacagcatcagtttgtttaagcatacaagtgtaacaagtccaagcattgtcagttatggggggatacatgacatggtttataatggaaatgggacataaaaaggatcatggaacatactttgatattcttgggtaagtaacttggatgaaaatatcagcaactcagtagcaccaatcttggttcgtaacccaatatgcgaagaaatatttttcaggagatggtcagaactcccatttggtctgcaaagaaaaagagagaaaacacataaatgcagataagcttcatgcacacagctgcattctgtagttgacaaaaagagattaaactccaaaagcactcgcatttatttttcagagataaattgttgaattggttttcaattgccggtaactgaaacgaatactccctccatcccaaaatatagcaaattttccacttacattctcctctcaaccaatcaaaaccttccacatttaatttctccacctacctccttttctcaacaaatcataacattcacccatttcattccacctacttccttaatacccgtgttcaaccccaaaacttcttatattttgggatggaggtagtacttgttaggatatgacagatgatgtggctgaacgcaccaaaaatcattggtgatacttctgaggttaatttctatcatgccactaaacatctgagaacttcctcattttataaataatgagttgggtccataccagcaggcccacatgccattgagacaagtgagaggaacaaaaggaaagtaagtagaagcattgatttgaggggttgtacctttgaagagagctaatgaagcacagtccaatatcttgtccttctggaggtttcatcttgaatgttttcggccacagatgagaaagaggtctagcctctagctttaatatttcaggcatttgttttgaagcctcatatacttgggcagaaatttcgaaagggaaatgggcttcaagtccatcacaaatatgtgttagctctccagtcacttcaaatttacccctaaagaacatggaaacagagcctcaatgtttaactgaaaatcaaacacacgtatactaaaatagcaaagtctcacagattttccattataacttaacttcagcattggataaaagttcaacacttccaaattgcataataattccaaaaacagaagcagcatcacttatcatacatgtgaaaattgttctgagatactatatagcttaccacattatcactggcacaaaaaagctcaagataattctgcagatactctgctaatcaactatatttgctgattagcttcatccataccagacaagattcaaggcttataatgcaagtgaaaaaaaaacaatgctcttttttagacaagaatgccaatttcatccattagtacatcaaatttgaggacaacttttgataactttgagtttgtaattgatcccaaaacaattttttatacaacacagtagctacagcttatccggtcagataaatatagggcatgtaactggtaaaatacagtgtgataaaaataaattctattgataattcaaaaatactctaatgcatgaagtaaattacttacttccagcaggcttctggttggtaatgcttcttgtgcagctttgtatgtaaaattactgggatacctgtttgcaccaataccaatgttactacagcagtgttctcaaaataagtttttcatcaataaatctccacaaggtaaaatggcatgcccatggctaaaacttagtaccgctgctttcacttttttcaccttttcaattttcaataagcataataattgaagggctaaatgcagggatgtctggatgctacagtactattaatgtcagctattttaaatatgtagatgaaagaatagaagagattactgtcaggatccacactgtacctgaagatacattacaattgattggtgcctcctggttcatttgtttttctgtaattatatggctcttagtagatggaactgcttcaaaatcatcaggcggttcaacacatcgtgcatgagatgtagactgtggactttgtgatggaggaatgattgtttcactttgcggtgagcccaccttgcattttgtatcaaataaatttggtctggaagaaggccttggagcagtatcaggatatgcctcgttggacttttcactaagcacagattttgggctcggtaatgcaggctccatggttagctttttttgcactgaaggcgccacagcagttcttgtgccttgacattgtaacgtgcccaacttacagctcataggggatgacttctcattgccaggcgcacaaaaactttcagcagaaggttctgcatttgtaccaggaggaactacagttgaatgtgcatgcgcagatgagaaggttctggtgcgtgaactgcaacttttgacatatgcttctctattacccgatctgctaagattcttgggagcagtggcatcagtaccaagaggtgtcccagaaggctgtgaaagaacagccctgcagaatggtgatggacgctgtgaaagataagctatttgtgttgtaaaggaatttgtgatatagcccccaacaagtgagtgaccatttccagctgtctcaggccacataggagagataggtgaggtagcaagtgagtgaatctttttaactgccccaggccagttaggagagataggtgaggtagcaagtgagtgaatctttttaactgccccaggacagttaggagagatacctgaggtagcaagtgagtgaccattttcagctttcccggtcaagtttggagagatacatgaggtaacgactgagtgaacatttttagctgtcccaggccggttaggagagatacgcgaggcagctggtgagactggtggtgtaggcctctgattaaccactgtaggtgtcacaagagacactttacgtgaactcggagggggggtgacacttcgtctgcgttgccttttctgtaatccatctgagccaacagttttaccacatagttttccatgacgtacatatgtaatttcttctgcaggaattatctttactcttgcatcaggttttgaatatgtaccaccagaagatttgtgcatcccatacttatttgaagagtttggctttgcaaatccctttgcctcaagcattgcatcattcgtatgatggatttcatgctttctgagatggcccaaaacagcaaaaaaatactactattaattataaaaccaataggactagaattaacacataaatattgcagaatctgtcatgtataaaaatgtgcacgacatttgaatacaatccaggtaacagaggattttatagtctgtcaagagcttgcacaagccaaaaaaatgtatgcatgcctcacataatgctgtaataacaaatatccacttttatgagaaataggatgccatacaaaataaggaagccagtagtctagtatatacacatgaatactcaatggtcaacagatatagatttttttttaaaaaaaaaaaaagcttcagccaatacaccttatcttatcgaaagtattatgctcagaatgacatcatctcattctaattttgcaacactgacttgatatcagatgtgaaatattttttttttgtgtgtagaaaatttacatgtatcaagttattaattggattatataaacttatatgcaactcaattaaattcaaatttacagcttctttctattgcccgattcctttgggtcattatgatccatatttgtgcatgtgcaagaaaaaataatactaaggggtctagtgaaagcctaataaataggtgcaatcacataaaacctcacatagccaataattacccgttggatgaaagatgaatgaatggctaccccggaccaggcggaagcagtgatattctaataattaaccatctatgaattgagtggctattaagaattttaccaccacatgaccctaaatccttgaaaattgt

SEQ ID NO: 61635 - DNA, 2343 bp, Oryza sativa
cggataatgaggcatggcattgataagtgaatggtttaccagtttacgatataaatagaacttttaagtttgtctttttgtgtaaatgtgcagtctctaagatgcttccatttagttactgtaactaacaatccgttctgttgtgagagtggtgtgctattggtgtctctgtacctgctgaaaggatgatagaaatgatacttgtgcatacttaaatcttcgttgaatttataagaaaataaaattgtggaacaagacaaatccttgtatgaatatgtatgctgatatgagctacgtcttctactttttccgtatatgaatatgtatgagttctaggttgtgatacactttcagttctgttctacatacatgcgagatcaatagttgtttcattgactaaggccctatttggaaaggatgggataaaatcctaaggactaggttcaaatcaattcaacatttggagttcctttattgcaggggattcagattgaaagcctcttggacgacaaggatgaagccagtagctcaccaccagaccagtgtgcagaagtagaggaatttagggctctactacgccagcaaaaagtactaaacactttgactgagcaggctctccgcaagagccaacctctagtgatatcaaacttaactcatgaaaaagctgaattattgactgccggagacctcaagggaacttctaagattgagcagctctgcctacaagttctttcaatgcgcatctgtcctggaggtgctactattgatttaccggttattgatagttcatctgcaaatgctgaggagaccaatcagttgaatgtgaagagtagtcctgctgctgcttcagctataccagatacagacctggcagaaattgtaagtaatcacttagtattcaatggtaatgtgttgattggatatgccattttcttatacatattgttcaattccaatgcaggttaaggtgataggatcatgccgtgatggtatcaataagctggttgagtcactgcatcagaaattcccgaatgtgtcaaagtcacaactgaaaaataaagtgagggagatttctgaatttgttgataatcgttggcaggtaagatactttcacattcaagaacgccataccaacaatgtttgcttttgtgctagtgttatttacagcagcgcattatgagagatgaaatatacttggaatgctctattaagttattttttcttatctctgcaggtcaagaaagaggttcttagcaagctaggcttaagttcatctcctggtactgtacctcatattcatttgtcagtaggaatcttgcccccattgtcatcttctgaaacccttctaacaataagtcttgtttttttcagcgagttccaaaaagcccaagagcatagcgacatacttctccaagcggtgtctacctccggaggaggccatcctggcttcacctgagctgcgcctgaagtcgaaaaccactcaaaacgtcaatggtgacactgatattcctcgaatcaatctgctcccctcgtcccagtaggatcctggaagcatcttcagtacacccagattagcagatacctgagcaacaatggtctgcagcagcaaggttactgcattgcaactccattttgcaacatttccctgacgaaagagctagaaatgtgttctataacttgtgatggatgctctttttgttgcgttcgccctctgccgtttgacatgtatttatctggcagtgatggtgattaaatgtctgtcaaactactgaatcatctgggttttttttgttactacaacttacaaatggattccaagcaagaatgtgaatggttgaggagcagcagcatagcatcatagcaaacgctttaaagcaatatatatttgctttgcatcttagtacaaaagaattcgagtacacatgaaaatatcactagtacaaaagaatcatgagagtaattctactaataatctaaacaacacacgaagaatggactcttcggtcgcaccaatggcggagtggagtggaggaggtgatgagggcttcagagtttcagacatggtaggaggcggcggcccagttcttgttgtcgtagtcgccggcgccgtcgtcgtcgtcgaggcggaaggagaaggcgagggcgagcgcggcccactcgaggacaaagatggcggtgccgaggccgccgaccatcttgaggatgacggcggcgtcgtcttcgcggacgtaggactggagctcggcgaggaagtcggaggtgcgggtgaaggcgagcagcgcgacggcgccctggaagatggcggtgagggccgcgcccgcggtgtgggcgttgtgccactgc

SEQ ID NO: 61636 - DNA, 61644 bp, Oryza sativa
  unsure (1)..(61644): unsure at all n locations
ctgcacttctctctctctcctcgtcctacaggctacagctgctgcctattgatgacacacctctactgcaatggcggagccgtagaaggctcgatgccatgtggaccccctcgtctccgggaccccacttgcagcgagacgagtggccgctttgtaagcaagccgctgcgtgcgcgtaggctaagccgcacggggacaccactaatggcagtaataattgcgtatttttgttaatgagcgctgcacctcgcggggcccatcggtctcactgacccgctctctcctttttcctttccgtcgcggcaaaagtgaggcggcgtcgacgcgagttgagacttgagacgcccaaaaaatcctcaaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctccgtatgtcccctcctcctccctgatcgcgcgcatatatgctttttcttttttctttcgcttcctacctgttcttttgttctggaggtgaaaaaaaaaagcagaagagggaaaaagacgtttttatggccgggggaaaagtaaagatggatctgtaggatagtgcaatctgtaatgtcgcaagcagtagtagtagatctgtggattgatgtcgtgaatggatctggtgcttgggttttcctgctcgaatttcgtgtttgagagatcatggttttgtccgtttcacatctgctgacttggtaaaagaggatcatgagaaaagtcggcttttgattaatcagttaggagtagtcgtgcttgttcaggcaaagatttgcgtcagtctgacaatcgttctggttatctcgctttgcgattttacagcttggcaactactcctcgattgaaggagtgccatactgcaagccccatttcgagcaactgttcaaggagaccgggagctacaacaagagcttccaatcacgtaggctactattgaattccaaaattgcgaacattgacaacctgtttattttgttgataaaatgtgttatgaattctgatgctctggccctgcttatttgttcaattttatgcagccgcgaaacccgcatcggagaagttgactcctgagctggtgagtgccattggctgcatgcattgcttgtctgttttcattccaaagtacttctatgtttctatgtgatgctacctcgcttttcaactaattttgtctgaaacattcatttcagacaagatcacctagcaaagccgcacgcatgttttcagggacacaggagaagtgtgccacttgcagtaaaacagcgtatcctctagagaaggtaatgccccataatttctgctcttttcatcttagtttcatactgtagtgttgttaggtcatttcttccaaaattgcattgttagatgttgaaatagggatgaatgatcagagggatcttttaggtacattattccgcctaattgtattgttctactgtaacaagttgtaaggttctgccttgattgtacttatttaccaagaatttatttcaattatgctcctcaagtctttggaacatgcagtggttgtgatgataagcttttatttgcaggtgacagttgaaggacaggcctaccacaagtcctgcttcaaatgttctcacggtggctgtgccatttcgccatccaattatgcagctttggaaggtatcctatactgcaagcaccatttctcccaacttttcaaggagaaagggagctacaaccatctgatcaaatgcgcatcagtcaagcgcgccgaagcacagccggcaccaccaccggccgctgcagattcctcctgaatgtaccatatctccagtgaggcttgagggcgaaaattcggaagccctctgttttacaacctgcttgtatgccatgttccagttctgaggataccgggacctatcaatttcgtgtcctctgctgtgctagactcgatcacattggtgaaccatgaatatcatgtccctttcaaagaaatcgttgtgcaagtactgatataccgtactctattttgttgattgctttttgagcgtgtgtttatctgttcagtcgtcttgctctcttttttttttttttggggggggggggggtgggggtggatttttcataaaattggtatgcggcactaacgatcatgatagcgtcgaaagaacacgattcggtttattagccccgaaaattatctccatttttctttttaacattttggcggctgtcatgcaaaattgcgcaggaaattagactagttagtttaatatcaaaattggccacatttgagtattactttttgttccccgactgcatggtaaaaagaaagatataaatatacagaaatacttctgaaaatctactgacatgattttcattttttttccatacgttaacacacgaagtttaagaacctctcttaactgctagcgttccaaagcaagaaaaggacaaaccgcattttaaaacaaactccatgttattttcaaggaccaattaatttgcatatgtgagtgcattcgatgatcatgtttacgctacctccaattttgttgaaatgtgtgatagtagcttaaggaggtagcaggacccaaagtgggtgtgcgtatccacaagtgcgtgtaattgtgttcaccttgtactaggggaaaaaaaaagaagagcaagacggtatggggtaaactgagaagaaaaaacggagaaaacctctatttcttaaaatccctttctcaactcattttactcacgtccatgctcaccacaaagaaatgaattcgcagtcaaacatcactaaaataggtaatgctccgcaagttcatccactacacctacggaaaaaaaaaatgtggtgcccaaatgcccaataatacaaactgttcccctcccgtttctttggctgtcctgttccatgctctttgccgagccagaacaaaacacaattgagcaagccaaccatggaaagctcagcacattaaggcaggtcaagatggaacctgcacctcatgtacctacgctgtaagtcagcttgtgcttgcggtggttctccaattttcccctgcataaacaccgtcacttccaagttcttcctctattctaagcagctgcagagaagatgagcacgataatcagaaaccatcccatcgacaacaaaaggctattgtactatgacttatcaatttctatagcagatgccggtgtgcaaatatgtgaatggtaatggtatatttcaaaaccataaaagttgctctggcatgaatctaactaacccaaaaaacaaacctgattgtatttactgagacattctccacggcaaggagcacccgctttgatctgtccagcagcagcaccaacagccaagtcagcaatgaaagaatcatcagtgtccccggacctatgtgacaccattacgccccaatgagcatcctttgcctgtctcacaacctctatggcttccgtgacagtgcctacttgattagcctgcatatcatacacaagcacaattcaggtatatactaaatgacctttgaggttgagagagaaatcagtgatcaaggaagattccagaaaataaatacttcatacttcatttgcatgcaaatatcgtttgcacctctatgtctacaacatgctaaaagttaaaaagtaaattcctccagtggatagttaatcttgaattattatcatattaatttatgtaaatgcctattcaagtactaaatgccaaacgtgtgaattgactatttgtatgctagcctattaacgattggttttcattgcattgtttgtaaatgccttagaaatcaactcatatgacacaaaacttgaactataatcaacactggaatggcagtgtcacttaaataagattcaaagggagcactgagcgtcccggcacaaagatgacaacaactattaatatagtaatattaattccaaatctttctttcagatggtattaatcttggatagttccaataatacgagtaagatgttgcacaaagtagctctaatcagtttcggtgcattaaaaatagaagtataacttatacttcaccttgagaacaagagcattgcaggtatactcatttactgcccgcttaatgcgttcgggatctgacatcaataagtcatcacctacaacctgaacaaatgttatgtcatgagatactgaacaagaagaataaaagctcaaaagaacatattagccacctggcacagctctagggtggtaaacttcttcgaatgctcccagtcatctttatcaaagggctgttcgattgagacaagtgggtactctagcgtataataaagaaaaggggaaatataagcctcatgaatgaaatcaaaagatgtaacaaaaagattttaatccagacatgtgatacctgaacaaagctggctataaatctcaatcaaatcatctgcagttttgaagccctgccctgatttctctgcaaacttgaactccatgtcatacttatttcctgcacaaaatgcatgaatatagccagaaatttaggtcatcgatatatcaaaacaaactaaccatagcatacaacacattctaattgctgttcaagttctctgcttctatggttcaaagttgtacggttaatataagccattaggttgacggctgaccagcaatactgaatggcataattccactgatgacacaaagaagaatgaatactaggtggccatgaaaaatagtactccctccgtcccaaaatataacaatttttaccacttaggatttgttccaaaatataacaacttctccaccaacattcccttcccaaccaatcacaaccccttcctattcaattttacctactttcttaataaccgtgcccaactctaaaactctctatattctgggatagagggagtaaaatcaagagatgacacaagaagagtgaacagaaatgccataggtacataagctgaaaaacatggaaataatgaaaaatgagttatcaacagagtcatggattttctcaaataataaggaactctttctttaatgcatgagagatcagcagagagcttgtattcgatcaatcagatatcattcacatgattctttatttgatcaagggaactgcatattaaacaatcacacaaccaatacccaagaaatcactctttctatccttacccatgcaaaaatcggtagcggcgacatcaattgctagcttgatccttccattatatccagctctatttattgcctcaatgacaagatccaagccttcggttatgctgaacattgacccaacggatacggcacattgatatcaatatgcaggtgaccaaaagggaaacaataatagaaccacaaaaaggtacagacgattccttacttgcctggaaatatttggagcaaatccaccatcatcacctatgttgcagctgtttgaaccatatttctccaagatgatatcctatcaaatcaattggtaagaagctattcacgaagatagtaagcttctcttcgcactataaaaacaaaattttggaacatctgaaagaataaatttatctaaggaggaatccacccaaacaaattaacactaatcagagtggacagaaagctgaaaagggcatcaaaagcagaatacaatgccagttaagttttgtggacagaatcttaaactatttgaataacaggttggtcaacatatcagagtggagcagatgcatgccatgggaaggtaggcccagcatgcaagttatagtagtctagtgatagtaccttcagatgatgatatgtctcagaacccatctgcattgcttcttcaaagtttttggcaccaacaggaaggatcataatttcctataaagaagcaactttacttgcaggtctcaaaaaaaatatatgacaacatagcaagatgttgatctacctggactatcttaacatgttcccagagaaaaagaaaacttcaaacaatgaaagaaacatgggaataacaaatttaaactttgcagatttcttaatggaatctgcagaaaagagtgatccagtaatttgcagagaaatgttggctaagaaaggtaattctacaggtttagtgagaatacttgaatagggagactgtttccagcatgtgttcctccattaatgactgtaattgcagggatgggaagtgtcgtagcgcttttcccaacaagttctgctatatgcttgtacaatggaacctgcacagaaataagcaaccaactataagaatgcattgccatatccaacaccttcttttaacccagaaccgtggtgattttatacagaactattacctctttttcagcagcacctgctttacaagctgcaattgatacagccaacatagaattcactccaatctcagcctacatgatgcagtgtcaatagttattaaagcaggacaattacaagcgatagaagctgtactgagctggctgctacaaagttaggcttgacagtaaagtgagatggtagtaaagaggagtagacattaaaaaaaaattatagaaaacaacacatcaattattttcatcattaaatctacatggaacaaaccaatgttaagaactgtcatgtggctgattatacagatcgatcgactgtttgtggtaaagcacaacccttgaataatctctcattataactctcatcaaatagagctcagcaatgtaggatcaggttaattccatagagtgagaagagatatcgattggggttttagggatttaccttgtgatgcgccttgtccaagtccatgatggcctggtcgatctgcgactgctgctgcggatccattcccacaagcgcctccgacaccttgtcgttgatcacccgcaccgcatcggcgaccgccctggcgagcagcttccgcttctcggcgtccctgacggcgtcggcggcggcgccctcgggggcgtccgcggcggccgcggaggcgcggtgcacggccttgttggtgtggaggctgacctccacggcgggctccccgcggccgtcgaggatctggcgcgcccgcacgctcgtgatcacggccggcgccgcccggcgcatgtggttggagatgaagagcaccgggtcgggggccttggcgcggaccgccgcgttcacggcctcctcgatcttgcgcgacagcaggtgcttctccaggtactcctgcaccgacatggctgaggctgcggcggtggcggcggcgtcccgcgctgctcctcctctcgccacgcttcccccctctctctggctctctcctcccgcgccctctgcctctgctcgtcggctcgtcgcctccagctgccgggatcgctaggccgtggacattggccgaactcgaggaaggggaggctcgagacgagaagtcgagagtcctcggaccagtgcgtgcgtttgggtaggcgtgggccagtttcacgatgggccggagcccatttgtgtaagcttgtaccatgggctgagtacacactgtgtctatgggccactgactaggagaagcccagcccggtggtcatttccttcccattgtcttcaaggaaaaaaatcggatcaagcactccaattttggactggaagttgctggatatctcgagtttggaagcagagaattaactgcacttgagtcagtcactgatatgtgggccccattttactatggcccacatatcagtgactcaactacacagcagttaagtcagagcatcctttccctcgagtttgttctggacgattcgggtcgtgctggtaacctgaactgttccgttcgtaatctaccgagcccagaaccaagtccagcattttcgagtctatccaggaatagaagagaactatcgagaagctgctttcctctccatccttatcattcccccgccgcatataagaacgccatcccctcctcgacagatatccaagcaaagcgagaaaagaagccagcaatcgaaagcccaagcttccaaaaatccgcttccaattcgcgaaactacactagtcgtaagcgccaaatccaaccgacgatgtcgctgatccgccgcagcaacgtgttcgaccccttctccctcgacctctgggaccccttcgacggcttccccttcggctccggcggcagcagcagcggcagcatcttcccgtccttcccgcgcggcgcctcctccgagaccgcggccttcgccggcgcgcggatcgactggaaggagacgcccgaggcgcacgtgttcaaggcggacgtgccggggctgaagaaggaggaggtcaaggtggaggtggacgacggcaacatcctgcagatcagcggcgagcgcaacaaggagcaggaggagaagacggaccagtggcaccgcgtggagcgcagcagcggcaagttcctccgcaggttccgcctccccgacaacgccaagccggagcagatcaaggcgtccatggagaacggcgtgctcaccgtcacggttcccaaggaggaggccaagaagcccgacgtcaagtccatccagatctccggctaggcatcgccggcgtgccgcgtgcgcgacggagaggagcacggcggggttttcgctttggcctggtttgtctgtcgtgaaggagcaaataaaatcgggtccggttgagtccagtgtgtgtccgtgtctgtcttgaacagtcgtgtgtcgcgtcgtgtcactgggtcagtgtgttgttccagtgcgccgttcatcagccgatcagcgtctgtaccggtcttttgcaactagttaagtgatgaatactataatctgttaatacgtgatctgtctgatgcattctgtgctttaatttgattgagtttgggtattactacctgacaagattagaaaccatacaagcacctttcgaatttcgtaactctcactggcggatttaacccctctagccgccaatgctcgttgccgaaaacctaaagtttttttatatgttttcaatgattgaagagtttttctttagcaatatatagaattctgttttttttcaatgatttaaaaatagtttttctttagtaaatgctctatatagctagaggctaggtttgggttggactttttctgtatctatctaagattatggtagcttgcagtgactttagaatattactctctctgttccttaatatagggcgtggctgttgtagttgcaaagaccaataaaaccgtttaaatatcagttacgctgattaattctctctgttcgaagagcgacgtttaggtagttgcgcggtagatacgctagcattaaccatcatgcagcgtgcgctcgacctgtactttccgcgcgaatagccagcatgcatgcagatgcatttttgctagcgtgctttgctcgcctggcataacgccatgtatggattgttttgattcaaaaatttggaaagccccatgcatgcatgcttgatcgaaaatttggatggcgccatcagcgataaaaaatgaatagaaaattttcacttggcgccactatttgccagcaaaattttctcctataaatatgggcaatgcaccacacatttttttccatctctcttctttcctcccatggttcaacgtacgtaatggctggttttgatctaaatctacccatcatcaattgggacgaagttgaggatttcgatggagatatatctgatttgaactatgactttgtttgggattatgacaatgaaggtgttcataggagcttcttctcttgctttgtcttcttttttttcttgtgcatgtgtgactataattttgtttcaacgcacagatggtgaagatggcaatggccgcggcagtggcaacgacggtggctgcgacggcagcgacgacgatggcggcggcagcggcggcggcggcgatgacgacggtggtggcgacgacggcggcggtggcggcgatcaaaccaccgatggagcagtcgatgcaggtaatacacgttcattttctttttgttgctgtgtctttttgctgcacgagttgaaggcctttgcatgtacacatgcacagtgccatgcttaagcaaactagccgatgcatgccaaccatagtatagcctgcacgttctcagccatcatccaccatgcatgtgtaggtatcaatatcaagaggaggagacactaccctcctgatatgaaacgagccatatatgcattgtgtttggagagatcggatcctggtatgatgaaggagggagtgacaaagtcagttgctactgatatgggggttccatggagagttgttcagcatgtatggcgacatggacaaattggaggtggaattgaagctttcgaatcgaagaagaagaataactgtggccgcaagaaactttcttttaaccctgatgccatcaaagatgtaccgcttaggcaacgccgaacactccgtgacctagctaacgctttgcatatgtcaaaaaccacattgtttaggcgtttgaaggaaggaaggtttaggcgccatacaaatgccataaagttcaccttgaccgaagataacatgaaggcctgtgtgcaattttgcatacaaatgcttgatagccaaagcataccggacgagccaactttcaaatctttgtacaacattgtgtatatagatgagaaatggttttataggacaaagccggacgaaaattattacttgtcacttgatgaaccgaaccctcgaagaaatgtgaagagcaaaaatttcattgataaggttatgtttctagcagcgaaagcccgtccaaggtttgatgagtatggcgaatgtacatttgatggaaaaattgggatttttcccttcacttactgggaggcagccaagaggagtagtcgcagtagggagaggggtaagttgtttaattatgcttagttactccacatatgacaactctactaattttgtttaattgcatgatttaatacaggaaccatggagctcaaggccatgacatctgtcacgagggacattatccggaactatctcattgaaaaggttttgccggccatcaaacataaatggcctaatgaggaacgaggacttccaatattcatccaacaagacaatgcaaagacccatattgcagttgatgatcctgcatttttaagtgttgcacaagaagatgggtgggatatacgacttacatgtcaaccaccaaactctccagatcttaatgttttggatttaggtttttttgcagcattgcagtcattgtttcagaagtcatctccatcaaacatcgaagaaattgagacaaatgtgatcaaagcatatgaagaatatccggcgaatagatcgaatcatgtgtttcttactctacaagggtgcatgagagagattatgcttgcaaaagaagggcagcactatgcaatcccgcatatgaagaagagatcattagagagaaatggtcaacttccaataaggttgcaatgtgataagcaaatttatctagatgcggtagatttcatcaatacatagttaggatatttctcttgtaactttgcatcgttcaacaattagcaagaaaaagaggagtattcatgtttgtttttctctgatcttcacgaaaaagacattgcattaaattgaatagaacaatcaagtgcatacacattagctaaaccatctagcaatgacaacaagcagcaacattggcactgattatacctctagtgaatcagttgtttttttcctcggcgttagtctcctctagtgaatctgcaacaaatgtgttgttggccagtgagtcaacaacgtacccaatgttgtcagagtcagtgaaacgatcggcgccggccagtgagtcgaccacgctgccctctcggattccggcatcccctgccttctctccgttgtcacccttgccgtcgtcggtgttgcaacagcgaacgagctctgcttgcgctcgcagccgcatgcgaagggcatgcacacggagcgtacgagcatgagcgatatccatctgcgcctcctgccgcatgcggacggcggcgtcgcggagcactcggacacggccaagctccacttgagcacgacgtcgcatgagcacggcgtggagacgaagtgatcgcgcgcggccgaactccacctgcgcctgctgccgcatgagtcgtgtagatgcaatcttctcctctgtcgtcgccatcgtcggcatatgaagtgtgagcagtgtcacagaggggcggtgtgtgcagtgagagagagagaggaagcagtgagagcgagagagagagaggggccaggagctgagctttttaaaagccaaaccgagtcatcagttaattctctgcatgcatctgcatgcatcagtacaggagccgaggagtactcatcaattcctgcatgcaccgaggagttgccaccctatattatggaatccaattgaaaagaagttacgccctatattaaggaacggagggagtacgactgtagtataaatggatgcttaacaaggttagaattgcctaaatatagtctctgatgatcattttctatgtttttaagataaacggttaaaatagaagcagaaactaggagtgtttatgctagagctccagtttacacgttggttaaaaaatgtaaataaatagtacgagtgcaaaatgtaaacaaagtctctacttttggttaaaaaaagtatgagttcttatgcagggacttcagtttacaggtttttatatatataaaaaaaaccaacgagacaatgaccacacctcaattagggatagtacagtcaaaaagataaacatgaagtgtagtaaattcaacacctaaatacactaagctatcaggcggtcaggcctaaagcaaagataacaaaagtactagagagtactgtagggatgtcagcccactcttcatgatttcagccatcagggcctttaggagctgttgttaagtatgatgcagaaggttcctccgttgtagaagaaatcacgagaggtgttcataattttgttcctaaaaatcatatcattcctaacattggaaaggtcccaacaagccttcgcaagtaaacctaatatttgctttttcaataatttaacatccccaatgtttggcttagttgtgaaataagtcaaacatcatattgcaaaccagaagtaatttgttaataaaacttttatatacgtgttcttagcgacttaaaagcgaaggccgaaaaatatagtccgatattaaaaaaaaaacctaaaatcagcttcaaatttaaaattaaaaaaagaatcaaattttgactgataagtataagtatagatgaaaagatgagacgttttcctttaataactacttaatatagttagaattgtctgggctattttttttatctaccaactctgtgtttattacttgtgcatttaaaacccacacagaaaagccctcacaatgtggcactagttttagttaacttgtttcactgatgaattagcaaagcttagttaacaaaaactaagcccctaagcaagtacgctcatcgactcattatctagtaaccctacgcacatgagtgtttagttgagtgataaactttgtcatgcttggaccattcctttgactagtattcggctacaactgtagtgtgtcacactttcttttaaaagaaaggtcttgttcgatagccctaaactatagcgttttttgctgtgcaggactgtgctgcacagcccagccgaacggctacattcggcaatctgctgtatcatgtgaagctcaaccgaattgctacagccggccatctgttgtatcatgtgaagcgtgtcccaccgcaattggccaacagttataactgttatttgcagtgctgcagctgctaggcctaccgaacatgttgaaattaggcccacttgttattggtggttactaacaattattttaaggattatatttgaaacaataggaagtaatgtatacaaatattatatttatggtgtgccatatttttaaaagaaattaggcccactctctcctaggtggttgctaataattatttcaaggatattatttgaaaacataggaattaatgtatataaatattttatttgtcaaacaggtacactcatttagccaatatcataaaaggaatgttatacatgcgtcattatttacaacaaattccaaaatgatacctagtgggaatatgtgctaagggccaacatattataaaaagggccccattgccctcttcccctcatccaactccatcgccctggcgtgcaaccaagttgcatattccccttgctctccttgtcatccctctcaataaggcaacgccggatgtagatctagaagcggaggacctcaattgagcgcaagctattctagatctgaacaacgtaagtactctatttggtttttatcttctccttctccctctgtgttgtagtggatctagatctagggttcgttctatttggtgacattatccttcctcatggtgacgcaccctaatctaagggagcatcacaagtgaaatggtgtgtgctaaacaacacgatggtcgtcggttggtgatagtgaaatcgatgatgacaaaggtggggaagactaagagaggttttgtaggtgggttaaattgcatgttttgtctatttgatttatgcaatgcaagtagacaaccatttgaatgttaatttcacccccaagtgcttttgggtagttccggttgttagtcctcttcggaccatcctggtcattttgcacaacagtataagtgagccttttctattatacgtgtattcgttaatcttcaagtgcgctatttgattcaaaattgttacacccccaaatcgtttaggttcgatttcaaacatccttttgaaatagcacaaaaaaattgctactaatgcacatatgcctaagtaattacacattaccttttgctttaaaaaaactttacatttgagtcatttgagtcagactttaaccttttccattcagccttgagtgctgatggttatggcggactagtagccatagaccatagctgaccaatacatgcaagatatttctagctatacggaggatagacatccgaattatccattcactcgatatttcaagtataatatatagtttatatttaaacttatgttagggaacaaaccaaaatgctcaagtgcccgattcacgaaaatattattcgtagtggttgtgtgtggatcatgagttcatcacctatttgccattctttgtgatctctgaaagcttgagccaccatggccttatgcggctgtgatctcatccctcgtgtgaccccttatgctcttgcagtctagcccagtgcgtcgcttgccaatcctcaagcttcattgaatgcaaaagagggctttgtgaactccaaagttgtgcttcctccacgcctttaattctccaaacacaacttccatatggttggtggcaccacagagtgattggttttgtgcatcgcacatatggctgtggcatagtgttgacaaaaaaaaatcgaacacactggcctgggagatctgcttagctcctgtacaggtctaaaaattgatgagatgtgggcgtgccagtcagtttgatcctgcaactgacaagatatgcaaatagtagatcaaaacagccgatcaactgacaagccgatggagtagttccagccgatagccgataacagccgatgccgataccagccgatagagatagggtttaagcaatcggctatatgtccaatgtagataatgatataaaggcaatcggctgatgatgctataataaaataacaatatagtcatgtataaaccaatcggttagcaatgatatgataaataagcatcgatccgagggttaaagcacacatcggctggaggtccgatatcatgaaatccataagattagattaaacagtgaaacctttgttgtcatcggctaaatccaacttatatgtatatgcaatccttatgagccgatgcaacatccagataactcaccagctgaaaccccgatgaaacccttattggcaatcaagaggcaggctagagattatggttctaagcacgacttagtagatcaaacttaactgatacaacactaagtatgaaaagaaacacaatatctagacaatcaagccgatgactgattttcagggtggtagatgtctaagctaaactaatctagcaatgcgatttagccaataccggcagaaaccctaaaacgagaagcagccgatagagctaaattgatatgctaagactatattaacagagacatatgataaataggtaggcaaatatatcattcaaaccagatcaatccaagaggtcgaatgtactgatgcagccttgaatgacgccgacgtagacgatacaattgcctggaccgacggaacattggacttatcccttcgccagagatcgaagacgatgcagcctcgcgtcgggtgccaagtttcgccggaacgtaaaaacaaaagtagaaataaaaagggtggcgatgcgccgaattgtattgatcgtggagatagattacatagaccccgggtgtacatatttatacccataggttgatacaattccttgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaattcgactattggcgacttgataactcccatcagctgattccgagatgctgcaaccgataatgattctaagccgatgacgtctttgccgattaccaaattttactgttaacacatagggctccttgtgtcgtgtgtgcatgtctctcatcagctctgagctatgcggtgataatgttgccttgctactgcgcggccacttaacaaccataggccggtctcatcccacaacatgcttgatggattgggtggccaggtgtacaccggggtactggcccctacaacttatatctgaaaatctagtaagtgggtccggggtctagtttctggtcactttcacttatagttgaaaatctagtaaaaaaaatgttgtcacctctatagcttattctaaatgattccatgagcatccttgagaaaatgttaactttggagctccgatcagataacgactttcactgcactatgttgttgcattttctactggtttccttactcctccgacccttaagtgtttactaaatgtttatgcagttgaagcaactatggtggagaatcatgtgtcaaaagaggattcaaagaattataaattgaggatgggctttgtggtaaaaaaaatccatcttcttaaatatccttgttgtggtacttgtcgttagtttccggacaaataaaaaggcatatgttagaagaaaaataatattttgtttgagccttgatcagatatagatctggtgttttatgacgcgattagttgattcctacctttagttgcacgaaagagttagcttgccgattttgcatatagaatcttctccgtggcatatcagctctaaattgtaaatctattttcatccaatataacaaaacttacattctttatgcaggatggccatatttgtgcaatttgtgatgatggtggtaatttgatacggtatgcctattctttgtctagttatcctatttctttttcatatatttgtttagttgtactattttttcccctttgttattgttctcttatttaaggcactaaaccgatagtgtggattgtacttgatagggtgatggataaaattaatactagagttgttttactgtctaaggcattgtagtttaggctcactggacaatggattggaacatagttgataggatgatgggtattagatttgtgtttgagacgatgtcctcatatagattgaagacattcaaccttgagttttccagatcacactgagtaggttttggcaaattttcccttctatttactctcttgatcaacacacgtgttcctgtttttgttgtcatgttactgttatattttcaagagccttaccattcgctgagaaaacaatacttatagatgttattattgtaaatattgaaattctgaaattaaaatcataagaaagtatttttaaatataaatccattgatgccacttgtatggtgctgaacatagatattggaagcttaactttttttttgtcaaaaataacaaatgttgatatttctgaatacacgtgtgccctatatttccaacagcgggagtaatatcaaaaatcataaagttattgggttttataaagtatcataatgtaaaattactggtgaaagtttttaaagtttaaccgaatcttgttctgaacgccaaatatttatgaccggagcgagtactaggtagacaattttcccatatgccataattcttgtagattttggctgcaaaaggctcaaggtttttgctttttattgtactaaaactatcagggtaaagcgctttatgcgttcaatttattttaatattatgatacttgattattgtagctgtgagggtgcctgtcgaaggtatttccaccgaaccatttccaatgatgcagattttaactgtgaaactctcaacatgagtcaagaacaagtggtaagtgcatattcctttgcctcttcaacttattcttgtttaagtattccagtattgccatttaccattaatatttttcaacaatataggaatcatcaaagttcatatgcaagaactgtgtgtataagcaacaccaatgctttggttgtggagagttgggatcctctgacatgtcatcgggttcagctgaggtatgtataagaaaaagaaactttgtatgtccttgggatacttcctcttgtatttggtatttccttgatttatcattttgtttttcaattttcttatggaattgaattaaggcactgcttgaaagcaatttttagggatggctaggagtcaatgataactttgaggaatctgagagcgatactttggaattgtatacacattaaagttcaagaactttttttttgtatgtgctcgtcagcataaaccaatttcctttaaattccaacttttccttcactttttgttaggtatatcagtgcagtaagagcagatgcagacgcttttaccatcctaagtgtcttgctgaatttgactctagtaagaacccaccagtttttgaatgccccctgcatgaatgctttgcatgcaagaacaaaggggaaaaatataacgaggaaacatgcaagaacaaggggcaggagagtatcaagaaaaaacaaggggcggaaaacaacaagaaaatgcacctggcattatgcaggcgatgtccaatagcataccatcgcaagtgcttgcccaggtgtgatatgtatttggcactatttgctagtgatagtgcccttctaaaaggatattttgttgacacggtgttctcttttttaggaatatttcctctgttcccaaaggttgtcttccaaggaaatggaaaactaataagggccaagttttcttctattgcctgtaagctttttgcacttcatcctttttgttagcatatgttctccatctccactatattcgtggaacttattattcacatagaactttttcagaaagcatacgatggtagaacatctcagaagtgcaacaagggatcacctcaaatttccaaaagttatggaagagcacatgcagaagtatgttcccaaaagagaagttgaaaacaaaaaacttattgtttatgttaggaaacgacatagaggtgcatctaagaaacaaggagcttccatggtggaagaagttgatcatgggaccatggaaagtgatcatgttcagagaagtagagatattaatctgcgagcacatgaacaaaccgaagcacctcgaaactatatgtctgaccgtaacacaagcactggtttcgtgttgtcttttgcacctaagtccttgttcccactcccatatccaggcaattgtggttggcttgatgattgattcatgatagtatttcagaaagaaaactgaagatttttaagtttcatgtatggcagataactttgtctgtagcatgtaacaccgttgtgttgatgttcgtgatggtagttaattactggtgactgttgagtataaatgtctggatactgtggcagcgacattccttccattgtcaggaatgaggatatattaagtactattatcactgtatgaaatgtttttcgcgaacgcctgtatgaaatgttattaaaatgcttctgttcatacctaggtgaaacaatgcactaatgtgtaatgcaggtatgtaactctctgttgggcagctttgctctggcctctgagactgggagtgtggctgtttccctacaatggtgaatcggtgatgcaggtcacagccttgcatcttgccgatttgtccagctcatttgaggtgacggatatggtggattttgctgtgtgttcattgtttatgcagtactggttcctccaattattttcataattttcttttctgttacgggccggcggaagctgccgtgaccgtggatagcttgatttccagtggacaagggagtataggtggactgtcaattgcaagtttgccagtgggaaactccagtaactaatgcatgcctcagaaagcattcagttgagatggcatgatgaaattattattttttgcaaactagatgaggagatgacgtgatagcctatttaagcgaaagcgatcgggttgtagtccacattacgcagaagcagcagtaaaaaaacagtgtctacctccgtcagccggaataatggccagcaacagggaagttctacaggtggtaacatgctgtgacggtgtatctaattgggtttatattctaagtttgacactgatgtctgctaattttagaaaggaatacacgtgggcacgtcttggtggttacatggatgctcatactctagcgggtgtttgatacgtttgacggtattcatgtatgcgaacgacacacatacttaaaaaaatttccctcttagaaaaagaaaagaattgtctgaagaggattagataagtcataaaccgcggtgaagtggcagcttgacccactagcaatcgcgcacagccgcacggttgttatcatcaaagattcaaagctgaagccttcaaccagggcaatctccattttccactcccggccgggtcggagtcgcgcgacgacgccaccaaggcaccaactccacgtctccgccccttccggttaattcgctcctacgcgcacccacaccaccaccacgccatggcgtgggagtaacgcgcgcccgctccacaccaccgacccgtggcaacgtttctcatctggcatccggctgtcacgttttcccgttcgctacagcccgcaaactcggggtttccccgtcacgccagccgcccaagcacaactgcacagcagcggggactccgccggtgtgcgccgacgcgagccgcatcaaccagttaccgccacccgcgcggcaacggcagcggccgcggcagcgaatcggggccagggcaagggccaatccatcctcaccaaccgcaccaccaccaccaccaccaccaccgcaaccgaacaaaactcggggaggccgcagaataaaggcgaggaggcagtataccggcgcggctggcctagtgtagtgcgcgctgtactgttcccacgtcgcgtcgaggcatcggttcgagcgagcgcgcgcgcgacgcgggcgaggctccggctcgattccgtcgccaccctgtgacagcagcagccaccgcccaccgccgccgccgctttctggaggcttcccgttggctcgtggttgcggggggactcgcggagtcgcggttgcgagttggctgcctgctactctgctagtgtgctaagcctgccttttagttagtctgggagcacgctactgctactttccccaatccaatccaatccaatccaatcctcgccggcgttggttcgctcgatcggcgcggcgcggatggagacgctcaggaagcaggccagcaagctcagggagcacgtcgccaagcagcagcaggtacgggttcctttgcccaattccagtggctccgtctccccactatgccaccaccaccgatcagcgcgtggcccgatgcgcggctaaaaaaccggaatttgggagtgcggggagctgcgtggtcgggttactggagttcttgtttgctccccgcagttaattccgcatacctagtggtaggaatcagggtagggagtggcgagtgcttgggttgggatagcagcaggccagcagttggtggaaggagctgaacatgaactgctcatttgctgcgcatttctgtatatcagatgatttgttccgaagcttgagtttcacttgttccagtagatgtgcttgtttggtaactaataacagaattccttgtgattacaggctgttcggaagcagttcagtgcacgctataaccaggatccttctcttgtcgatgaggcggaacttgagtgccaccagaatcttcagaggctatacaacagtacaagagctgctaaagtatgtgctccaactgtttgttatatgtgatataagaaagttgtctagctcatgatgtaaaagttattgggcatatgtctcattgtatagcatttccaacgaagtattgtacgaggtgtcgagggtttcattgctgtcagcaccaaacagatggagattggtaactgttaccatggaatatctgttcaacatccttccaaattttataatttttgtgtgatcacgttgcgatgtttcttcctgtagtgaaaaagctagctgaggattgttgcagatatggaaacgacaatcaaaattttggttttattcttgcaagggcttcagttgagtttggtaattcccatagccaaatggagaaagagcgggagaatcttcttaaatttcttggagagcaggtgctgtcatattatcattttcctctctttcttaagttttcagaaccaagcaaaaacaaatacattgcaacatgcaacggatatttaaataaatatatcataaattgtatactcaaaaagctttatataaatcctagaggaaaacatatataatctgcaagcacacatcaatccctaaatagcatcattataagcaacatgcacttattttctaaaaaaacacatgcacagatgttatgcttatcctcaaaacatcccactaactcaagatgtggtgtgcgatggcacttactatcaccaacaccactaacttattttatattgcatagaaatttcaatgctgcctagaatcttgtttaatgttcttaacctgaatcttctaggtttccatatatttttctttttgtacccttgacccttgagttacctgaaattaaatggtgttctcctgaaagtaacaaaacagtgtaaaaaacaattggtggattctactccaagagtacatattatatatggaagtttgctacaaacagaaacttattcagctttgctgatgcttgatatttaagttgatggacgtagcatagtttgtttatgcagtgcatggagctggagggaatttttttttattgctgtgtaaaactgagtgccttaattgcttcatttcggctccaatcttgcaggtttttgagcctcttcgagaaatgataatgagtgctcctcttgaagatgcccgcctgttaacttaccgttatcaacggatcagacaagatatggaatctcaggtaattacccgaagtgagacttcctgttcaccagagatgacaaccagatactaaaaataaattttattagatagctgatgtgatgagaaagcaactgaagtccaaggagagtagcggtaatgcagataattctgtgaaactgcaacatgcagaatcaaaattatctgagctccgaactacattatcagcattaggaagagaggcaactgcagctatggaggctgtggaggttcagcaacaacaggttacctttgaccgtctccttgcaatggtatgataagcctcactgttctcataaaaatattgcttaacatcatcaaataatatgtttttgccaatggttaagacttcatgtacatggcaagttgagcctatccatcgtaacaacatggctatttctcttttgctttgagtatggtgtaaccaatacatgtacaccattaggggtagaaaactgtagacatcaaggtcacaataacctttgggttctgagcagaattggtgtttgtggccatgtttggatgttgctttttttttttccctgtcaaccccaatgtgcaggcccctttgttagttagagcatatctttgcaatatgttgacccataatcctagaagtttctgcatatctacgacaatgaaaaatcccactccattgtttaaggccttggttggttggggtggtttgtcccagtccttataaaatttaataccaggaatttgatcggttttcctaagggcctggtattgactcttaagcccacactctcatacagggttccttttctccctgctcaccttagattgtaacaatcttatcttttatatcatgtggttgcttaagttcccatataaatttctcatctggatttccatttagtagttccagtacttataccatttgtccataggatgttcctttcataaagagtcatgcatctccaatttaccttatgacccacttgcaggttgatgctgagagagcttatcatcagaatgctgctgatattctgaacaaacttcacgacgaggtacataactgttgcaaaagaaagaaatggagattcttacacctgttggcttagaggaaattcgaatgccataaacctggaaaaagtgtgtatgtttatgctgaatatcactctgtttttgttctgctaatttgcacagatggtccaagcaaaacaccatgatgagccggaaaaccattatgatgagacatcatcagatcctaaaacagctgcaacacatgagcattcacgtagcacatccgaagatcacatatttactaatactagtgaacctacaaggactgaaaccagtgaacctacaaggactgaaactagtgaacctacaaggaatggtcaggaagtgcattatgttggagaggtatgtgtgccctttgcactgctgctcataatgatcataccagaacttataatgtgtcaccaactcacaacatcactgtctttcatttaattgcagtgcagtataaaatgttagaccttagcttgtattactggcattgtatctgtgctatctgtttatgagatgttttagacatagatacaccctcttacaaatatggtacttcgactgaattttatgtccacatgatatatataaagcggtttgattctgcagccaccttagaagttaaaatttcgatagcatgagcaatacatatgtgattttttagagctactttttttttaactttttaggaatggaatttagagctactgttggtaaagatggtagtctgaaatcatgtgaatttaaattcaaaaggtgcaacttgaacataccggtgtttcttcaacataaccttttaccttaatctttacatttcactttattcctctttacacctggtaaatactatcaccgaatgtcggtatggaagtcacctggtaaaaagaagcaaacatatacaggcaaaggataatcagtatatgccaaaattactagttcaacaattttagcagttacacaatcagtaaaacagatcagcacattattatacaagctgagcagtttgtgaattactcattggtcaggtaatccatccattcgatgctcaggctgatggcgagctcagtatttccgtgggagattatgttgtggtccggcaggtatacatggtttttgcaggttttattcatgccatggggtaactaatgaccaaaattctgaagtaaagaaccatgtactgtataattcactgcggtagcatcctagtgtatacatctgtgaccgctgcaggactatgatcagatgcagtgcaagcatataattgtccccttgttatatttttaattctccaagggtgaccaggggggaccagaatgctaactaagcattccttgtctgtcttcacaggtggctcccaatgggtggtctgaaggggaatgcaaaggaaaagctggctggttcccatctgcctatgtggagcagagggacaaagccccggcaagtaaggtgatagagcctggattgctgactacttaatctctctcatactaatagttgctttcatcgccctgtttcccctgtacatggggtttttcttgagtgaatagcattttgtagaacttctacctttctgtgcatattcatgtgcttctaggcttgctgttacccaataattgtatgtaaaatttattgttttgcctttagcatctcgttttctctttctttcacaatgtatagagctattggtcctgggatgctgtaaccttccctttcttttgtggaaagcgtgcttcctgccaaaattgtgagatggatttcagaacagtctcactggccttgttccttcacttttggacccaaaagctcgtaatctacttccctccaaactctatttactcttcttttttctgttcttatcaaaacagcaaagcaaaggacggattgcagcattcggtatgtctgattgggtagaagaagaaggcatggttgctggattcctggatccaactttatctgaaaccctgaaccttaacgggaacaggagcacttgtttgattgctcccctcctctcatcatttcactgcccacaaagttaatttgccacttttacctacttttggctctgcggatgctgaatttatggggccaagccctgacgcctcttccgttgccggtccgcttcgcggaatcgcggtagcctggccatgagcgcgccaccaccgccgcctcgcttcttgccgcgacacgcacatggagctcggaaagctcgcgtttcccaagccccgcgcgatgagtgcaacgtagcccggattgattcgcgacgttagcccgtagcacgttgcgcgcaccagcggcggcaggactggatttttcacattttggtccttttgaaaaacttatttcgcaaatagacccctgaaaaaacttatcccagaaatggtcctttttgggacgccacagtgcctggcgccgtcatccaagggggcggcgccagcctctctggcgccgtcctcctgccaccgtggcgcacgcgaaccgacgtggcaggaggagggcgccagcatggctggcgccgccgcctctattcctgtttctctgtatggagttgcaacggtgtcatttttattttatttttttgatgttttttcacactcaggatcacgatacaaccaaccacaaaaaaaaattaaactcgaactaccacttagctaagtttgaaaatatttagcataccacttagtctactttgcaccttcactaaaattagaccataactcttttagtaaaactctttgatcagcatgttaaacataatgcactctaccactatatgaaattacttaatctaattcaaaatataaccacatgaaatgagatatataagttaaacagtacatagagatgtaatttttttatttttatttcattttttttgatatttttttcacacttaggagaacatagaaaccaaccgtataaaaaataaactcaaacggacaaaatatgtgacatgtagaattttccaaaactctaccgaaacggacaaaatatgtcatctattaaaataggcgtaactttctcatacggactcggaatcaggcaaataatatatgcacggacatctacagaaaaagttacatccgattctccccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaagaaaatatcaaaaaaataaaataaaaataaaaaagttgcacatctctctcctctgcactagttcggagagaggagaggagaggaaaaattctacatgtcacatattacgtccatttgagttcaatttttctatgattggttcttgtgtgtccctaagcgtgaaaaaaaatatcaaacaaataaaacaaaaataaaaaatttcggggggggcgccagccactctggcgcactccccctagccacctcagcatcgccccgccacgtcggcagggggacggcgccaaagaggctggcgccgtcctgttgaacgacggcgccagccactctagcgccccaaaaaggaccatttttgggataagtttttctaggggtctaccttgcgaaataagnntttttaaaaggaccaaaatgtgaaaaatccaggcggcaggatgggtcttcggtgcgtcgtgcgcaaggggcggcgtgtatgggtggtggtgtccaccggattgattgcgtgcgcttcgcctcaccggtcttgggctgctgggtcctcgtgcagttatggcgcggctcgcctcatcgcccgtgttccgccgatcgctttggggggcaaggtagcagagatggaagagagagaaaatgatgcgtgccggagacttgccagtgtttaccgttcgtctgtctgcctgcctgcctgcctgggtgggtttaacccctagactagtatcttcttttggctaaattttcaggacatgtactaaactaccacgtgattttaacattagtgaagcagctagggactagggagagaaagcatcaaccaacaatcgacaacgaaagattgaggccatgtcttagttcacatcaaacttctgcctgactctcaacttttcatcacatcacatccaaaactttcctacacatataaattctcaattttttttcaaactatcaactttccttaaacttttttttcaatttcaaaaactaaacacagcgtgagaagcttcaacggtagcaggagtacagtaaaacgggagcagtggtgtggaagggtgaaaaaacaggcggtttggcctggccgatgggaggaagggtcacatcgagagcagaggacaccgggtatgagacagcacagctcagcaacctctgggtcgcctcgttggtcagagctccgggcccgccaccagcgacccgtcgtcctgcttcactaggctttgtataattgtacccgtaggtgctgcacaatcaatactttacctaatacctaaatactctaccaatacgatacgccgcttagctcaactgaacatcttcagtatcatggagaagtcgacaccgcgtgtagtttccagtgacagactgacatgctctatctagtttaaagctgatattctgtagaaattttgtcctaatcgcaggtccaaatagctcaaattgaaacaaaacaattggctcaattatctatcttgaggtctatgccgacctaacaaaatgtactgctcctaaccaacatatattgacaagctgcaataactcggcctaccttcgcctatttggaagttgagagcacagggagggccgataggaaagagagaaaaacactgtagtttatcatctgattgttcagaatttaattcgtcccaaaggctaagcacggtccggcatgggaatctatcgctgtcccgtcccaattggcacgtcattttcactcagcatgccacacaagtaccgctacgacgcaaaggcacgcacacctaataaccaataaatgtgaacgaaaaagagaaggaaaggaaaagaaaaaacgggcgaagaagaagaaaaacgtaaaagcagcttgcggtgcgaggcaaaagctagtagacgaggcgggggtgattagctgttcgtcccgtgtcccgttgctcgcccacgccacgccgcacgcggacaaaaccgcattctctctctctcactacactcctcccccacactctcctctcctctctccctctcgcagccacagcacagcgcagcactggccgcctaatctctccgcactctctcccctcgccgctccctccactgccgcttcgtctcggccgacgacctcgtcgtcgtcgtcgtcgtcgtcctcgtgttcgccggtcgccgcgccgacgcggatcgccgtgccgctgtccagtgcgagagcgcaggcaggcaggcaggcgcaggtaaaaaccttgcccccgctccccgtcctcgcgccggatctgccgccgattcgtgcggccgcggtgagcccgtgcgtcgcgtcagcttgtgtgttgctgagtggtgaactggtgatgccgcggcagcgggcgctcaaaactggtgtgctcggtttcgtgtcggtagcgtcgcgggggcttgtgggttgggttgtggctgtaccctactttttgcttagtggcgtcggcggcggcagttgcgacggctttaactctggatgactggatgcgtgcttgcgttttggcggttgcgagctggaattagtaactgctttgttgtttcttcggctaactaagttggtccttttttttttctttttaagaagtaactgaaagatgttgatttacagtaattggggtgactaaattgttttcgaaattaaccgctgtctaaattgtttttgttagaatttttggggaaatttcaaattgcaggttctaggtaattcaaataccattaaacaattttgtggaagcacataattttttttattaataaattgtcatgttttggttcttatggtcgtccattttgctaaagaggagccatgagtgtgtcacaatgtactgcatttgatctgcatatctgattgttgctctgtttatttgataactttgcatgattgctgatatgttcctgttttcacttacagtgccagcaatttgcctccctcaccaggggcacatctacatgtggagttcattcccataaaagaggatgcacatggtatacctcacccatgacctctgtaataagctgcggtgatctttatatgcttcaccaactggtgaaaaatgggctcttttctgagaaaacagcccagtttcctcttaattttgttaattctgcaccttggtgctcgtgaagcaagagcactaagttcagatggtatgtgacatttcatagttatggttggtatttgtgtgctacatttgacaatctgtgctcatttattatgattcttttgacggtttcctacaggtgaagcacttcttgccttcaagaaggcagttacaacttctgatgggatatttctcaactggcgtgaacaagatgtggatccttgcaattggaagggtgttggatgtgactctcacaccaagagagtagtttgtctgtaagaccaaaataaaccctacataaatattgtgaaatgcttagaatttcaacctggctattattttgcttcagtaatatggttttcgtttttaagatggcattttctaataggaagggaatgataacttcatagcttccattgttataaatatatctgaccaccaatatcttttgtttaggattcttgcatatcacaagttagttgggcccatacctccagaaattggaaggttaaatcagttgcaagctctgtaagtgtgtgttgatagcgttctttgcttaacctctttcttttcagcatctgaaattactattttatgtcattagatcactgcaagggaatagcttgtatggctcactccctccagaattgggaaattgtaccaagttacaacaactgtaagtttctaagtattactgtttttccagcatttgtaacaccatgtcttgcaaaaaactattcataacattcatactgttatgcaattttaattgatgcaactttttacgttttgtgttctgacttgtgagatgaccagcaggtatctacaaggaaattatttaagtgggcatatcccttcagagtttggtgatctggtggaacttggtacactgtaagttttgggtggagtttctggttgctttttttaatcatttattacctcaatcaaccaatgtctttcctggctgtccatttcacatcagactgatctcccctgtctgattagttcaatctatgcatcagaaacgtaccatttcactgaaacaatcaacacaaaagttctgatataaaaattaagtgcactggattgcaaatgaattcgtttgtcaatttagaggattactcatatttctggaatatgtttttccccttcagggacttatccagcaatacgttgagcggatcgattccaccctctcttgataagctggccaagcttacatcattgtgagtgttttttatcttgataaatccattgaatttttatgctaactttgtgcggcaaattaaataagaaatttcacctgtgcagcaatgtttccatgaatttcctgacaggagcaataccatctgatggttcacttgtgaattttaatgaaacttcgtgagttatcttctctatgttgtttattcttgtctaattcaatatgtatatttgagcaagtagagtgggggatgtcatgtgatagagtgcttttgtttacctcttcatgatgcgctacactacatcacacttgtaatatatcatatgattttgcatgttgcaatgcagcttcatcgggaaccgtggtttatgtgggaagcagattaactcggtgtgcaaagatgcacttcagtcaccatcaaatggccctctgccaccttccgcaggtaccagatgtttctaaaactgtctacatacctttttttcatgcttcaaacattttttgtaaatagttaaatggttagcaagatttcaatgtttgtatttaatatttatccatcaatatcaatcatcagtatcagttgcttttatatttgactaggaaatatacttctggcagtttggggttctgtaaagtgtaaattgatccctttcttttcagttcctttcatgaacctatgacttatgttcttctgattatcatatggcagacgacttcatcaatagaagaaacgggaagaattctaccagacttgttataagtgcagtagcaacagtaggagctcttctgttggtcgctttgatgtgtttctggggttgctttctgtacaaaaattttggaaagaaagatattcatggtttcagggtggagctatgtggaggtaaccatgtcattgaatatgctatgtgaatcatcttcaatttatgcggtccttataatcttgcttgttttcttttaggctcttccattgtgatgttccacggggacctcccttactccactaaagaaatcctcaagaaactagagaccatggatgatgagaatatcattggagtagggggcttcgggacggtttataaacttgcaatggatgacggtaatgtttttgcattgaaaaggataatgaaaacaaatgaagggcttggtcagttctttgatagagaacttgagatactgggaagtgttaagcatcgttatttggtcaatctccgtggctattgcaattctccctcatcaaagctattgatatatgactatcttccaggtggaaacctagatgaggtgctacatggtgagcatgttcagttttctacttcctatttattttatttgtattgcattcttccaattgttaacagttttagtttgtcttcctcagtaaggagttaagtatgtgttcaaagcccaacattaaattaaggtttgaggtgattcagttaatggatatgaaagaacctagtggtgatggtggagtctgccattccaccaccacctctagggttggtgttatcttctaagggtgcatagatacttttatatgtgtggcttggctatcagtgtggattgatgctctcttgcaaattacatattcttccatgaggagtatacatataatttgaattttagaacataggatagtatagtactatagttacattcaatctacctattggaaagaggtacaagtacaacaatatcttaaggggcatactagctaatgtcagctagacacagaatgcaatagccaagtgggagatgaagactttagtatgtgaaaattgtgccactgtgggggcaacaaagttgttcatttttaagttcttgatcgtcccatttggctattttgtggcatgttcagacctccatgtgaattagcagctacagattccacgatggatattatttctgcctcttgtaacaaaaatggaatgctacttagtagtcgatgggcatgggacttcagctattatgtagtacgagtagagggttgtatataacatactaggacacaaggacagaagatgctgtctactcatggtgattccaattttacattggcagcgagtctgagaattatactttattactttaaatacagacctctgttcattcttcaattacatctggatctaaacaatcgagataagagtgaaaaccttaaccatgatattaccatttatattccatatgcttgtggaatatatgcattgaattttataacaacgtataattaggtcttacattagcagacttcactattttattttttaacatcaagtcctaatatctcatctatcttcaatcttgacagaaaaatctgaacagttggactgggatgcacgtattaacataatacttggagctgcaaaaggcctggcttatttgcatcatgattgttcacctcgaataatacatcgtgatattaaatcgagcaacatcttactagacggcaattttgaggctcgtgtatcagactttggactcgcaaagctattagaggacgacaaatcccatattactacaatagttgcaggaacatttggctatcttgcaccaggtatgttaaaactgttctgtttcattcattgtgggaaaataacagcatataacaaatgcttaccaccttattgcatctctggattttatttatcaatatataatttcatatgctctgagctaatttgcaaaattcaaaatccagagtatatgcaaagtggcagagccaccgaaaagactgacgtctacagttttggagttttgctacttgaaatactaagcggaaaacgacctactgatgcatcatttattgaaaagggattgaacattgttggatgggtatgtatgacctttatgtccttccatttcatatccacagttttctgatatgaattacgtatgccttcaattgatttaatgtattcttgaaataatctacttgctctgtggcagttgaatttcctggtcggtgagaatcgggagagggaaattgtcgatccatattgtgagggagtgcagattgagaccttggatgctctactttctcttgctaaacaatgtgtaagttctttgccagaggagcggcctacaatgcacagggtggtacagatgttggagtcggatgtaattacaccatgccccagtgatttctacgattcagaataggcttcgacttacggctgctcttgaaaacgccacactgccgctggttttcctgtggaggcacattccatttattctttgcagattatgtaaattcattcctgcggtgttcggctccaatcggctagctcaatggggaggacatttttgtgtctatgtatctatgctacgtacaaattattactactacatgtcaagttaataagaaacttaccaggagattactgtacttgtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggttttaccgttttacatagcggagtagttcgagcggcaacaacacacttgaaaggaaccagagcacaccaaaaacaccagtaattacacctcacataagtgatcgatacacttgaagccacagataaatcgttttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctcaacctccaccttgacctcctccttcttcagccccggcacgtccgccttgaacacgtgcgcctcgggcgtctccttccagtcgatccgcgcgccggcgaaggccgccgcgtcggagttggcgcgagggaagaggctgccgctgccggagccgaaggggaagccgtcgaaggggtcccagaggtcgagggagaaggggtcgaacacgttgctgcggcggatcatcgacatcgtcggaatagctgcgaatttggaggtggaacgatcggacttctctgagttcttactctgatgtttgcttggtttgctttgcgttttcttcgtggttctgccggtgaaggggagcgcggttttatagagggcagcgagagggcatcgtggagcttggaataagcttctagaaacttccagtttgcccccgcatgggctagaacctagtacgagatagcttgggctagaagtttacaccaccggtagcggggtgggctgtagcccatagcgtccaggactctccagaataatctaggccataagcaggcctagaacaatccagaagaccacttccaatttcggcccaaattaacgaacaaacgagaactatccggaagcaaaacttccagtagaacccatggaccatcacgaactgctatataaattgttgccaccacgcagcgacaggtgccaaggaaatcagctcatcgatcgaaagatcaacaagctctcttgagaattgagatcaccctctttccatctagaacacaaaccagacaaccaaaaaacagcaagacacaatacacaatgtcgctgatccgccgcagcaacgtgttcgaccccttctccctcgacctctgggaccccttcgacggcttccccttcggctccggcagcagaagcagcggcagcatcttcccgtccttcccccgcggcacctcctccgagaccgcggccttcgccggcgcgcgcatcgactggaaggagacgccggaggcgcacgtgttcaaggcggacgtgccggggctgaagaaggaggaggtcaaggtggaggtggaggacggcaacgtcctccagatcagcggcgagcgcagcaaggagcaggaggagaagacggacaagtggcaccgcgtggagcgcagcagcggcaagttcctccgcaggttccggctgccggagaacaccaagccggagcagatcaaggcgtccatggagaacggcgtgctcaccgtcaccgtgcccaaggaggagcccaagaagcccgacgtcaagtccatccaggttaccggctagtaagaaacttcgggtgtgacatgcacggtggagagcttcgattcgagccttcggtttgtgatcaattgcagtaaataaaagcgtcaaatctggtcctcagtgtttatgctgtgaaaaagttcaaagctatgttggaagtgagcaataaagacttttcttgttttgtgaacgaacctgagattatactagtcctacacttgtttgtttaatctaatctccggtatattctgccatttttatctcgatgtttcagtacttttagcctttggttcttgaatccttctgtcgagactggagagttcatttcggaaattgagagctcaatttccacataagtcccacaaatttcacttgtttcagcattttcacagcaatcgattcgattccaacagaagtcccaaaaatttcacttgtttcgaaagatgcctataggttttacgttttcagatcggactgagaaaaggcctataggatttccgttttcagatcagactaaaaaattattccaatgctaggccatgactgaactaaccaaatataacgaaattgctaatattgtgatttgcgattcgtacttcatgtgttttttcttcaactccaataacctcatttatttctacaacactgataacaacctaaactccggcaaataggtttgggtttaggttggggctgagagagaaggggaaggtggcttagagggatgattgtggaaggtgatggcccgacgatgtacagcgggatgagtgggtggcgaggcaacgacggcaccgccaaagccgtagggtcgataacatacggtgggtcagtgttaggggcaaagtagagcgacgggttaggagatggcgtggcaggggcacctcaccaccattggattgaggtgacaacagaggcagcgatgacgagagccattgagcgttgttcaaggacaaaggaacaaaagataaaagataaaaggattagggtttggatatctgcaccaatccgaaagcgatctaatggctcaaaaattataagaatttttaagtggtgttttctgtcaaatgtgtaatagaaagtctcaaatataaatatgaagctctgttatgattaaggagtttctacttctaataaatccataaaatagaacttttatttatgcgacggtggtagctcatgcagaacatgccatgatattcacaactattaaatctctgacgtataaaaagtggatactttgctatggacacaaacatcttagattttcagccaaaaaaacgcatggccgcatgtctaagggcaatcccactccgaaccttcaatcgaacaaataagggcatcatgtcacaacctgttatagatcaactaatatgagggtattgttctttagcacgagattgtttctagcgcactttctttttctcaaaactttgtttaaacttttttcatatgaaatgattttattgaaaaattcatctgaaaagttttacatgaaaactttcatgttacgaaagcacgtaggctaaatagcaaatccgactagggtaaatagatctaattgtcctaatcctgttccgggaccatgtgcagatggttcactctttgcccaagagaaggtggagcccaccatttggtccataaacggagattgagatcctctaccttcaaaggcaacatgccttatgtcactgacaaagacttcatccatcaccgccaccatccctcgcggcctcgccggcgatcaaatcgcctgcacggctggttccggtagccgttctccatcttggatgctcaagcgggcttggggtcctgaagaggcggcgccaattattttcttctcctccccttccgttctctctcgtggtcccacggcgttggcagaggccagggtgcctcaaccctcaagagtcaagaccctatgcgcctcgcgcagattgttggtgaaggggctcgtgtgcccctcttcctaatcccctgttgtattacttcttggtatttctgtgcagagattaatgatcattgcgctttcgttgggttgtggcaatggcattagtcttaacgctggataagtccatggtgatgcaggagaatgaatccgggaagtgtgccatgccatcagccaggtgcgtacattgttcttgccgcttcttcgtttgtccatacctttgtgattgcgttggtttatgttttgctaattcaccggcatagtattgtgacggtcgattcggattctgctattacgtctcttataagaagaaaatgggagagattcagcgtatattagttatgctggataataatcagaactgatccttctaaatcaaccgagctaccagaacaaccaatgttgtagaaccgaactggccactcccagtttccattccaaaaggctcaagaaaaactcaaacattggtacattaatcaagcttaaagtttatttcccgtacataaacgcataggagacaaacacatttgggacccttggaggagaccacacattcataaacacatgatcatatcacacacattttggactgtgtccctcacgacacaagcaaagtaccaaaggaggagatcaattgcagcattgaggagaagcagcagaataaacaaacggggctctagccggagatctggatggacttgacgtcgggcttcttgggctcttccttgggcacggtgacggtgagcacgccattctccatggacgccttgatctgctccggcttggtgttctcggggaggcggaacctgcggaggaacttgccgctgctgcgctccacgcggtgccacttgtccgacttctcctcctgctccctgctgcgctcgccgctgatctgcaggatgttgccgtcgtccacctccaccttgacctcctccttcttcagccccggcacgtccgccttgaacacgtgcacctcgggcgtctccttccagtcgatgcgcgcgccggcgaaggccgccgcgtcggagttggcccgagggaagaggctgccgctgctgctgctgctgccgccggagccgaaggggaagccgtcgacgggatcccagaggtcgagggagaaggggtcgaacgcgttgccgcggcggatcagcgacatggttgacggatttgggcgagaaggaaggctgtgtttgtgaacactaaaacagtgtgtgcttgggaagcttgggatgtgagcacaagggatcgcgatttgcgagttgctttcgatctttgtctgggccgcagagcgggaggggaggccggatttatacgggctgtgggcggcgttgagaggtgggatcctgataattctcgtcagttcaagaatgcactggaaaacacctgatttggagcctggccgcctgggccgaatcatcgagtgccttccagaacttttggccctgtggatccaaacggcatgggactctggttacagatttacaattgccgatttccttctgccatgttaatatagaaattgccatgtatctattgtgaactatagttagatttgttcctatttctatttttaaaaaaatatttaaaacgaagaccttttaaattttggtaatatcaaaatttaacaaggcagcatactaaacatactattaccaatgcaaccatattttagtaattcgggaactttctactctagctactacacaatttagtaatgtgttaaaccaaacatcgtccacatccttaccttattatcttactactaaacttcgattctggtaaaattactaaaatttgataagttttttccaagtgaaaaatgaacaagtcctacatctcctctggcctatagcatagaaacccatcactcccaatttctactttgagtacgcctaagcggtcaaaaaaggagaccgttcacacgttttacaatgtaagcataaacttatatggtcatttcataataatcactaaccttttgtcgataaaaaaacatccccaaatcttagggcctgtttactttaatgccattttcaactataccattttttaataaagttgtcaaaaaaaagtatctacgtttagtttgttgccaaatttagtcaatacataagaaatcatgccaaaattttagcaatattgccatcttgccaaaattttggcattgctaaaatttggtaaggtttattttagctacaatctaaataggcccttatagttttgggtcactagatgtgctttgcgattcgtgctgtagacccttatcttgtagctctggtgatctccctttcttctctggcaccggtgacactgcaaactctagtggagtagcaacggattagggccccgggggttgggtggcagtggaaggaggagggggaaaaggggatatccatgcgtttagatggatggaagtaggaggcggtggacacgagcaggcgacgaggcaacaatgacgacgctggagctgtggggatgaaagagagtggtatactggagcaaatttatggttaggaggcagtgaggagccactaaagacgaggaaaagggcagagcggggcacctcacggccggcagccaacgacttgagtaggagaagaggttggtaacggggaggctggctagggagggaggggggattgggctcgccagtgttattaacgccttccggccagccggcgaggccgggctgcagggcggtggcgacggaaagcatcgagcgagcgggtgattcaatcatgtctggtgacactagagtgagaagggaggagaggaggggcggggtaaggtttagggatgtatgcaccaatctatacctatacttattataaaaattgaagatgtttccgcggttcgtcatctgtgtttgtgtcggttataaaaattgaagatggcatcatccgtgtttgagtcggttttaattttatgttttggtttatactattataaaaattgaagatgtttccacggtccgtcatccgtgtttgagtcggttataaaaattgaagatgtttccgcggtccgtcatccgtgtttgagtcggttttaattttatgttttggttttaatctgtatatcttctctactattataaaaattgaagatgttttcgccggtatttttgtacgtcatccgtgtatgagtcagtttttaagttcgtttgctttcagtaatacagaaggaatcatataagaaatctgtttaaaaaaactcgcatgctaacttgagacgattagactgctaactgcagctcatgattttctaaaaatatatatatccaagggaattcccacagtaaatttcatcttaactaaaccatataacaataataagattaaaatagacttcacccgttgcaacgcacgagcatttttttttctagtcttaaagaaattcaactgttcaaaattcgacagttccctttatatattgtaacgtcttacatatgcgatttttatggttcagagtttctgacatgagtttcttatgtatgtctcacatgaattgtctgttctgatcgatacatgtaagttttcatcctaagggcacccgtaatggttatctataggctctctacaagatatctatgtcagcatattttcctacttgaaagagattaaatgaagagatagagcaaagctatctactaacctggagatagtctatagagaaaaacgaggcaatgaattagagagctatagatacccatgtagacatactattggggtagtttactattaatctagtctattgctgagatgtacatgttttatagagagcaccttactttactattgcgggtgctctaacagttccattttcaatttccaatattatctttgttttggcctctaccgtttccgtgaaaaataaatggctacagaaatgctttaggctgtttgtcgactgttttcaggactagtgagaaggagcctcgacctatcaacagtagggatgaaatccttcacaatgggtttaattaattcgccatcagaaaagaaaatttctacaaatatattataatttagttacaatacttttttttttagaaacacccccgtatatgaaacttgcagtcaagccaagaacttctcgaccttctccacttcctccacgctcccgatgtacagcggcactctctgatggatctgcacggcacattcacaaacgaatcaattatatagacacatttcgatttctaagtctactcgtagattaatccattaataacactgcgcatataatgtgtgcgcatattttacctccgtaggcatgatgtcaagtatcctctggtggccatcggagcccttgccgccggcctgctcgacgatgaagctcatcggcgcgcactcgtacagcagccgcagcttgccgttcttgctcttctggtccctggggtagccgtagatgccgccgtagagcagcgtgcggtggaagtcgccgacgaggctgccgatgtagcgcgcggagtatggcttcccggacggcccgggctccttgaggctgtccatgtagctcttgagcttgtcgtcccagagcgcgtagttgccctcgttgaaggcatagatcttgcctgccttggggatctgcaccttctcctgcgtcagcacgaactcgccgtacatcgggtccagcgtgaacacgtacacccctgtcccgatggtgagcacgaagatgaccgagctcgagtacatgcagtagccggcggcgagcaggttgctccccggctggcacacgctcacgatgcacctctgctccacctggtcaagctgcaggcacacgcgcgcggacagaggcgtttcgttctgttagcaccgtgtcagtgtgtgcatgagcgattgctaggcgatcgataacgcgttacattttggtcgtcggcgatgtcggctaggcactcgtcgttggggctgtagatgccgaagatggagccggtggagacggcggcgtcgatgttggaggagccgtcgagcgggtcgaacaccacgatgtagttgcccgagtagctctcctccacggccaccggcacgtcctcctcctccgacgcgatcacgccggtgcgcccgctcgatttgaggcagttggagaacacctgcggtgcgcatagcgctcagcttatggtcggtcgcgcttgttgcggtggttcgcgcactaaccacgacgagctactgataatttagtcgtttacctcgttggagacgcgtcgagttttttatggtcctcgccctgcacgttgnnnnnnnnnnnnnnnnnnnnnnnnnnnnnnngacggcgccctggacgccggtgaggttggagatgggcgcgcgctgcaccagcgaggcgatctgcttgcacgccgtggagatgctggccagcacgatggtcatctcgccgtcgatggtcccggcctgctcctgcttcagcagccacgtcgtcagcgtggtgatctcgtagctgctcttcttgctagcctccgtcgcggcgggcgccgaggccgtgtcgacggccgccatgcaccgcacgctcggggccgacgacccaccggcgagcctgccgggctgcctccggaaggagaggccgcattggagcgaggccgccgcctgctggcgggagagcaggagcaggtgggaggatgtcgtggctgcggcggccatcgctgctgctgcttggttgcttgctctgctcgcgctctcctctcgctgcggctacctggtcttggtgccgatggcttcttgttttgttccattggttttagccgcggtttgtgtggccggagagagggcgggaggtgagtgtgtggattgggggagaattgtgaggatggcgttgcctcagatactagcctaattgcaactccttgtccttcagccagcgtcacgtacagtcacatacaagtagcatcgccttgctcaggggcagtatatacttgtgcttttgattaggcagatctattattcgtacctatgaatatagatggtcatatgacccagcccaaggccaggtgatttgacccggcccaggcatggcaggtcgggccatgccggcccagcctaacagccatgtcgtgcttgggctgccacctcggcacgttgggtcggcatggcccggcacaaagttcagtgtcgattggaacgatgagcccagatccacatagttccggaggacaaaggagcaaaacggtggtcagctgtcgatgatgaggctgctggctcatatgggtttgccagtagaggctcaagcatcagtgacgtgcgtggcccaatgagagagatggtgtcagaccactcccctaccgggatcacggacggcaaggtaggcagcgactgtgaaggactgaagcaggcgaggatggggaagatgtctgaaggggaagatgaggaggggcggctttctctgccgtcatcatcgcgccattgcctactattgtccccactcgagctcgtgtggcggtgtggaaaaggagaggggggtgagaaagagaggggttgctcgcaacattggtagcgatggcgatgggaggggaggctcatgtcgtagtgttagagggtcctgccaacaggatgaggccacagagtcgtcacctccatccctagtgagttccacaacctcctcgagctgttgttacctatcggcctactgatacatactcactgacatgtgacccccacatccggttggaccaacttgccacgttggtgaaaaccatttttaaaatgggacaattgcatatatgcccccaatttcaaacccaattgttgttttaccctcactttttagggtttgcggttttagccccactttttgaatctgaaccggccgtctacccctacttgtaacaatcgtttggtgggtcccacgttttgtgttaaaggaatacaaaaggaaataaaaaaaggttttaggaaatatgaatttacgtttgtacccctgagagaatgggtagggactaaatcctctcaacctgtgcgtgcgtgaatcagggactcgagggcgggcggctgcgagggcgtacgcgcggcggcggcaaccgtggagagggcgggcgtgcggtagccaggcggccgtggggctttgacacggggattcgcagttctagttgccacacgagttcatgctctccccgatcgccgccctctcccttgccgcgaggtatgccgccatcgagaggtctgtacgaccgcttccccctaccgcaccctcctcgcactactacgcagccggcgacgaccccatcctgctcgacgtcgatggcaatggcaacgccgccttcatggcggtcctcggccccacccacccaagcatactctccccggtgccctccgcgctgccccccatggcatcgtcaccgtcgaggctcttctccccgctcgaccaggcctccgtctcctagctcagcgacctcagcccttcgtccactccgccggcgcaacccctcccccccaacccatgccgccgttcgcgccgagcacgcatagcctgctgctgtccacgcccaccgtcgccgatgaccttctccatcaaggaattcttcagtagcaacttcccggacctgtcgaaatgctgtctaaattttgttcaaagtttggtcagattatgtacttggctagtatttgtgatttttttattaaagtacaaaaacatcacaagagatgctcatatttgaattatttataacaatcacacaataggggcaaaatcacacaagctgaaaaaaataggagcaaaaatgcaataatcactaagggtataaatgtccttttgctgtacaactaacaccgttaaaccggatgttagaagtggaggtagtcggatggttcaaattcaaaaagtgggggtaaaactacaaaccctaaaaagtgaggataaaacaacaattaggtttgatagtgggggcatagatgcaattgtctcatttaaaatagtcaagataattaagttacatcaattttaatagttggggggttagaacatcctctttcacgaatgaggaatagaatcagaaggactttaaaggaaaggagtgccatccaacagaaggccctataactacttacgttcagcaaatcctgatatgtagcctgagccgagctgctctttcttgggcttcttacttgttatactctgtgggccgtggcccaatttgacaactccttaccgttttacttttgcttttctatttctctaggggtataaaacagctgtaccaaatcaatagaaaaccaatgctgcatttcttgtgtactagaaacaaaatgtccatgcgttgcaacatttttttctttctgtggtacgacggctaataggagctaagcaatatattgaaacattggaatcactatacattgccccattcctttattttcagccccagcccaatccacgcctcatatctccctccgctcggcctgcctctctccagcgcaccctacaaatggagttgcaagagcccagctagcacaatcggttgcctcctccaaacactacagtagcgtcttcaaacctctagatgacagtcatgtgcccgtatcatgccggagctaatcatccccatcaagtccggtggaatctttctcgatctctcaaaattggttgagggttttaatccactcgatctcgatcctctttccatttctcccaaaatcagagcgtcgcatccaaatcgtcgtagcccaattttgtaaaacttgggataaaaacacgcgcacggtagcgctacggacattgacgagcccaaaaaactacaaaagccttacgtatttttaattaagatatataaaaaaaggaatcttggtctcgattagactcttgatcgtgtcgcaggtgcagcgatgatgaaacgaagcggagggacgaacggaagccgaatctcaaagggatttaagggaatcattgatggatgaaaatttcaacagaagctttacgcattttttaaataggtatatatagatatatgaactacttgtacaatacttttgtatcatctaacattttatgcaagatggacatgacgcagacatcagaacatattcttaaaagaacatatcagaatactaacaaattaagcaataatcacctcctccagcttaatccttttttttgctctttccacgacaccaaccttttgaacaagaaatacaatatttttgtagaccaaataatataattctcttgcagagtccaatcctcgtattgtttaagctttgagtttagcaaactctactcttaatttgtaccattgcgtggcaggattccaatcaaatactagtagaaaacaactcctatgcttacaaaaaacaggacattccaaggcaacctacctattcaggcgcgcacgtcgatgtgctatgctttacattgacatgtccagcaatcttgtcctatcctgttccaagacggtggcaatttttgtcagctaccgattgggcaggggagcacagctacctcctgcctcatcggagacagaaacagagtcgtaacccatcaaaagcaaagacaaaatacacttgtcgagaactcttggtttgtttggtttctcttcacgggcaacggaatcttcaaggtgtcattggcagaatggcaggcatgctaatttgttcagaaggtctctaattcatttgacgagttagcgtgtatactagcaatcaccctcttgattatctcatgctgtgctcgtcgtcttaggaaatgccatgtctggtagggtcaaagccaaaccgagtcaggtcagtatgaaaccaaatgcatttcggttagtggcgggagaaaaatatcgatgtcacaattagtcaacgagcaagcctactctgttctatctagcacatggaagaaatgggacctaacagtagacttctgattgttcttctagctctttgtgttttataatacatatctgaacgctcaaactaacctgtagctatagtcgtcggttcaaaccagtgtttgattcgaccacactctatgaacccaactacttccaccactccatctcttgatcctgaaagtgttaacatttcataattaggagatcatgctgggagattctgccaaaccacatttgcataccaacggcctagattttctatagcttaccagctgccactccaagcttgacttctgaacccgaataggttcacaacaaaggctgtatttagatctaaagtttggatccaaacttcagtctttttccatcacatcaacctgtcatatacacacaacttttcagttacatcatctttaattttaactaaaatctaaactttacgctgaactaaacacagccaaagccagattcgccgcgcttgccctctccggcaggcggcagcttgaccctacgcaccaaattaaactgaacagataggataggataggatgacctcattggagcgccagcatgaataacacagtaacctttttttctcgacacgaaaggagccaatgacctatatgagcgcttgcttttgctgaaactgtactttcacacggcagattaacctaacgtagatatatcctactgaaaagcatctcacgaccgacctgtactgctgctgtcctttctctatagacgatcactccgcagcaataattctggtccagtcggagacatcgaccccccacacacaatagctagatcgctagctagcccaaggacacccaagaacagcgagatggggcagatggcgatatcgccacgttctcgtttcattcgtttcagcggccgtcactttcactgcaaatttttcgccgcagatcgtgcagctaattataaaagctgataacaatcgatctgaagccgcctctcttcgtcccgttcacagaaattcatcttacctaattaccagaggagacactagctccttttgactttgcgtgtcgctgcacctgatcactctctctcacacacgcacatccattagctgggcatggctgctacttgcagctgagtgcccagctcacgtagcacgtcgcatacagtaatacacttacaggtcatgggctcatggcagtgacaaaaacaaggccgtcttcccaggctcgcacactggcaccggcagcctcgcacactggctagctaggtgacggagacggcatcgctttacaactcaaaagggcctccgcacctcggcacgcctcgttttctattgctcggccgcctttgcgcaccaaccggccgggtcggacaaaacacgagggcgtctcgcggatgattgggaggcggtctcgcagatgattgggagggacggggttggttgcgcgcactcgcgcgcggggcagtggccggttgtggaggaaacggtgctcctctcctatcccgacgtccccgcggcagctgatgttgaacgggctccaatccgatcgatgcgatgcatgcatggcttgactgcatgcgacgttaggtaccaaggctggctcagatcaggaccgggacgtactgtctcctcgcagctgtaatgaaaacttgcaaagcaacctggtactactaaatttgtcccaagatacaaaaatttttagagataatacagttattaagaaaataagtaaaattaaacggaagaggttatgattggatgagaagtgacggtagattaagaaattaaatggtgaacagttataattggttggaaagagaacgttgatagataagctattatattttgagacaaattctgaatactaaaaattattatattttggtacggataaagtaatagtagtacagtaggttattaagctgctagtaacatgatggattggaatcgccgtcgccgaccgtgcatgatctaacatcgatgccttctttgttttcaaaaagagaaaaaaagggtagaagaggattcggtggttctgttaatttgcagcccctgtcgttttcaggttctgtggaagcatagaagttatttcctagatattgactttgttattcttttttctttgacctcttacagctttcaatactttggatccattccaccacagctagcctaactccaattccttcgttgtataaacctattgcgctcttgacttttttagcatgagaattaaacaaactggaagtcttagcttagctgctgaacagcagtgcatcaccacaatttttttccgttattgtggtcattgatagtagcatctttgatctaagggatgaattgtcggtaacgtacaaaggaggcccattttccatgcagatgtgaccaccggaaccaccatcgtcagtgggcacggcaagccaagcggtaataagattcgcaagaacgtggggggtttgcctcccgtacgtgaagacggtgcgagcgtcagcatctgacaagtccagtggtgtcgggccttggcgcgaaattagcaagcaatgcttcgatcagaaattcagttatactataaacatgaaagaatcaccctgctcaccgggttttattttgttttgaaagggaaatctgctcaccggatttcgatcgcagtgtcaggttgttggggataccacgtcgagcaaacaataatattcccgtctctgtggcaactgcttccaccagcaagcccaggctcaccaatcgtgaaagcggccggccggcggcgatcagtctcctgtaaaacaccggaggagcaacatatatggctcggcactcacccactcacccagctcagctgtgtaacctctaaaaatactagcaatacttttaatttggaccatatcttatctgccttcactgacacctcttatccagtacttatgcgtatctagatcgtgctaatcattgacgctccgtaataatgtctgtgatccggccatttgattggagagtatgcaaaatatgcatagtattacagacggatggatcggatcgaatcagtgtactgtaaatgatgagtaaccctggcctgattgatccgtggatctcccatgtcgagcggcagccgggcaatcacaatgatgagacccgatctcacagagtggtacgtggtgtccatggcctttcgatctccagcagcagcggcagcggcagaaacctggttggcacgtcggaggaaacggacaggatctccacccccacgaacgcgaatacaataatcccgcgcgacgcgacgcccgcacgcacggggcgggggcggagcggacgacgctagcgtccagccacagcgcagcgcagcgtggacggaaccccgacccgccgatcaagccgtccacccgcgccggcgccgcgaatggcgcggcccaaccaccgggagcgtgaggataaaccaagccgagacaccgggaatctggcgcgcggcgtgcacagcgaagcggcccgatatcaagcgacgatcatggcggcaacctaacacgggggcccgggtgcacggtgcgtgcgcgcgaacgtcaacagcctacgactacaactagtactgttcgcgatcccctcctcctaatcgtttgaagccagtgccgcgcacgtaggcgccctaccggttatggaaagggactcgcgggccgttcggaacggattagctagtcgtaactcgtacgtactcaggcgtcatgcctatggttcgtgacttgtacgtactgtgttacatctcactccacggatgcgcgatcaggatcgagagagaaaaaaaaaaggcaatcgatcaattgcttcccaacaactccaggttcccattatcaatctgaacgtgtcgatgcttccatcgaattgactactcgtgcagcaacactccgtacgtagtatcatcttcaacagcgaagaatcggttaaatgcaagtttaactgataaagtgagtgtgtgggaacactgcagaacggcacaaaggctgaaagttgaaaccaggaaagggcaacgcatgatcgtgcgtatatgtgtatattactgtttggacgatgagcacaaggatatctcttgagaaaagaaatgttaaacaagatcgcagagtgcgtgcggccacgaccaaattttgggggggcaaaaataatgtaagagcaaatcttggaccccacctgccagctgcccgcacgactcatcaaaaccggtacaaacccaccgagacagggtaggcgtcataacgcaacacaaaaggaaccgcgcggcggcaccaaagcgagcagaagcagcagccgaaggcgatcggagctcgcgcaacaggagagctgtctccatgaggaagctgtgcccgaacctggagcgcgatgacgcgctggacacggtgctcgaggtgcccatcccggaggagatgttctcacgcggcagcggcggtggcggctcccgcggctccaggttcggctgcaccaacgtcaagtcgtgggtgcggccgaacgcgtccgaccgctccggcggcgccggagagccgtgctccatgagccgcggcgagctgcagctcatgctcggcgtcatcggcgcgccgctgataccgctccccgtcgaccacgccaagcagtcgccctgctccgtcctctgcgaacagctcaaggccgatcccattgtacgatcgccatcatcggattcttctccgtttcgtttgtccatcgccgcgcgctgattggctcatccatttatggcgtgtcccctttcaggagtcgtccacggccaagtacataatacagcagtacatcgcggcgtcgggcggggagtgggcgctgaacaaggtcacgaacatgtacgcgatggggaaggtgaggatgaccgccgcggagctcaacagcagcgacgccgacggcggcggcggcggcggcggagggcaccgcggcgggaagaagagcagcaagaacggcggcgaggttggcgggttcgtgctgtggcagaagaagccggagctgtggtccctggagctcgtggtgtccggctgcaagatcagcgccggcagcgacggcaaggtcgcctggcgccagacgccgtggcatcagtcgcacgcctcccgcggtccgccgcgccctctccgccgatcgctccaggtataatataaaccgcgagttcttcgttagttccatataaacgcttaccgtattcgcacgacttgactgcaatactgcatggtcgcgtagcatcatagaaaacacgctcaactctcagttaaagtttccaacgactaggagaactgcgtactgaattggatcctgtttatgagacggacgactacgagaaccaaatttggtggcacatattttcttttctggttcgacgtcaaacgagtagtcctttgtgtttgggtcgatccaacgttgctgttggccgaacttacgtagcgagtccattgttgtcatcgttcctagtggtaggtactaataggcatcggtatcatgacatggaacgcatacgtccaaagtcgcaaagttctcatcttaatgggaacttactttctgtagttctttgtcccaagaagctctgtttttccccttcgtcctgctcaaaccggcctgatttgggtactaggtggccatcagtacgcgccgtaccgagcgtgcgtagtacgagtagagagtagagcatgcatggcaacttggccagtgtcacgtacctggatcttccctgcatactgtcggtaggacaggacagatcggtcgagtacccgcacggccgagcgacatgattacgcctttgccgcactcattgggccgttggcattagctgtggtcaaggtcagtccagggcggtgtcgggatagggctggccgatcgctcgctcgtctcatcatgaggcttgtacacttgtgccgttgcgcgagagatctggtccagggcacccggtacacacagatatgggggacgtactcatcatccatcgtcagtagcggtggctgcacgctgtcgctgtggagtgggggcgaatcatggcaaggggagggcgattagcgggaacaaagcgcggagcagcgggattaggggggacgggttttcaacaccgtcaccgcaacgtgccgccatgtgctgcagcaacgcggcgggacacatcacgtggacatgggcctaaaccgggacgcgacccacgccatcaatcggttggtggctcgcggtttgtcacccggccggttccacccgactcttgaactctccccgctaatcgcgctgcaccaaccagcccgatttaatttgaccgcggtgtcaactatcataccatgttcttttttcataacagctataaatagtactagtatatagtgtccacgtggattaaattaagtgactggagaaattaactaacttgtgcatgcatggtgtgtttggtacgcagggacttgacccgatgctgacggcgagcctgttcgcggacgcggtgtgcatcggcgagaggagcgtggacggcgaggactgcttcgtgctcaaggtggaggcggaggcgtcgagcctgcgggcgcgcaacagcagcagcgtggagatcatccggcacacggtgtgggggtacttcagccagcggacgggcctgctggtgcagctggaggactcgcacctgctgcagatcaagtcgagcggacacggcagcgtcttctgggagaccaccatggagtcgcacctccacgactaccgcgccgtcgacggcgtcaacatcgcgcacgccggccgcaccgccgtctcgctcgtccgcttcggggacagcagcgacggcaacacgcggacgcgaatggaggaggtgtggaacatcgaggaggtcgacttcaacatctggggactctccatggactgcttcctgccgcccagcgacctcaaggatagcaaggaggacaaggacgtctccgccgccgtcaagcccgcgcggccgccgccgataaggataccggcggtggccgtccgcgtcgggccatcgcaggtcgccgccgtcaacatggacgattccgactcgctcattgcgaggtcatgacatacatagcgggcagtgttacaccgtatgagtcgtgtgtgtttacgtgccttatcgccataagttacttatggtaagatctgtaaatatattgcaggttgagatatttttgttttcggggagtggattttacctcagatagatgctcaggggtgagtagtaaagcgagtaatccgggatagatgttctaattagcggtattgtaatttgcttatgacgccccttcactgtaaagttgaaagaatctccagttctgctagtcacacactgggcttcagcatgttttccacttctcctgaacatacttgtgctacaggtggctgcaatccaaaacgcacataacttgctgcaagtgttttcaagagtaaaaacttaagcctcagtcctcagattaacacaatgcagttccaggctttcagcccccagaacatgtacagagagtggcacaaacgtatcacaacatcggtgccatttctgcaaggggttgagtgacagaagctttgcgaggatctgctttgcttgcatataaaaagggtagctaagcactgagatgagccttgcagcaacacacctagtcattttacatgtacagttagctaccccgctaaagccgattccataagattcatcacatttcgatgtgagtcgcatatggatcatggcataagattccacgacgcaactcgagttacagaagaaaacgaaaagaaacaaagaaaaacatacatttttatcacaggaagctaggctcgccctacaggagatagcggcggccggtgtggcacatagcttgcctgagctctaccttgactagctgccatgatcttgttgagcttatggtcagcgagggatgcgtgctcttgcgatgcgtgcacacctgcttgcgtcctggtagggcgcctgccgtgaagcatcactatacacatagcaaaagcctgaagtaaagcaatggatgatctgaattcaactgtgtataacccttctctgaatgaaaccatactgaaagcatgcttgtcttctcgtgatcgaccctacaaatacagatttatataagcatcaactgattaggtcgtcatagattagatacataaggacataggcaagaacagagaagcacaaggacgcacctgaacaaacaagtcaaaccgttgacttccatccgtcgtctggtttgcttgagtggatttatcacctttgttttctcgggcgtcatcgctgaggacactgagcatgcagccttcatcccacccaccacagtcacacgctcctcctgatttccacctctcaatcagaggtagtggctgtcctgaggttgatgtaccatggaagccattaggaagtacggcaagaacactggatgatgcacaactatcatccctcgtattaggatggaaatttcccaatgggcaagaacagtcggttggtgttgacatgcttcggctggaatgctgtgaggatgagtgacgagaagtttctggttcttgctgagacaccgcactaataaaagccgcaaactctctgctaacatgtgaatcacctgattcttcagaagatggtagctgctctgagccaacagaacaaattctctatgcaaatggtttttttctgcctggtagcatcttgattttcgatgtgaaaccctcattttcgccaacaatattataaacaagctgatctttcttgttccttattacctgccttgatccaagccccacctcttttcttagggtcttcaacaccaaacagagtgtatgtgctctccagatcattgttatcggagatgcccttccttctcacggtagccaccaggatatcagaaccacaagaaagcatgaaaaaaggcaggccattcttccacgctagctgcagaagcgcatgccttgttgttgttgaatctatatcttgctggaggtacctttcactgttcaggacctgaggaggctggtttgtattagtttctgttcggcaatttgaatttaccactgaatcaactgacctacgttgaacattctgcaaagcagatcctcccaagctcagagattgcttatcaatatggccaggcagatgacactttggaacaaatgaaggttgaattggaccagaagtggatgactgacgtggctttaatattggatctaacatcctcctcaatgggctgcgtctactgcctttgttgcctgatgacttatctccatttatcttatccacagaggtgcttgcttcaggttgtcgaggacatggtccatccttcaggcttgaacagcggttcactcgattcagtccagaaacaagatgtctatgtggtgacgcatccatatcactgaactttgcactgatccgaggagttctctcagaggcacccctggaaatttgcttttggttgcgattttcacctatagttacagcagcaccaacagaatcaccttgagtcccagttctgctggtgccaagctcttcagatgaatccatgataggaagtggacatgagtatggaattcgaggaaattcatggtgttgcccaatatcttttgagaaaccaacaggtgacaaactggcatttctttccatttccatcaccgcactagacactagagtctcaaaaacctcaccagtcacgccactgctctgctgaaaatcaccacatgcagaatcattgttatgtgaggtgaagaaactttggccaatgttatcatcatctgtaaaaagcctgcgcgaacaatgatggacggcctcctctatattccttgtagtctcctcatcatcaaccatttcatgtcgcatggaactcccagtggcagtaagaagagggtccgagagtggagatatgtttctgagattcaagtcaccgtatttgccagtgttctctggaaagtgttttccatgaacaggcaacaagttcaacactgcagaatttgggctaggtgaatatctggccttcccatggtatttatcctcaagatcactttgctgaaactccatagaacaatgctgatggtcattgagtgtaggagattgattgctttcaagagatttgctgctgggacttgcagatgactgggatggagaagagaatatcagggacctactagtattagatggagaggcaccatggctgctagaaaactcatgcttttgttggtgagaccacctggctaggaggccccactcgagaactccaacattcaatgccttgtcctgaagatggcctgatgtctctttacgctgcaaatatgaaggaacatttgacatatgcttgacaagctcatcaaccgtagtggcctttcgaccaggccatggttttgagcctttcaaggatccacccgcatctgcactccgaggttcccgttgccttcgaaacttctcatttttcacaactctgattctatcttcaaattttccatcaatgttcccaccgactactgcaatcttctcttttggcacttgtacagattgatcttgtgaatttcccctttgacgtccatcacgacctaatgtggcctttacattcctttctctgctaaactgtcctttcgttggcatctttttttatggtttaacatacgccaacaagcagagcttttcacttgattcaaattgaatcgtcaagtttcaacaggatactacacttccttgaacctgcaacttcaatattagcagaaaaaaactcagatatgtagcttctgatatttccaccagagcactaatgaacagaaagaaaatagcaggcagcaccacagaaccaacataactacagtattgcagtatctcaattcagaactaagtatttgtcggtggacaatggcatcattttgtctcccgggaatcctggatttatgaaacattatgtttctacatgtacttagtggggttgggagttggccaccgacagttttgacacaataatgttctaattaggatatgtcaataaccatgcaaacaagactgaaaaaaaaagggctcccactaatgataaaaggtgcaaataattatagatatttgccctgatgctataccgtgtgtggcttgtatataaaaatagtttgcacattgttaagggcccagccatccataaatagttcagtcagtcctgataaatgtatatcaactatggctatggggcatctttccccgtttccctcaagaaaaagggcacctttctccacttgattttgttgggtggcttacaaaatgaaaatttagccgtgcaagcctagctactcacaaaaaaattaaaggtctaactacaagcaagaggggaaaaaactaaagttagttgcccggcaaaaataaaataaaatctggagttgcatagacaacaaatattttaccatatggattaggttgaaaccattttttccctttgcaaattagcctacaaaatgcatcatcatcaacgatggtcgttatagcggcagaacgggggaagttggagaaaacttgctgaactgaataagatggaacaccagctgcggcattaaacccaacagaaacccaccactcttcagcatctctctccaatcgagccaaccaaccacattacccaaacattgaaacagaagaagaaaagaaaaaagcacacatacgacgaagtcacgaagataacataccaagatgctcccaagaaccacttcaagaacagtccccccagctcatcgagatcccatatggaggtcacgcacccgcagatccgccacctcccctacaaccagaacacagatcagtgaacctcgaccaagcagagaaagaatgccaccccaagaaagatgcgccaccttgggggataaagcgagagcgagatggaacgagagcgcgcagcagagtgggagcgaaagaaagcttcggaggtggactggactggatagagacctggagcacggcgacgcgcactcggtgggtggtagtagtagtagtagtaggattgggagtgaggcgcggtggtagctaggagcctcctacttcttctactactcctgtcccctctccgagaccccccaactggttaggtgggtggattggctttagg

SEQ ID NO: 61637 - DNA, 3509 bp, Oryza sativa
ttttataaaacatatgttggttaacatgtaaagtctgcatgatttcatctagctattggttgcactagatatgtcccctttaccaatatttaattatttattatacgcattggtgggttaggaatatgggttaagtttctcaatctatggacatttatgcatgttaaacagacaagctaccttggtattacgagtagtttggacactttcagtaaattgttgaaaagttttttggcaccaaaaagagaacagaccacattacagtttgaagaaaacaattcagcattatccttgtggacataaatgcaaattacaatgataaatggcaagcttctaaaaaattctttaggtaaaatgcacatgacaaaggtgtaaaaacaagcctatctttgtttaatataactaaataagcacaaatgacaaacaaagggacctacgcatgctctggagatttcttgcactgacaacgtattacatttcctgaatcaattttatcaccacaagttgcacaagctctatcctgcagtagttgaacaaaacaaaacaaaacaaagttacacatttaggtgtctctgtatggaaataaaaacaataatctggtaaaggcataatttattttaatttcattaggcagaaccagaatttaaagaacaattgaacaaacggtaagaaaataagaaaaaggaaaaaaatgggctaaaggcccaatgacacactatagagtatagattacccaggaatgaactggtttaaacaaacgctcccaccaaacactcacaccttgcctttgatcttatgaagtagggcttgttgggcctgtctcaacatgttggaagacccctactaccagattccccatgtaacaagattacaagaaaggcataatgagggtggactcttgactctagaaatcctaatccaagtgtgaaagttgattggaaggctgttatatatatgcatgcatatatatgcccgtcacaaagattaggccgacaagatgaaactaaggtgctatgcaggaaaccaacaaacacgtcctaagagcatgtccacacaaatgtaaaaaagaatcacccatagagatgtcgtgtgtactcaatgtggtaaacgctatcgcactggtagtttcatactttcatggcatgtttgaaaaagaaatggcccacataagtacccgtatattagatcaaacgaggtcagacattgtgaagcaccgggtgctaggtagtatactagctagtgcagaacaactgaacaagcacaagtgctactgctactactaccagctttacaaattaaactgggtgacattgcgcaacgattagaacagagcaatccccgcaaagtaagagaatagatagcctcataacaacaaaaagtaaaacacacatacaagggttccgcaaaatctatggaaccaaacagtaattagacccaaagctctgcaaagcggaatgcacgccctaccccaaaaacccctcttttctttctcacgcgacaaaatcggaccaaaatacccaaaagggggcgaactaggcgattgctactaacgcttatcgagagcaaagcagcacatacgcaaaacgcacacgcaaccaactattccaccccgcaaaacatcgcctgtagaaaaccttaataaagcaaccgcgatcgccagaaatgttgggggtaaaaaaaaaaactaaaaaagcagagtccgcccgatgatcaccttcatccgcgcaaccctccgtggcgcgtcgcggaggtcagcggcggcggcagcatccgccgccgcgaacggcggcggcggccgagcgggcccggggctagggtttcgcgcgcgcccacccaatggccgcgccgcgtgcgccattggatccctcggcgatcgccgcagagagaattgatgaaagtgggttttgtgcttcttgttcggtgcgtctctttgatatgaagagagagagggaaaaaggaaggagaagccgagaagggccttctcctccgggcccacctcgcagcttctgtttcgggaaatacacagtccacgcgacggggtcttccgacttccgagcctactggcgggtgggtcccaccgcgtgtgggaccgggatgtcattgtgtcgttgccccggcgcgtaaacgatgggcgcgtgtggttgtgtggaaggtaaggggccccacgttcccagttcgagcggtgggccccacatcaggcgtggtctggccggaccagttttggcaggggggaggagcgcatcggcccgtttatgatggacgatccgacggctggagattaatcttgggtggagacgcatcagaaggttacagaagcccgaaggcatcacctctgttgctcacggatttgaccgctgggctccacgcgaggaggtgcgttttgtctatatcgcacggtgaggatttttcatgcgttaggcccctttttctctcagagaagttggatgaaaatctggatatccgttgcatgttttttaaactgttaaatactattgacggagcgtggggctcctcaccgggagaccgcgcaggcccccctttgccggttcggccggggactcagggtgagattctaagctctctgtatgtggaaggttcgcgagaccggaaacacacaagactcgggcgatgtatacaggttcgggccgctgagaagcgtaataccctactcctgtgttgttgtgagatctgtgtaggaatgagctacaaagtatgagccagcctctcccttgttctgggttcccaatctcgaaaagtccagtctcccctctaagtgggcaaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgccgggagcagatgcgacgtggaatcgtggttgtccgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccatgactatcgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaataagtgcactgcactgcgttatatgcggcgtgacacgctcagccaaatcgcaataaatgtggttaggtgaggcctattgggctaacctaaccaatcccttggagcaaagacccaagaaggggtggggcgcctttgggctttgggtccaaggcgtgtgtcggccctaccctctttggggttgccaggccactcttcgcaattgtttcttccttaaaccttctactattatactct

SEQ ID NO: 61638 - DNA, 551 bp, Oryza sativa
aaagtgtgtccagtgtcctataaagactttatgttttccttttatctttaggaaagtttctttcttatcctacaaggactagtatctaccatgggtataaatatgtacacccgggatcattgtaaactatcttcacgatcaatacaattcggcgcatcgccaccttttaccttttctactttattttatcgtccggcaggacttggcacctgacgtggggctgcatcggtgttcgatctccggctaaggggtaagtccaatgttctgtcagcccaggcaattgtatcgtttatgtcggcgtcgttcaaggctgcatcagtacattcgacctcttggattgctctggtttagatgatatatttgcctacctatttatcatatgtctatgttaatctagtcttagcatatcaatttagctctatcggctgcttcttgttttagggtttctgccggtatcggctaaatcgcgttgctagattagattagcttagacatctaccaccctgaaaactcaatcaacggcttgattgtctagatattatgcttctttt

SEQ ID NO: 61639 - DNA, 6581 bp, Oryza sativa
catgggcaagccttgtattgacgcgtgcctgaaattttctataccgcgttgcgttgactgaatatccattgcagattcatcatgtactaatgctagttctcgagcttttgctgaggttttcccgccattttccaccgaacagacgatggtaagttaagtttgaatcgtggacagcttccacatatacgtgttatttgacataattttttttgtaataagcaaatatcctggagatttctcatttctcatggcatctagaactaaattagctcatgtaatcaatgaagaaaggactacgaacttgcatgtatttttcgcatcagtttctactgaaattagatcgagctcaaatctcatctagggggaaagagaaaaaggaacccggacacaagttcagctgtttagtgcggatggttttgacaaaatttcattcaaattaattaatggtcaaaacttgtcgcggttatgttcaagcaaacgacatcctggacatttcgcattccatccacagaatactctgaataaacaaaataactaaatctgaattctaaattattaatgcagggttaggttattgcagctaattttctctcccgtttctgttgtagttagatcaaactcaaatcttggaaattttgcatgctaacaaataccagctgtttccatgttgtcgtcttgttgctgcgtctgaataatctgaaatgtcaatatattcagctcgcaaataattaatccagtgtcgcctgatgttttccttcccttttccatgaataaacgatacaaagatttgttcaacttcaaggtgctgtcatagtctgaaactctgaacgagaattggattgggctgcatggattattggtattgatgggtcgttgacagagcaattgggcttttttgctgtcaccgaagagcccataggtccagtacctttccattctttttttttttttgcggggacctttccattcttctttattttatttctttttggcagatcagtctgacagggtctagaattttttttttttggtccatcaactttttgtgtgtttttacacccttttcctgtcgataattcaagaacaggaacagcgatcgcaattgttttagtttatgttttctttatgcttttaaaaatagaaatactacagaacattatcccttttgaaccggatgactaaataaccatccagttgaacatcttatccataccagtacactacatatgttggtcttatcgtatccctgtgattctcctttccctccactctctctctatctccctccctccctctctccctcccttctcccctcatctctctcacccctctctcaccctcatggctcaccagcggtgagcaccatacagccatccgtctgtgtagtcaacgatgatcagttatgtgctgtcgtggaagaccgactccacttgaggtggaggcattgcgggggcgattcttgaggtttctttgaggtggtggcgaatcggatcgacatgttttttgttggtttttttctgtgtgttttttaagcattttaagaggtgatttctcatgttagtttttctcattattttttgagttagctagccatattgaagaaatttgtgtgcctcctgtggggcgttgccgctgccgctgccacccctcccgccggaattggtggagggaagtgtgccgcccaccgctgccatctctcctcccaccgccgccgcccattgccgtcgacatctcccgccgcctccctcccgctgccacctcccgctgccttcctcccaccgccacctcgagagagatggtgtggtggagaaggagagagagaggagaggcacttgtgtggtggagggggagcagcagcagccgccgccacgcccgggagggagagcagccgccgaggagaaggaggcgagaggggagacggagaaccgatttttttatttataataattactcatccctaaattaaacaaatagtaattatggaccgatatttaccaatatgggaaggacgctaaggtgtgcagcgtccagctgtggacgctgttgtgaatcacgtccactttgggacgctgttgagaatagcgtccacaccatgatccctgatccaaccgtccagcgccatgtcaccgcttgggtcatctttaacccaaagttaattaggtgtcaccgcttgcactccactggcccggtcctgctctaactacggatgctctgacgaattattcactcgccgccgattaaggtttttactgcttatgtattatatattccactatatcttgtcatcgaccaatttatcgatgtgattcagtcattggctctagctagatttttactaacatggtacaaaagagcaatactcgactaatcatgtcctaatagattgtctcctgcatacttgtgtggtgttataaattagtattgagcacattttttttatagcatgtctcactcttgagcggaacaatgcatcaaccaagcaagcatctgaacatggcatgacctgatttctttttgtatgtaaaagaaacatgcatccatgagctgcaaaagttctgttaacaaaaaattgtcaacagagcagctgattctgttagcctctagtttcatgggaacttctatctgcaatttttgcagtagcgtgaatgcatttgctgaaacctcttcctggttacatccaatcatcaaataaatcattgccatagtcttttggggaattcgttgtgtaactttgtaagcaacgattgaacacaaaaagtgtactgagacttgcgtgcgggtgcgccacccacatgaatcaattttgctttgcttcaatttgctgcatatatgaatctgtacaagcctggctgcctggatcgaggccatggcggcagcagccttgtggcttgaggaggcggcctctatcggcgctctgcttgaagtaaacttccccggccaagtaacacggcgctgccggcgttcgagggcagtcgagagaagtctgggctctcgatttgggccgcagctggtgcctgatggacgctggacgtcgtttccggtagcgtccacggttggccgctatttgtgagagcgtccatacctggacgctgttagagatagcgtccttcctattttgtttaatagaagtaaacatttactaattatttaatttgatgattaatatttattataaataaaaaattggggacggagaaaagtaggcgaagagacgggacgtgagacagagagagagatgggtgggcagggggccgggatggataagaacgtgcggctcgggtcggttttacagggtatcggttttttagaaaaccggcacctataagatattataggtatctttttttttaaaataccatcacctattcctgttaccacaaaaatactagttcctaggtaggccccgcgccaactaaaaggtaccgaattttcaataaaaaccaccatctttctctgacaccagtataggtgcatgttctttttaaaaaccaacacctttttgatgataaaggtgccggttctttggattttggcgggcagatgggctcgtgggtggggaaaggcgctataggtaccgattttacctactctggcacctatagtgctgacagcgaattgatgttttgcagtagtgagatgttgtgtgtatatgggaggtaggatcaggtattattggtgtattatatatttatagataactattactccctccgttacagaatatatatagttttagagttggaaacggttattaagaaagtaggtagaattaaataagaaggggttgtgattggttgagaagtagagataggtaggaaaagtgaatggtggagggttgtgattgattgtaaagagaatgttggtggagaagctgttatattttagaacaaatcctaagtgctaaaagttattatattttaggatggagggagtatatgaattggctacaatattggttataaatgattttgagctagtaattgactatacataattaaacttgctatgatgaacccaaaacaaggttcattgttttgatacacccaatatacaactgatcactgaccaatcagtaataaaccaatgaacaaatcgaatacatcttatttaatggctaatgaaccacatgaagaaattaaacaaccctacatatctaggttcgctgctgctcccaaacatgtatttacagaaagatacacgacaacacacagagacttcctctctcaatatgactatttgtatatacggtgcttgtatgagtatatgcaatctgttgattgttcttcatcgatcatcaagcactgccaaatcagttaagatcagcccttgagtgacggatacctcttattcgtgcccttgcctgagaagaagaaacatatattaacaacaaattaattaattactggagaagtcaaaccaatatcgatttcacatgctctatctagatatagcttagctaggagagagaaaattcattttccccgaaaaaaaaaaggagagagaaaattcattagattgatagtttttgctcactttggctgcttgtcgtagtagccagcacctcccagctgctggccttggccgctgcttatgctgttatagtagtaggagtactggtctgcagtcttggacttgtaatctgaatattgctgcgcaggcactcttcctgtggtgcttttcgatgatcctgcagacgcagatggccgcacaaaattagtggtgtgcaaaaggagagcgtgaaaacacatgagaacactacgccagatcctcacacctctgacgggatacctgtgacgggcaaacgaattggtcagtagtgaccgttacctttgacgggttatacgggatgccgtcaccggtgaggcacctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagggagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggatttatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgtcgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgttttgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggtaacgatatcgatgtgttccttgaaccgataatcgatgacttcgaaaggctatggaatgagggcacacgaa

SEQ ID NO: 61640 - DNA, 7717 bp, Oryza sativa
  unsure (1)..(7717): unsure at all n locations
ccggccaagggggggtggcccacccccctcgggggtgccagaccaagtgttttattttttctccccccccctctagtcatgatactcctgatcccatgtcaccgacaactatctagcaatatccatattcatatagatgttaatgaatctaggtatatatatatatatatatatatatatatatatatatatatatatatatacatatatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtctagataagctaacatataagaaaggggcaatactagaaagtcttatataattaaccggatgaagtagtatatttcatgtgaaaactttctatatgaaagttgttgtaaaatataagataaatctgtttttaagtttataataattaaaactcaactaaacatacgttaatcccatatcattttacataaaacacttaatcttcatctttacccacatcgttttgtgttaaacacttatttttcatgaagaacaccacctagtattgcatatggatgggccgagatcttggttattgatgtttacggaccgagattattagattaaggcccattgaaacatatcctacgaagttcttttaacaccctctcctgaagaatacgtccatgtttccgcatgttgtcggcgaaaccagaaaatggcatccaatccatcaatcatcaattatgtacaagttctatgatctatcagcaaattcaaccatagcatattaacatggcttgaacacagctcatgccgatggaagtgtataatcacaaagaacgaacacaggcaggagtaatgaacaatgaaactgtaataaatacaccataactccacaagtgtggaaggttcactattgcagtgtcagtttctccatttgctcggcgtcaatcattcaagatttgcaaggatttgatgaccaacttgagtaaaacagcccaactacaaaagggcacagccagcaatgcatttaacttgagtaaaacaaatatcagaaacagtaattctctgtagtctgtaccctgcatttgctcagtcatagctgctctcgatttcttatgcactataaatatgaaacaatgtcagatttaggtgcacaagatagcagaaacacaagtaccaagctgagtgaaatggcaagtggagaggaaggaaacacaagagttctccaatgcagtgaacttatatatatcaccaaagatgtttgatggcattcggcaagtttccatgattcatcattgaataacccgagtaaacctgcttgtccaggcaactacaacttttgaacaccacagtggtaaaaaccagatatactaaccacctcactaaattagttaaacagtgccttcggttgggatttgacaagttgagccctccaaagcaaaggtaaactgggaaggagatagtgacctgacctccagagttcagttcaatagtttaaaaacaactgatagcaaggtccatctgctagaagaggcctcgctggcgagcaagcgcgatcaggtccataggaatggcaggagtgctatcccttgtgggaatcatgagaactgccttgtacagaggatcaccatccttgttctccacttcagaggtggtgcgatctgggcttggggttggggtcctgatcttggcaccccacctcacctttcttgtgcaaaccctaggcctgcgccgctgcttgacaatatcgctcatctcatcgtctcggttgtcctctgaggagctgcatccaggggtggtgcgcgacacggctgctggtgatggcaatggtgctggtgctggggactgggactgggtgaaggggagggtgcacatggtgatggcgtcctcttgagttgtgggaggtgtgctgaagacctcaccatcatcaccaccattgaggaatgaggagtgggcaaggagttcttcctgggaagcggagatgtcgccacactccaacaccactgagtccatagctgatttgataaaacccaaattgcaacactatcactatcaaatttcctttaacttcctttaactcaaaacaccctgaaattgccagataacttctccctccctgaaatgaatgcagatgcaaaaagatcagtactaacaaatttttatttgcaattaggattaaccatttgtcaaagaacaactactgattaacaccccaaaccgagcacaatatcttcattgacccaaatggaatgcagacaaaagtagtaaaatgggtactactgcattaatttaacagagctattgcccagggtttagatatgatattctcactaatcacatgtatggaatatcttccagtcctacatgaacactgacatgaagctcgtacttcatcggtttcataatgtaagtcattctagcattttccacatttcattaacatcaatatgaatgtggaaaatgctagaatgacttacattgtgatacggagggaatagtaagttaacatcaagaaataaacataacagagaagccagtcaaaactcaattaaattttctactttagcactaaacaaagaagccctggaattgactattatacctcaacaaataaccaagatcacatatccctgggcatgagacaggggcgaatccaacttgggacatgggggttcagttgaacccccaaacttttggggggaacaaacaataaactgttgttacttgtattaaggtaagggtctgaaattaagagaagagcttcttccagatctagaagagaagctagggttaacgaacgcaggcaaattccagacaaaagtagtcccggtgggagagagagatgagttctgagaaagaggatatgtggatgctcacctgcaggatcccctcctctcccctgctctgctcgccgcctcccctgttcagccgcgagatggcgcaaggagcggaggagccgagacgggagattttctttcagctttgctattttgcagttgcctgaaaaattgcaatccgtcaccgtcagccgatttgtgggccattagatttctgtcaagattcgtgcgctattgggcttggttgtggatgcgcgttttgtaatgggctgcatccctttggcccgctaaccatttgttttttttttttccctcaccaacagctagagccagacctacaccgagcaagccggtgatttgggtcgctgggcagccatgcgagcgaggccctgtgtagattccggcgaaaatttttttaccatgttacatcgaacgtttaaatgtctgcataaaatattaaatataggctaaaaaataactaattatacagattgtaactaatttatgagatgaatattttaaacctaattgctccatgatttgacaatatggtgctacagtaaatatttgctaatgacggattaattaggcttaataaatttgtctcgtggtttactgacggattctgttattagtattttttgttagtgcccaaacactccatgtgacaccccatataatattcaatatgacatgcaaaaaactttacacctttggatttaaacaccccctggactagcagcggtggtgccagcgaactagcagcggcggtcgagactttgtttttcttagcgtcttctcaggtacaaatcgatgaatcgatctcttttgtttatgtggatctgatagaagttcaaatcgttcctcctctccgcgctttgtatgcgggaccgcaccctctagttaccaacatgtctcttctcctctcccattgtcatgcacactactgttatggttgtcgtttagatcggatgtgtcgggcctgcagtgactcaagaaggcaggagccgacccaacgaagagcggagacgctagatctgagctccttgctggatcctcaattgtcggagggaaaatagaaatagagagagagacttagtgtgtggagtggttactgagtaatcggacttgtagatggatagaatagggtggtccaaaataaaatgtaaataatggttaaatagtgacataatatgaaaacttttaataatacatagtataaactatatttttttttctctaacaccgttaaagatgagacgtccattacccgatagtgtcgtcaaactccattataccataagcccatgtaaggcttatttggaaattagcaaattagaaatttccagttcacatgtgcttcgagttttttttttaaggaatataaactatttgccactcttataggtggtaattaaggatttatcattgagctcatgtgtcattgatacatgaaggcccatatgtcgtaaaatgtgagaggtaaaagtggcaaaaagtaaaatgccccctcgtgtgtgttttaggccatgtttttttctcccacaaaagttggatggaaatttagatattcgtgaaacgtttttcaatctgctaaacggtgtgtttcatgtgaaaactttttatatgaaatttgccctaaaatattacataaatatatttcaagtctgtaatatgttagtactacctcgttgttatatttgatctcatgagtttcaaagcctatctaaaggtctgtttcgggagcttaagattctgaaaagcagctggttggtaaacatcttccgagagagaatatggaaaagttgggtttcacagcttctcagaatctggaccaaaagctgaactgttagaggaaacttctgattctgagagaagctgtagtagctagaagctccccaaacatgccctaagggcctgtttaattggaaaaaaaatttgcccctgcatatcatatcagatatatgtggacataaatttgaagtattaaacgtagtctaataacaaaatatattactgattccgccatgaaactgcatgacgaatttattaagcctaattaatccgtcattaacaaatatctatcgtctcgtaattttctgacaaactgcgtaatttttttttctccctttaaatactccagccttaaattttttttttagaactaaacattccctaagtaataaggggaaaacaacccgctcgcgatagtccggtgtccggacgagaccgatccaaaacaccagtagaccaccagtagtagtccaccatcccgccggcgcgaccgccttcggcgctttcgtagggggcaagctgcttgcgcgcggcagaggcctctcctctcctcccttttaagggccttggcgtcgcggcgcgatccaaaccgccactatcccccaatcacaccgacaacccgatcgccgtatcgccgccctcgccgttccgctccgcctcccgcaccgaaaccctcgccggcggcggcagccgctacgccgagatgctcgcgccgctcccgcgcctgacgagcgcgctccgcggccactacgacgccgaccaggcctacctcctccgcaagtccgcgctccaatccctcaagctcccgaggtttatccctctctctctctccccttgccgtccccaaaatcccaatcgccgcggggagaacctaacgatttcgcctccgcaggccgcgcgacgagtgggagctcgcacggaagatcgtccccgactgggacgatggtaaacgcctccaaaaccctcgactatcgtgttgctgcgtctgctgcgcgcgagcgcttctgattttttccttttttgatacaataactggttgcgattgcccccttgtgttgcagcgcccagtgatgtgcgccaggcgtacaagcagttcctcggtgccgtggtggagttgttgaatggggaggtcgtgtctgaagagcttcaggaagttgcccctgctgtgtacgccttgtttgctggcgatgatacgcagtctaatctcgctgacaatgtccttcgcagaaggtaatgacacaattgttatggttcgaatttgtatgttcaattgatgatttcatgtaaatgctttggatatcccagtacttaagatgtgcctatctcctcaggaatgaattggagaaccttgtgggttacagtgtgcaagactctgttttaaagaagctagctcagttagctcagatgctctgttctctccaacgggcaaggggccatgaacttgttcagataaatgcagatgaaagtattacaagtgaatttggagcaaactttgatttcaaaccaccttctcgtttcattgttgatgtttcccttgatgatgacctacccttaggaagtggtgtattgagctctaaacctgctgaacatgatcaatacgatgccagcagcgcatccgtaagtcataattcagtttctcctgggggttatgtaaatttgaggtggctaaaggatcagtgtgatttgataactagaagtggtggctcagttctctcaggagatgaacttgcaaaggctttgtgcagagtgctcctatctaataaagctggcgatgaggtttgcaatgctgtggagtaaactgcttttagtctttccttttgttgctataataatctaatagcaccacttcgcagatagctggtgaactgttggatcttgttggtgatgctgcttttgaaacagttcaggatctcctttcggtaagagcggaaggccattttattttccatgtacagtttattttgcatgttgttcttcatacatgatacatggataagataaccaaaagaaagattatgagatgacctcaattgttataacttgtattgatatcagctagatgttagtatttctgtatatgccacttagtcctgtattctgcaacctatctaggaagtagggcatatgtaccagactaattccaggactcactttactggtacaaatcacacaataagatcactaaaacctcctagttggccatatatatccaaagtctatggtgtagccaacattcagaactgtcttggctctgtttaagttcaaattttgactgcttgtctttttgcggaaaatttataaatacttgagcatatattatattactgaagtgtgtagcgccataaatataatcatacaactttcatccatcataaatataatcatttaaaattaatctgtcataaaagtgatatggccgtagtcaacaatgtcagttatgtgagaaacggagggaatagtgaacacttagtacaacaagaagattatccatgtcccaaatagtaagtcgagtgctagaggactaccttaagccttattggtgctgttttattgtggctacctagcgataccatgaaaaggagccacacagtaaatgaactgttcttatgaggatatgcacacatgagaaatatcgaaacaaaagggggtggacttcagtgaattttggactctgggacatacaaatgtaatgctggatttctaatactatgtgcgtgtcaaaaagtactttatcaggatctgatgctttattgatcattaggaaatatgatagtgatcggtgagtggtcactggtgcaattatttcctatgggctcaccctgatttctcagcacatttccatatttagagttaaatatctcgtttcaagattgcaaagttccttatttatggttcagttcattaatacatagtggatttcatttgtttatcatgataatattttttttttatttttggtctgccatatgataatgtaatcaaacatgatcatgtcatgccctgcagcataggaaagagctagtggatgctctgcgggtgccagatcgtntctaanggccag

SEQ ID NO: 61641 - DNA, 1047 bp, Oryza sativa
catgggaactcttgaagcagttagggaccagctacatgaggccaaggagctcgccaaaaagacagagaaggaattaagggaccgttttgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaatgtgttttgtagaccgcaaaatcaaatctcaagctcaatttgacgtcctagttagtaagatcaagaggcttgaaggagcaagagatgaagtcgctaatgtcgctataccactcgtccaagctatgttcctcaataacagtggtccgagtgtactcgacgcaaccgaaatcttagacaagctgagagttgctccggatgtatatttcaagaatatcaagaaagctggaagtatgggagctagcacggcattggcgatgaccaaatccttgtacccgaggattgaaattgacgccattgatggctttgcagacaggacaagcgtagaggctgctcttgatcttatcagcaatgctcaaaatgcggctgacaagattgcaagtgacgtcgtagatcaattccgcaacaccgatcttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaaatcaaacaaggcaatgataaaccaaggaagcaaattgaattgat

SEQ ID NO: 61642 - DNA, 646 bp, Oryza sativa
tcttcctcctctctccccaactcccatgtattcatctctctcccatctcctttgtcctctctccaagcgtgagtgaggaggggtggtgcacagcgactgccatctaaaatgagaccaccggttttaacagttgagggacccgttgtatctggttttccggttaaaggacgaaaatcggattcgttgataagttaagagacctcagataaacttattccttaattagtcacatagctccgctggcccataaaggaaaaggcccaaggctcattcaaagctcctacccaacccaagtcacctcgcctttcccctctcaaaaaagggaaaaaggtcgcctcgcctcacatccacccgcgacttcctcctcgcccaccaccgccaccagccctccctccccctcatcgccgcctgcgactacgccgatattatgtacctcatcgacgtcctcaccctcaccctcggccgccgcaggggcgccgccgcgcggctccatccggtcgcccggtacgccagcaccgccgactacctggattcgtcctgcgatggactccttctcatctcccggaacaccggccccccgcaatactccatctgtaacccgaccacgcgccaattcggtgacctcccgctgatctccggattcatg

SEQ ID NO: 61643 - DNA, 823 bp, Oryza sativa
agtttcgcttgggatgcgttgcgcagaacgaacaaaccatcttctgaaatccaccgagatcaatagacagggtgatgtttatattggtagaaatacaagtaatcataaaagcagtaaatttggatatgccaaatttaacagaggcatcgaacgattgaacatataagaatatcatccaaagatgttcaactgttaccgcaagaacacggcaataaccttctttttagtgttgtgcggaaatatgttgaacggttaattgacaagcaaggattaaccttacttataggcctgttaatttgccattatgaaacgtgataaagacctagtaaaccaaagagaattacccctacattacgaacttacgattggtggcgtgcgtatgactcgaaatggtcgagcagcttttgttggagctctgaaacaaaggcaggacaacttgtggatagtacacgtcaaaattggaagtttggttgaaattgaaattggaatgaattggaagtttggttgaaattgaaattggaatgatgtgatgtaaaagttggaagtttgtatgtgtgtggaaagttttgatatgatggaaaagttgaaagtttgaagaaaaaatttgaaattaaacaagggcctgatgagaggtctgcttagctcatgcctgcgtcagtggaccatccctgacgaccttccaatcttcgccactactcgctgcatggtgcagatcatggtgacaagaaaccagaaacaaaaacggcggtaggaatctgcaagtcttgtgccaatggttcacattatcaatgtacaccgacagcagcgcacacagcctcaagtt

SEQ ID NO: 61644 - DNA, 792 bp, Oryza sativa
tcaacttgtacatcaaggaaataccttgagacttagtcggttacgactgtattttatctgtatctgcatattccgttagggatatagattatcttttgtaacacggactctttcccatatataaggggggtccgggtgcctctaggggcatgtgttgattatccccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggtccgtcaagcttttcgccgatcagtgcaatgggttctgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccgtctcaatcgagttggcttcaaaccactcgggcgggatcgcatcttctccaatgtcaccagatcaagatgatgaggcttacccaccgatcctgatgaagctccccgacgatttggcggccgtctccatcacgacagcgtctccatcccgtaggcctagacggaagtcggcttcaacaccgatttcgcctagcttcagggaagtcggcgttatcctc

SEQ ID NO: 61645 - DNA, 39818 bp, Oryza sativa
caatataccgagtaaattgcatcgttggtacacgaacttgttaggtgggtttaatctagtacacggacttgtaaaatgctcattttggtgcataaacctgtctggtgcgtgcggaggaaggcgaaaatgacactacattgctaatcttattgatttagggcatatatctgagaaggttgctattagatatacacctcttcaataaaaaatagaatatgatatagtgatactagaaaatgattaaaaaaacgagcaatggtataaaggttagaaatatatgaaattcatcatttccatggtgaagaataaagtagagaccaaatttataaatattgaatgtcctatgcatactcactacacgtgtgtatgccacatcctaatcaacatcacttcataaaattaacattatcaagttattttggttatcattcgcacgaactagacaagttcgtgtactgaaacgagcattttacaagtttatgtactaaattgtacctacctaataagtttgtgtaccaccaatacaatttactcgcaatataccattacccttcttggggagccactgatggaagccagcgcaatccttattgcagaagcgacaggtcatgacagttaggtgtggcgggagacaggtcatgacagttaggtgtgacagttagctaatatgtgtttttagccatatgattttgtggcatttctttgcatgggtggctggcaggtcagcaaagtggctgccctacttgcacctatagcatcaagtgggatgcccacgaccctgcaggtgtgcagccgtgtatgtatgaacttgaacatgtcggattgttgaagcgactagttagcatgcacgtgcaaggcacgttttgacatatactttactaacgattacaaaagtagagcaatgagtgtggccattttctatgcagtaccctccatatgaattctccgtaataacagagtttcatttctacgcttccaagtaaattcttcatgataaagagagtttcgtagtcactccattctaaactccaacaagatataaaatttttctcgatttccgttagtatgttctttaaactgctaaacagtgtgtttcgtgcgaaaactttctacataaaagttgttataaaaaaataaataaatccattttttaaattttttataattaaattttaattaatcatatgctaatgacttgtcttgttttggttgcgcatttaatcttcatccttgttgaagaatcgaatgggacctaaggtttcatacaaagatgcatccacgccaaagaatcacatcatcatggttaagaatgcatcccccacatcatcatatcttatggttaagaatgtaaactgttcaggggaaacgggtgttgtcagtgtgttggtaaacatgaaaatcaggaagcatagagcataaaggtttgagtttcaacaaagttagctcaataattttgctataacagtgagcgtaagcttcaatttttcatgtgaacttatacagtcaattggatgataggcagttaaacaaattatccatgccgggattagattaaaaaaatcaccatatactgctctgtctcactgcaatgattagtcatacaatatatgatagatgcatttttcacacataagtaccagcaaatattacagtggaactggccgaagtgctaaacatatcgtgcatgtcagattatgatgcattctaatatgataggaagtgaacatatgagtagtaaacttgcttgcatatgcctacaatgttgccactgagttcagggaaaaataaacgtttcagttaggatgaaatgatcagaaaaaaaaaaccctaaacaaaggaaagatcaacaaacattgaatgttggaacggtgttgcccactgtaggttgttatgctttctcgacctcaccaaatagacctagaacgtaacaatgctttgctccctatccaggaaagccagagaagtaatataatccaacatctctaattgtgccaagagattgccttggacctggcacacatggaaggatagtaaatggagtattaatccctacagatataggttgtttgcagcaattgaagcctcacatcatactacatttgaagtcccaccgacctacatatgtaatcacagccagagaaagataaaaaggctaaaataataataagcaacacttgcttaatagaccgcagacactggagtttccaaacatggtagcttccttacttgaaacaacatctacatgaactaaaattgaaagttctaacaaagagaattgttcaagacttgaattgtatacctgtagaatgattgagtgctcacaagtcataggagagtcactatacaatttaattaatacctgcaggatatagtactatagtagatcatatgctttcgagacaattacttctaaaagcagagagaagatatcgatactttctgaacattatgagatatataagatatgtttcttaacatagatagatttctccaagtgagccaccatttaaccttgagtatcaatcaatctacacaacgcattgtataagtcagcctaagaacttaggagattaacatgccctaaaattaatggagagataactaccgtagcattacttttttctacaaaagaataacaaatatgaccttcttttctcagcatcagcactacacagaacaaaaatagtttgaagaaaataggtaaaacaataaatctgatctcctgttctataagctgaattcacccaaaattactgcaaaagatgaacatcatcatcatctagtgcattcagtataagtttcattattcaaaaaaaagagagataaagatgtaaatatttgtacaatatacaatttaaatgataatcgtactgaaattcaaaagaccacaatttcatcatttatgttcccacacctaaaaaaacaaattatcagatttttcaaatctgctagctcatattatgcttaaagtgatacaatattgaacaaagatccaatgaaatgagttgtgcatgcccaatatgttgtggcaacacactgctacattcaagcagtaatattttatttagaagagcaaagaacaggggagactgggaaattttcatagcatgaaactttgtaacacttgagatgcaccctaaattttttctcactaaaaaaagtttcagtgtatcatctcagctctgaaattaaccaatacttgatgttaaattaacatacctgtgtaagcatcagaaagcataaaagctatggtagttattcattcatgtatttctagagcatttatttagagcaggaaaagtgcccatatgttatttaattagcatttcacattttcaaaattcaaatttttagtatcgaattacaaaatataagcacataatcttactgtcatcaccaaagtgttcctctccacttaactttttgtatataccagtatagtgtggtgcaattgcagtaaatagttttattgttagcaagctaaagcagaggatgcaacagcaattattttattatagagccagaagccacaatataattctaaaacctaatttggacacaatgtatttttgctctagcataaagaggatgaacaattcacctcattgtcgatattgttgtagtccactcatttccattagacaaaccaattgaatggcattcattcggttcctgtgacaccacaatcagaatgtgggcatgtatgtggttttagtttaattcagcagagaggaaaatcatatgtatacattaccagaagttagcaattgaagaccttccaaaatctaagatgaaaaccaatgggtacatctgagatgcaatccaatgggtaaatctgagattaaaaaatgaaagttaatcagagcccattatccatatcaaaaccattctggactttggtgaagttataaaggaaaatataatttcagctggaatccagcaatatattataaggaatgacatgcatcttttttattatgattgacagagggagaaatcagtgtacgatattgtatacttaactaaaaatcaaaggtcagctaattaaaaaatataaccaaaacattcatgcagatttataccgttggactcaatacttcagcattttggtaatcagaatctgggtatgtatactggctaaatgaaatctgagggatcaagcggactgtaaacctccacatgaaatctgccattggcttacaacaaattcagatagaaatgaaatcagaataatatttgtgcttaccttccaaatccatcttgaaatcagcataatatttgtgcttaccttccaaatccatctcttctaacatcagtgctttcagaatgtgtctggtaggagagctcttttgatattaatgtagaaattgataatatcccagaagagaattggtagcccaaactgagtctgctaacattgattcgtagcccaaactgagtctcctaccagtgagaatcaatagcccacacctttcagaaacccgctgcatatgaaagtctaaatctcacaacaaatgagcaagttctgacatcgatgcccaatcaacatcgaaggtatacacaaaattgcagctaactcatggggaatagctcaggaccagtaggcatggggactggggagtctcgtgaatcccttcgacaccaggcacccctccacagcgccacccctcatccacttcgtcagcgctagagggttttgtcacatcatgagacagcagtggcagcggaaaagcggaacagcgattcggccgagggcgaccggcgcgacatcttcacatggtggcggcggagagcaacctaggatgtggcagagttggatgcggtgatgagggggcgcaacggggtggacgcctcatgacgatggtggcgcagtggaggcggtgatgggtccgacgtcccagcattagggaaggtccctcacaaggcaccatcgtgagacaacggcggcggcagcggcggcaagggaagagtgaggacgacagtgggggatcggcggaggcgacggaggtgggaaaggagctccgtgtcgcagcgtggcacacgggatttggaggatgcggggcagcggtaggagtcatcaaggagcgagcgcgcagagttatcgtgcgggggcgagggtgtgggcggaaagtgtggtggagaggataaggtcgccgaggatggaatcggattgatggatgagattatttggcttaacggatggatggtagggattgatctagttgatttggcctgtaggattggaggggtacaactcctcctttttatattagtatagatgtggggtgctcacgcgatgtgggagcctcatgaactctgtttgtgctgtcatgaaggacaaagagttcccctagttcaacatgggtgttggtagaagctgctatcctgcaaatagtgacacactgctggtagcggctgatttttctccctgatttttctcccttgatattgagttgacggggttaaattggactattttccttatctgaaccggtctttgtacttgaaggggtagaatactgtctcacaggggattaagtagactatttcctcgtttaacaaagtatcaatattctgatccacgtaggcacctgaactgaccggctgatggggcttatcacataagggttaagtacacatgttgcagagggaacaaaagggaaaaatattgtactcttgagttaaatcatgttatgtctgcattcagttccttttttttacttcggtgttaattatagtactcatattgcagatcatatattttactagaggacctttcctttttgttttcaatttcaatcctgacgcctcctatcagctctattctgttggtgtggatgaagctggtgaatatcaggtaactaatgctgtttgtatgaacttattcttttgtaaatatgcaagtggcaggcacatataaaaatgttggagcacctgacactttgataaataaaatgaatatgtaaaaatgtaaaaactactcgtagtgatatttttaccaaaatactctctttttttttaccaaaatactgcaggtgaatttctacttttgtttctcctcactagttttcggtttaaaaatgtattttttttcctcgaaaaagcaggagagctgcatttcatttcactaaggggaagaaaaaaacaatacaaaaacacaacacaaagaaaagcaaaaaaaaaaaaaaaaattacaaagtaggagtacccgagccctcctaccgagacccacacatactagactacccggggaacttagttgcctaggttagccgtcccactcaggagcttttgaaggcaagaagctccagcaacaccccaaagatggccctcgttttctatcacttgcaagactgttgctactctaggattggcgtcgttgaaaatgcagtcgttgcggtgcttccaaatctcccaagctagtaaggttaccaaggacttgatccctttcctcacctccttcagccggttcttggttgcttggctccaccacctcagaaagcggtcggtagagggctgaggcgcagcctcggctaaccctagtctcaagaagattgccatccaaacttggcgagaaaaaacacaagagatcaaaatgtgttggatggattcttcactttgatcacaaaggggacagatcactgagtgttgcagcccatttcaaaaatgtaattacatagggtgacaagagaaactctatcaactcttaattttctacttcttgtacttcttggttttgtgcttcatattttttgttatttgcacccaaatgataatttgctgtttacatttgtcagttgaaactaattgacatgggatagaagtgtgtgaaaggactaaatgcttataatctaggcttgatgcatacatcagaaaactttgccatgatagttaatgacttgatgctttaaatcctgaacagtttgtttcatgcctcgagaaaatcttgaaatttttattagctcattactaatgctgagaataagaacaactattagattcttgaagtacttgagtctgaatttattgaacaattgcgggtgtggattttcagaaccagcaatggcatgtattttatatctgtttgctctttagagttgtgttcccagcactgaagttattgtgcttctatcatttggccagcttatattgaacacagatgaaactaaatatggtggacgtggggagctgacgagcaatcaatatatgaaaagaaccagtgacaataggtgctgtttttcagttttcatatgatatacattgtgagtttattattttatctggaggtatccatattttgcaatcaaataagcattgttactttcatatagggttggtggttgccgcaactccttggaattgacattaccatctaggagtgctcaggtgggtgggtgtaaagatatgtgatgccagaactccttggagttggttgttgccacagctccattacaacagatatgcttctcttttaaaagaatacacacgcttgcaggtattcaagttggtccgaattttgagaatttagattctcaaggatgagcattgttgatagaccaagcaattcgggtcctcagaagacggaacttctctgttaatatctgaactcttgcaaacttaaagattcgcatggcaaaaactgaggtaatgggtacttgcggtcttttccccatgtaattatgatctgcattgataggtttattaacaatgcattttactgcaaacctcatcccagtgacatggaaactcacttatgttttcatatgccctttttgactgaatgcaattctgaccttagctttgtcttaaagagaataaaagaaagtaaaacatttttttttcatattcgagcatatttatcctatcgtccacagactggagatgctttgcacagtgcaatggtaggtatgtcaaaaaattttgcacatgcagactcctagacagacaaaaaaaatacaactagaacagttcacgtcagttacacacttaactacatgactgctacctccgtctcaaaataagtgcactcgtgggaatacgtgtccaacatttgaccgtccgtcttatttgaaaaaaattataaagaaattttaaaaaattagtcgcacataaagtaatattcatgttttatcatctaataacaataaaaatactaatcataaaagaaaatcaaataagacgaacgatcaaacgttggacatgaatagtgcaaaaccgcacttattttgggacggagggagtatagtcccgttcttttctctaacatgagttggagattaagattttcgtggcacgcgtttcaaactgctaaatggtgtgtttcgtgcgaaaactttctatatgaaagttgccctaaaatatcatattaatctatttttcaagtttgtaataattaaaactcaattaattatacgctaataccaccccgttatacgtaataaacataatcttcatcttaatcttcaggggaaaagaacaccaccgtagtgagaggatccttcaggtatgaatgtccatgcagatgcagattgttgggttgatgttcgacgtctctgatttgaccttctgttgtggtacaatatgaagtattgcagtatttatttagacctcaaattgcctgttctgctcactcgtgtaccttgattccatgcctagtgtgggcgtggcaccgtggctagtttaatcaaggatgctatagagtatatagactcatagctccacagtgaaacgctcataaggagtgctattgaaactaataaggctttgtttgttccagctgggaacctcgtaaggagtgctattgaaactaataaggcttcgtttattccagctggttcccagctcctttgccctcattttctctgtgcacgttttccaaactgctaaatggtgtttttttttgcaaaagtttatatatgaaagttgcttaaaaaaatcatattggtccaattttttttaaaaaataactaatacttaattaatcatgcgctaatggatcgttccgttttcggtgcgtactgttcgtgttgggtacacaggctaacgaacgtagcgtaaatataggccaacttgtcatccacaccagaatagatagcgctgtccaaagaaacctgttagagcatcttcaatagattggctattttagactctccaaatgcccatttagccaattggccaaaaatttagagtcatatttgccttttactctaacagtctctccatcccactctccaatctttcagtgggtcccacatgttagtctcttacttttttttccttccctctatcttccccttttcgtgagccgccggcgtgcggacgaggcgtccgtgggaggtggtcgacggagggggccgccgtgcagggacgaggagtcagacggcgctagagatgcgagagacgtggcggcggacacgatgatgtcggcggacgcggtgacgttggcggcatcgctggccgggccttctctagcgcgcacgagcgagcacctccggaggccggatatgccgcccacggcgcctcccaccaccagcgcgcttctctccgtcgccgtgcacgcgggcccgctcggcaccggacctgccacgcgcggccctcccggcgccagatccgccgtcgttgtcatcgagccgccgccaccactcctcctcgtcgtcgatgaactaccccttctcgtcgccgagccgccgctgccactcatcttcctcctcgtcgttgacgagccgccgccgccgccgccgccgccgctgccgctcatcttcctcgtcatcggcgagccgccgtcgccgctcccgcttcctgcatcctccgctcgggctgagacgaggccggcaatggatgccaccaccgctgcatgcgctcggcaatggaggatgtgcgtggagagagagggaaaccggcgtgggtcccctggatagctagccggcttggctggccaagtttggccagtgagggaggcagtttagctagtcaaatggcttagccattcaaatagctagtctgttggagtacaatttttgttcaaaattaccaaattttaacttgtaaagtgagatagcaatgctcttggagatgctcttagtggaggaaggcctcctatggataagaggtatagagctaaagaatactacaactctggtacaagcagacaatgataagttcgaaagtaagctgtggtacaaaaagtttttgttttggtaagaacatataactttaacagcatatggcatgaatatctaattcaaaacttctttgacctgccaagtttctccttttgtgatcttcagattatgtacaaatacagcgaattttgactgtttgagtcctacaatagcgttaacaagttgtacttaagttcagcttgtttcaccatctccggtttgcggtgcctttttaagcttcatatgttgcagctgcgatgtagaatgttttctcatatgtgctaccattaattttgacattttccgcaggcccaattttgttgcattgccttcttgacattatttcagttttgtgcaatggtacttttgcattgattttggtgctacatttctacccaatgttgttttatggtactacctataaatgtgccgtcagctgtaagaaacttctccactaagtaaaagaaaagacgcgaatattagggaagaacctaatataaaaaaaaattagaagggctcagctgtaaaaaacttctccactaagtaaaagaaaagacacgaatattagggaagaacctaatataaaacaaaatagaaggggtaaggcttcgaacccaggtcgtctagcctaccatcttgtggagctagccggaagacccctgggtgtttcgagtaaaagaaaagaaaaaactcacaactgttaatatactctcctctctctctctactttgttcttttgaactccataatttagagaaattctatgccgaagtttctatcagcaagatttatgtttcctttgaactatgttcaatttcctttatcaccatgctctttgatatttatggttgctcttctgggagtgggattaaattcatatggaaatggaacattcatattgtaccatattgttagattaatcctaccaactcctgcgagctggcctccccctatgtatgtataaaaggaggaccagtgtctctaagaagaaggttctaagttacattcaagccacatccaagggtgagtgcaccccttggcgttcaaaacatctaagaacacattgtaaacttcatcatttaacatttaatgaaaaacacaggagtagagcatgctctcaagcggcctgaacctatatatacatttcaacattctctcgcgtgaccctaacacaagctttggggatggggggggggtgggggtttgggggtggggttataggtggtggtggtgctgttaaaaatgtgaaatatgtccggccaagcagcgccgcaaccccatcgcctgtctcatctcgttctgtgacttccatccagacgcacgcacgccccatcctctccttgcttgatccgtgcacctcaaggaacaagcgctgctgttgccccacacgctggcccctcggaggacagcaattcccatgattacaatggcattagctctgttacagcgagcgcctcccctggttggaagtgagggttgttttggcttgtaaccatatcaaaagtttggtagtgctgtattgttgcaactcatttaaattggcaaggtttggtctcgattcaaatagctagcaagtactatttagaactacttcctctgttttacaatataagtcattctaacattttccacattcttagtgatgttaatgaatctaaattgatatatatgtctagattcattaacatcaatatgaatgtggaaaatgctagaatgacttacattatgaaatggagggagtacctaataattggtagggcaagaatcggccttaatggcttaatccaatcaggccatgaacctctcttttctgaaaatggcatggcactgtttatttggccttcaatatgatcagagtttatcacacgcactgtttccgatttgttccagtgcttgcacttcagcggtgtttgtctcagattctttgtttatgggaaagcagaaagatggtgaacttagctatcaatgcaaacggaacacatattagaacatgatgaagggaattgtgaagcagcgtctctctccagcacgatacaaaacacctgatcatgctttccacgcaatgcaaaaaccaaaatttcactactacagatgttggcccccgttttataacaccggaaaccacatatattggtacacacattcatagccagtacaaaacaaatatcaaaatgaatttagtcaaagaattaggacacgcctagggatcgggcgctcgatccggaggacaaaaaatcgggcgcccgtcccagccatcccatccagagagaacatcagagtcctcacagctctgaattaggacaacatgcacgcacgaaaatattatttgtagtacttgcatgcacaaaacaaattaccttttctctcaaattttttaaatgtgtcaagttttttaaacaaactttaaactacatgttctctcaaattacttatccaattcatgatccaattgcaccactaaattcattgtaattaaatctttaaaacaagactaaacatggctataatctgatgaaaaaaatgtttagctttattaatgaattgtttttaatgttgcacctatatcatttaaatgtttcatgtagtattcatatgatgtttcactttttaatttgtaataatttgtaaatgttgcacatgttcttctaggaatgttttagcatgtactttataatattttaataattataactccaccaagtagatcggaatcgtttcactaagtagatcgaaaatgtttcagtcttgtaaaaaaagctgaaacccaaccaaatcacctcataaaacattttactataacgtagtgaaacaacagtttccgaaagaaccagacgatgtttcaccctatataaaaataatgtttcagcaaatagtgaatagatgtttcaattattaaagacagtgaaacgtggtcagatcgctagatgaaacaatttggttcaatgtaatccattgcaacacttaaaccccgtgtacatcaacaaaacattttcagcttttcaaacgattgaaacattttcgatctacttagtgaaatagttctgatctacttggtggaactgcgtgcaacatttaaaaataattcaataataagctaaatatttttttcatcggattatatccatgtgtggtcttgttttaaagatttaattgcaacggatttaatggtgtaatcggatcagggtttggataaataatttaagagaaaaaatagtttaaagttcgcttagtaagtttgcatgacgtcatcatgatgctaggggcagaggttgcatggcataggaggcaccagggctgcggcgtgcagcgtgatagcagtgctgggaggggagcccgatttttctatggctggatcggacgcccgggcgccatcattttcgaaagaattagtacctttacaaggatcaatatggtcttgtcctactcccttgtcctcctccctccgtttcaggttacaagacgtattgactttagtcaaagttaaactgttttaagtttgactaagtttgtagaaaaaggttgtaacattttcaacccaatataaatttattatgaaaatatattcaattatcgatttgatgaaactaaattagtattataaatattactatatttgtctataaaattagtcaaacttaaaacagtttaacttagaccaaaatcaaaacgtcttataacctggaacggagggagtattagataaacaacaacgcaaaccaaaatagtagtaggcctaagtgacatgcccataggcacttgactagacctagttttcgataagcacttcgatcatctgctaagtatgccagcaagctagcagagtcttcctcttctcctgctttcatgtctaaaacaggagaaaatagcaacggtgagtacatagagtactcacaagccaccacaacaacatgattaatgcaaatagggttaaaggaagtccaaggttcatttgcacaaagctaattttcgtaaatatttttacaatcctatgacctagccatctattatttctataaagctaatgcccactaaacaactaaagctcaacatacaaatatagtatttattagaactcctaaaacctacatataagcatgccacatcaactcattaagcacataaagctccacgtgcaagcatatagtaattatatctacaatttatttcataaaaaactaaacatacacatgctaaatcatcattctcaaatcattttcataatatttcaatcaaaatcgtttcattatttctccaatatgtaacatatatcctgtagcaaagcatgggtcatcatctagttttaacttaaaaacaacatcaagttttcttgtttaaccattcattgagtgcacttctttgattactcgcatagcgaatgggcttggggttatacctaatgatcaaattgcttacatttccaccccccgttgatgaaacttatttagtgcaaggtcacatacttaagcatggggcagataactctcttatattcttttttcttggctgtacgaatgaaattccgttacctaacccggggtatcatttgtacaactgtcatgatttaaccattctcctacagacgataaaagaatttcgtgtaggtacattacaccgggatacccgcaacatggcaagagatgaacatgaaggttcaacatcctcaccaacagtgcggatgtatgaggctgactaggatccgaccggagatgctcccagatggacccaagcaccacactatgagttgccaaccatcccgatctagcaaaatgccaaatcaagatgggttttgtagaaagaaaagctaaaacggctatcagaaccgatttagagatcaaaatcagcctctaggctgattcagatcgatataaggataaagtacccatctcgtgggcaaagggaaagtttacgggacaaacctacaaaggtgtaatcgcactctcgcagcgacggcagacgatttacggcgcaaatcaacaaagatggacaaaagctaggataaagtagaaaacatggctagaaagtaaaagtaagagaataattcgattgattgtgtagattgtgtggtaaattgtttgaaccggctttgtcccttatataggggttggtcttgccctctacaggccctcctccacgtccaactcagagtagaaaccaaaggaaacccgaaacatagcctctcgagtaaggaatcccaaggcccgacaaaaacagactctggctcggactctgacagtatgaccggccacatacctgcaatcagactggccctactagccggtcagactgtccctgtgaaggaaatccggtactttccaacctttggcaattttcccctatttcgtccataggtgccaaatttgggtgtaaacaaatagaaccctggcggaaagacaattccattttcgtaggtcccgatgacaacaaagacacagcggcggtgacgacagtggtagtagacgtgacaaaaactcgaaactctaaacgtaccaaacgataagaccagcaacacgactcgacaatgcaacgcaaaattcaacaaagaaaaacataatagaacaatgcaagggcacaaatatggctaggtattggatgcaactttttttatagctatttctggttatgggtagataaaaactcactgagcaacgaaagctctgataccacttgataaaccctgagttccacttgacactcaagattgttgttggcccgatcttttggtgagttcagataactacgatttgggagaaaagttgacgacccgattacaaccgtacaagatgttgtgttgcgcctttgcgatcgatacacctctccatgggttgttgagctagacggtgtagatcaaccttattcctgtaagcaaatcaaaaatccaagcaagaacaagataaaagcaatttaaattgcaaatagaaatgaataaacgagataagttggggatccgaagaacaaggagacggacggttcggctggcacacgcactacaagcaagtagcaatggctaaaatttaatctaacaaaacccgagataccctcaaggggtacctagctatttaaggaggtgggaggacaacctagtggtccctagggtcgtgctccaccagattggggcgcaccccacatgggcgccacttgggctggggtcccagacaaagttacaagcccataggccccgcaacaccttgtttcctcaattgtgaccaactgagatggaattcggtgatgaggctggatccgttggtgctcttcgcatagtccacttaaaagaacctggttcttccaatcaaaacaagacaaactcgagataatatgattagcaataacacgtatctctagcttgcatgttttatccacatgtacaaccgttgctcacatcatggatgaacaagaagatatcaaggtcatgttctccaagtgctggaatccaatttggccacttgctacactactaacatcaaacggccgctgaatctgcatacgacctcggttttcgacctgtgagtacttgatggaaagctctcggagtcctctttccaacggatccatcctaatcgccaaattctacaccagtcatctgaaactgaggaaacaaggtgttgcactagtcatgggcctttgggattgtaacttcatttgggaccccggctgtgggcacccgaaaattataccgtccagtgcaatttgtgatcaccacataattttggatgagtggaatctatacacctataatcgcagatgttggaggcataccacaaggaccttcggccgggcctaccgaaaccagagacgatcaaaggcgcgaattggaagcaagcggcaaagatctgagagacggcatgggcgaaagccatatggcgaaagccgtggcgtgaagtctacaagcctcgccgaagacagacctcgccatgaggggacaagtcgaaggtctaaggcgaatgccttgccacgaagggcacaagtttcgctaggcatcggatctcactagaaggaggcccagcaggccgacacaccctccgaaggcttcgccaaaggctgggccgaaacatttggcccattaagagcccatataagtaaaagacattgtatacccacaaagatgtccgtatcatgagggtaaccatgtaaaatcccctgtaaaccctagaccctaaaagggagagtctgtaatggggctataagtagccccctaggacaatgtaacaggggatccaaaaaattttttttactaagcaatacaattgtctttacttacaactactattgagaaaaccacgcctctcgacgtgacgcggttgtccattcgacaacagctggcgccgtccgtgggtacctccgagcgaaaccactgatgccaccaaagaaggtcgttaaggagagagttaccaagcgaaaggaaggtggcagcgaaggggacatggtagccgaagtgggagcagagccttcggcccccgaaggcgaagctacagcgtcgcctcctcctgtggcgtcgccatctctcccgccttcggcgcccgcgtcttcgatagaggcggagacggcgaaagcggcggcagcggcgaaggccctctggaccagagacgtgatcctatcatctcaagcaccgggggtgcctccagccaccgcctttgcccaaccagccacgacgtcgacagcaatcatcgtctcgcaagccaacgccaatctcgatgctcaaggagaagctgacataggggctatgcatcagaatatggctaaacttcaagacacgcttcgccagatgcaagagcaacagcaagcgtatgaagcagcaagacaaaccaagacccatactcagcagctttacgctcagccccaagtctttcccccacatgctgtaccagcaccagtgtacttcgccaagcccgccacagccgttgccgtgcgagcgaccccacaagtggtctcggcactggttcgcctggtggcacctcaaggccagtacctgaagcctactcacacgccacaaaaaatgatggaagcagctacgaccctacaagcacagtttcaagccttcttgcaacaactcaatcgaccccacaacaatgtaccaagagcttcgcctccggcccaagccaagggaagcccaagtcagggtgcaccagctcgatagttgctgggccagttcgccatgccaagccaagctcaaggggtttcttctcaaagccaactgctacaattcaacccaagcaccgcggcacaagcacccatgactttcgtgcaagccgtgccctgtgggttcggagcggccccaccaccaaatcaagcctggaatcaagccatgttcaacccagctgtggcgatgcaagctacctcgacagaccagcaaaaccaagcgatgatgttcggcacggggcattaatcgacacctgcagctcaacctcatgtgcaagctgtagcttcgccattcgcgcttccatacccacaatttaactggccctctcagttaaacgattatatgatgctggttttattcgtccttgtcgatatgctgagtgggtttctagtatagttcctgttatcaagaagaacggcaaggtcagggtgtgtattgatttccgaaacttaaataaggctaccccgaaagacgaatacccaatgccagtagccgatcagctggttgatgctgcttcggggcataagattttgagttttatggatggtaatgcaggatacaatcaaatctttatggccgaagaagatatccataagacagcttttaggtgtcctggtgcaatcggcttatttgaatgggttgtgatgactttcggctatggtcaaaccgggtggcaaaaagggtctgcccctcagctggggaattaaaagtcaccccatccctccccagttcaagtaccctcccgtcccaaggtattcgggagagacggatccgaaagagttctgtccatctacgaatccgtaattgcagttgctcacggcgatgagaataccaaggcgaaggtaatccacctcgtgctcgacggcataggggaatcgacaagggagtacatgcgccgattctcgcaagcacggtgccaagtacaagacataaccaaagcatccatcgtcaacgcaggttcggccggcttgcttgagggtgaactcacaaggaagatcggacgcaaggagccaaggacgatcgaacacctctttcgcataattgatggatatgctcgaggtgaggaagacaccaagcgaaggcaagagatacaagctgaatatgacaaggcggctgcagccgcaacagccaccgtgcaagctaacgctcaaactcaggttcaagcccaagttgtcagttcggcgcccgttctggttcaccctacccctccggcgaacccagcgcagcattcaaggccaaaccaagccccgatgacatggaaaaaattcaggaccgatcgaggtggcaaggccgtgatggtagtcgaagaagtgcacgtcctctgcaaggagttcgacgcccagcaagcgggcggacatcagcaaccttttcgcaaaatgatcaagaaagacctgtactgcgcctttcacggatgctcttcacacacaacagaacaatgctgaaatattcggcaacaaggcagcactcaagcgccgaggcagcagcaagctagggccgaagaggcgccgtgcgaagcggtcctcaaccaagcacctcaggccgaatagcgccaagacgcacaatgaagagtgatgcaggtcatcacaagatccgatcccccctcgcaagtgtcgaaacgacagcagaagatgcaactttgagcagtgcatagcattgttttggtaggagaaggggtcccaagatacttgacgaagcagatatccttcggaccggaggatgccgaaggagtccttttcccgcactaggaactgttggtggtatcggcagagatggctggttttgaagttcggcgtattttgatcgacagggggcagttcggctgatgtcatctttgccagaacatatgccaagatgggtttgctaacattggcattatctcaagcgccaacttcactcagggggttcaggggcgaagcagtgcatcttttgggttaggccctcctcaatgtcgccttcggcacacaaggaaacaagagagaagaagagatactcttcgacattgttgacatcccatacaattataatgccatcttcggccgaggcactttgaccaagttcgaagcaatttatcatcataactacctcaagctcaagatgcttggcctagtcgatgtgatagttgtcaagggttcccagccttcggctaccacggtagcctccttcgacagggaagttcataccctagaagtcgaagggcaagaaagagccaggccaatgctgagacccgccccccacggcaggttgtccgtttgcagatagatgattctgaccccgccaaagtcatatcactcggcgaagaccttcatcacgcccttcggcaccttttgccatctcagaatgtctttcggcctaaggaatgcaggcgctacattcgctaggctggtgtacaaagtcttgggatcgcaattggggcgaaatgttgaagcctatgtcgatgacattgttgtgaaaagacgcaaggcattcgaccatgcgtcagatctgcaagagactttcgacaatcttcacgcagccggcatgaagttaaactggagaagtgtgtgttcggtgttcgcacgggtaagttattggggttccttgtgtctgaaaggggaattgaagctaaccctgaaaaaatcaatgccattcagcaaatgaagccaccatcgagcgtacgacaagtacaaaagctcacggggcgaattgcagcactcagctgattcctatcaaaggcagccgaaagaggattacctttcttcaagacccttcggggggcaaattcaaatggacgcctgagtgccaagcagccttcgaggagctaaagcagtatctgcaaagcccaccagctctggttagcccagcagcaagaagcgaactattgctctgtcacgccctgaaaattgcctaatttagtaattcattctttaatgcatttttagaaactattttaaaagcttacaagttaaactctaataatctaggaaaaatttcaacataaaattgagctagataaaatttcattaaatactttgcttatttatctattttctagatttttctgggaattatttgagcaaggaaagtatttttaataaatgaaacatcatttcacgaattattttaattgagaaagtaaaaaaaaaccctcttctaagccgttgggttgttcccagcccaacccttttccctccccttgcgcagccgtgcggcccaagccgagccgccgcccctccctcctctcagccgccgacatgtggggcccacatgtcgggcctttcttcaacctccggccggccacagccgagaccgagccgcagccgtcccccaccaaatgcgccccaaccggccatcctcgagtccgattggttgaggtgtttttatccctttattgtcctctatcttttcccccaagaatcagagctaatttctttgtattttatccgaatcaaactcgttttcgagtttatctctccaaactaacccttagagaacctcacccatgatgatttcataagggctgttcaagaacaaatgatgggattcatcaacgagcagattctcgatcccacaggagaattctattacgatggaaagcctattcatcaagccggtccttcttcttccgatgtcacgaagttgtactatacgacataaacaaagattgcaaagtcttaaggaattgtaatacatgtatatatttatataagcacacatgcatttacttttgcgtacttatgttggtaatatatgtgtatatttacttaggtgcaaactcatattttgttaatatatgcatatggcctctaattacttaagtgcatatatttgtatatttcttatatgtatttctacatacgtatgcacattgcatatatatatatatgtgtgtgtgtaaaaacatatagtacacatatatatgcacttaagtaaatataggccatactttacttaagtgcatatacatatatgtgcacactatatgtatctgcatatatatgtatagatacatatagtgtgctcgtatatgtatatgtgtaatatatacatttctatattatgcatatatatatatatatatgtatttaaacatatatatgcataatatatatatatgtatgtatgtatgtatgtatgtatgtacaggcagcacacaacacaaccaaatttttttaaaaaaaatctttagtcccggttggtaacaccaaccaggactaaaaatggctctgtcggccacgtggctgagccaccaactgggactaaagatggagctttactcccgggtatttgaatcgggactaaagaccgccatctttagtcccggattctccctcccgattcgctacctgggagtaaaggggcttgcgaaccgggagagacgagcacttctccagtagtggatatatcattttccagtcttctccaattgaaatgcaatcaagagaacctcaaagaccatatatgtgttcaattgtcgaggtatttccgtatgttcggcacaatcactaaaagataaccagagttaattggtgagcagctaattatgtttcacataaacaatctcatgttatcatccaaataacatttggttgaccatgtgtggtatcagatatctacacagggacatgtacgttttcctttttggagatctttacagatggacatctatcaatctatgggtaccttcgtaagaggttcggtggttattcgaggatctggtatgtcataggctcatagcagaacattcaactaaagatgggactacttgtatgagaatttatcagttaccaacttgtccatcaaacatcagctgacttcagacgtccagaagcttctgcattgtggagtgtggaccattcaatggcgtaagctagaatatcatcaactggactccttgctatggagtaggtttaccttgagatcatgtcatccttaagtattcttcttgccatcagaacgtgacaccgtgaggtctgctgactccagttggtcatggagatgcttattgtcctccactaggtggttatattcaatcattagaccttcagattgcttttgggcagctagggctttagcctctgcatccttggcctcatttgccttttcttttagctgacgtttcatcttcttaatctcctcattcaatgaagctatgtctttctggtatgtcttgctctcatcagagcttccaataagctttgcttcgtctagtgtcttgttcagctttgacgcagcctccagatttcttttgagccctcgtacttctctgatatagttatggagccggtcaatgaccagagcaaggaataaggagtatcctgaaacaatgtagtgctattatgatatgtccgaaaatccattatggaactagaaattgcatgacagtatgatactggcatactaagactgaaaggtgaactgctacagagaggtctgttgcatttggaggtaattactactaccacctctgttcaattttgtaaggcgtattttgatttcaaaagtcatactaaaagattttgaccgataattaattaatatacaagtacaattagaccgtatagcttatgccattacatttagtactttcacacaatattggttttacagctatttgatatatcttttatgaaaagttaatggtcaatgatgaggacatcctccactattacctgctggcaaagacgcaaaagtcgggcggcgaccgtgtgagcctctgaataatcccaccttacttagcttgggaggaagaagccaccttaaaagggagagccactcttcccctattggactagtttttcagggagattgggcctttccccgagtgggtgtgcctatgaactgttgaagtctggacaaccttaagttattggacctcagccaaccccacctggatcggattgttatcatttggtatcagagctaggcccttgttaagggggtgggaatgatgagggcatcctctactattacccgctggcaaagacgcaaaagtcaggcggcgaccgtgtgagcctctgaataatcccaccttcgagctaggcccttgttaagggggtgtgaatgatgagggcatcctccactattacccgctggcaaaagtcgggcggcgaccgtttgttaagggggtgggaatgatgagggcatcctccactattacccactggcctggcaaagacgcaaaagttaggcggcgaccgtgtgagcctctgaataatcccaccttcgagctaggcccttgttaagggggtgcgaatgatgagggcatcctccactattacccgctggcaaaagtcgggcggcgaccgtgtgagtctctgaataatcccaccttcttaaaatggagattgggcctttccaccttcgagctaggcccttgttaagggggtgggaatgatgagggcatcctccactattacccgctggcaaaagtcaggcggcgactgtgtgagcctctgaataatcccaccttcttaaaatggagattgggcctttccactagccaccttaaaatattggactagtcatgcttagctttggaggagaaagccaccttaaaaggaagagccacccttcccctattggactagttttttagggagattgggcctttccccgagtggatgtgcctatgaactgttggggtccgaccccacctaggccggattgttatcatcatagttcagtcttaagactttttgaaattaaaatacacgtaaaataaatggagggagtatagtactccccatgagcatcagaaaatgatgcactaagatttttcatcatgatatatattgaagagaagaagtatttaatctgtaccaaaaaaattccatcaattacaccaaccgatcaatagaagttcgataaaaaaggaggacagcatagtgtacagcattgatgactaatctttttaatacttttctggagcaaagtttagttactgagaatgggaagtcctttcatatatttatttcttgaatacattaccttttattgttcccccgtacaggtttaagtacttcgcagatgtaagcaagttaaccagtttcagggctaatggaaataaaagaccaaaattctacagaaactaacagaaaagcttgttttcaaaataagattccccaagtaatgaatagtttaagaaaaattgggcatgacgtatgctgcattatgaacaaattgagatcattcactggttacttggttggattttgcacattcccgtctacttatttccaagtcagtctttacgatagttgataccattcaatataatttatcatgtaaatatattagtaattgtgatattttgtgtgctggatctgaagcaagtgtaatctacataaatctaaaacaaaacaaaaaaattaagaaaacaaatcaggagacctacatcacaagcatctgttttaaagttcaattggaccaaaatagcagtgttaatcaagaacacccaggacctccatccatcatcagaatggatgtaccaaaacaacatatattaagctcggaattgattcagctatatatattctatctgttgtggttaaaggacatgcagcagcagttgcacaaaagtgcataactgcaagacaaccaactagtcaacaggaggttttggaaaaaaaatcaatattagtagatcaagaaaaccactactcatgcctgtttaagaaaattcatgaattaacaaaaaatgatttgaactagaggagtaggaagtagtgacagtgtatgttaaattcatgtttgtttaagaaaattcagttgagtgcatctcatgttaagaaacttaaccgtgcatttcttacatgccaaaatcaaagtgttcatagctcacactcccagctacttatataaaagcatatgcattgcaatatttgagaatcaaacaagatggaatatttatctgctctattcactatctttcaacccctctagttccaatctatgcttagtaccttcaaatctcgtacacccacttcatgcctccaaagttgggttttccactatgtgatagttattccattgtgaaacaaagtccacatgaactctttgcacaattttttaaaataaacaaaaatggcgaagttccaaaaaatgagcaataaaaaaataatgcaaacatattacacataatagtagatgcatcacgcagaaatttgttatgtaacttttagtggagtaatcacaaagattcgagtcagaacagcaatcacagtttgcacaagcacgttattaaacttgagttacatgcaagcattggacacaaaataaaaatgttccaagcaatgtaaaaaatgttctacatattgttgtaaaattatacattgttgacttatagaagaatgagtaaaggaaatttattgctacagctaatgaatatatcaaactttcttcaatgcttatgccatactttttttaaaacagtaagcagtaagttcataaaaaaaatgcacaagccaaaggaccagaacaatcaagtggctttattaatactcaatttacaaatgcatttagcacgaatgggaaatttaacttggacaaaagaacctgggtgacgaaccacagaacgacagaaggccacaaaaacaattggatttctactacattttatttatgcaacagtgacaaagaaaaatatatctaagacattagcactgcacgatttccttttgtggggaggactctatcgcagtatggcaattaattatagcacactgtggatgcgcaacgaaacacaaagcaggatataatggaggatctaaagatataaccaggttatctctactgcaccgtcgccaaaattcagctcttagaaatcgccgaccccgacaccgaacacagaattatgattaaatcagatcgtggttataccctaaccgaaaatcagttcatccgttctcctccgattcaccgcgacatcaagatgatagagcgcagaagggaggggctaggtgcggtgcggacatacccatgagcgaggcctcgaggaggtggcgggcgaggaggacctggtcggtgggggtgagcgtccccgcccccgcgccgtcgagctcgccagcggcgcgtccgcggatcttgttcatgctgtggacgctggaggcgaggacgacgaggacggtggcggcgacggtgcgcaccatgacgggtccgcggccgcgcttgagacggtcgaggccgagcatcgccagcttccgcaccggcgtcttgaacagcagcgcgatcgccacggcggcctccgccgtgagcaccgtgaacatcagctggatcatcgcgctgccgtggtggtgctggggagagagagggagagggggggctgggatttcgggttttcggcggagggaggcagcgcgccttcacacttgtagcgggcacagtgcgttgcctcggtgtgggtcttggaatgtgtgagaaaggcgttgccgctgccgttggcgttggtgttatggatggcgtgttgcgggaggtattctttctttcttttttgagagaattgctttgttcacccgttttaaagcttaacaattaaactgatatattttttctagtttgcttgtttaaccaagcttttaaaaaagaacatcccatctgactatgtttccactacaccgtgaagtttttatttttttaaaaaatatatataattattattcgtaatgaccaaactgccctcaaaccctatccattcactcccatcccactcactcttatatccggttgaggcggcggcgcaccgggaggacgagccggcacgacagctcgtcgacggaggtaacggcggcggaagcagaggggcgtgaggggaccggacccgtggcggtgcgagcgcggagaaagtagcggccgcggcggctgctgcggcaagcgaaaggaggagcgggcgacagcggctcgacgacgatgaggaggagcaacggcggcggagctcaggttgtcaggatgcgtaggcggtggatccggtggtgactgggcgtgcgagccactgatacagcagcgctgaggcatgtgggctgtggatccggtggcggtgggtcgacgatggcggcgcggcggtggtctcagggactgcgggtcggcaacaacgcatgaccccgcgtcagcaagctctccgcgcgcgtgatgcctccgtcttcctccgtgcgagcaccgccactgggttggtaacgatgatgatgacgccatggctaagaggatggtggctcacgaatacaaaaattgttatactctatttatatttttgataaaatatagtcaaataagcaaagacagaaggggcatttttttctctaattaacaccgttacatgcccttaacataatagagtcagattgtatcttcaattttaaaaagaatggtcatacgaacaaagttgaaaaaaagataatcaaattgttagtaacagggtcaaccccttcatttttctggtcatgtttttgtagcggttgcctactaccggctagaataactgcgggtacacggtttggttgaaccgttgaaggacttgggaacctattcatttgatcaataatttgttggtaataataagggcttctttataacaaagaatatttgtaggatatttaaacgatttaaattaaatataaacttttttatttgtgtctttaaatcaagggaattatcatctcaaaatttttatgatagtaatccctatccttgtaataggaacactttgaatggtttggcctttatccgtcatagggcacctccaacggaggcgcttacataagaaaaccaggttcttttgccaagtaggatcagcgtgactcttaggcctcgtttatttcccaaaatttttttgggtgaatagttaatttagtcccttaagttttaccaaaagctcaatttgatccttcacgtttcattttgtccacatagctcctccaaatatttgttttggcttgaaatcatccttggaccctcttaatatgccatttggctatttctagtcaatatttctattaaaaactatcatttttgcccttaatttgtatacaactatatactagaaaagagaaagtaaacataaataaacaatattacagatgttcttcccattatttcaacatgtgcacatgaaacttaagcaattgctatcgtatacacttgctagtacataatttattttctttttacataatatactatgtattatctataaaacattcaagcatgcaatttttctcttatatatgtgaatgatgaggggtataagtatcatttatgaagagagttgttggttcaaggataagtttgaactaaaatgaaaacttgaaggactaatatggatagattgaaacatcaagaactaaactgagccttaggtgaaacttggaggatcactttagctattcacccaaatttttttcccaaaaatgtcatatcgaatctttgacacatacatggagattaaatatagataaaatgaaaaactaattacacagtttgcatagaaatggcgagacgaatcttttgagcctaattagtccatgattagccataagtgctacaataacccacatgtagtaatgacggattaattaggcttaataaattcataaagcggtttcgaggcgagttatgaaattagttttttctttcgtgtccgaaaactccttccgacatccggtcaaacgttcgatgtgacacccaaaatttttcttttcgcgaacggccttagcatatgaagccactgcttcgtgcggcgccgacgcttggtggcgctacaatcttgatcccaacaaatttttgaatgagcgcttgcatcgttgcaacggtccttgacaaaccaaaaaatttggaggcaaacaaataacccgacaaacccgcatccatattgcatcaaaaagcaatgtttctcaactactccgtccgtttcatactataagtcgttcgactattttcttagtcaaacttttttaagtttgaccaagattgtagaaaaatatagcaaaatttccaatacaaaacaaacatattatcaaaatgtactaaatgctaaattttatgaaactaatttggtgctataaatgttgctatatttttctataaatttggttaaactaaaaactttgactaagaaaaaagtcaaacgacttacaatatgaaacggatggagtattcaaaaaatgcgatccaatcaaccagatagtaccaagaaaatacaaatgagatcaaatcacccgtacacagagaactatgcggggcaatccaacaaactttccacataccaacgcctacaaaaggacccaccctcattgtgggtgaaatgggaactagggtaccctattcccctgatgaattagtaagtaactcataattaagataaatggcaggcataagccatccataaaaatagatggaagacttaggtttagtcacttagggacccgccctatatgtgggtcccgggctttcctaggtactttagcatccactcatcttaaagaaataaggtaaggggtagtccaggatcctcattgtttcggggcccggacacgcccttatccctactcaaagtgctaattccgccccatggagtgtagtgacatacaaaacctatgtattaagatcttaagcgaaagggatcatggatgatcaatctggggtccctgggtctcggtaaactggaacaggcccctctgggatatgtgaagcttacaagaaatatatcttaatagcaataggaagagatagatttagggtcggcctgttccagggccccgggcccactgctgtcgataggggaaccactcttcctaaagaggagtgttgaaacatataaaatctacaatgacccaaaactctgagcacaagggaacgcaacttccttatgtccccattagcaaaggtttgtcttggacccggtcctgccctgggtaccgaacttacctcaatccttgtaagtcctacgatccttaatgagaggagcgtggatgtcacatccagaatattttgtgtataaaatccgtgtctaggattcagccaggaaaaacaaaacgacaagtaaatatacagatcgaaacctaaataaagcgtaaaatactaatagaagaggcacttagtccccagaccgaaaagaaacaactgtgaaaaatagacgatcctagcggtgcttcagctccactccacaggcaaactcgactgggtataagccttggtcctctaacatcatctttagctcagaagcactacacttctgaaaagggggaataattagcaaggctaagtacaaccactgtactcagcaagccacacccatgatgcagacgtgcaaggggagacaaagaagggtttgtggctatttgcataaaggtggttgcaaacatattatagttgaaagcagaaaaactattgattaattaaggcaatattaaatctccactggacaatgctaccccacattgaacagacccaaccaaaccacctgaactacaccagttctttaagttaaattaattaatagaattgagtctaatcacgatggctagttgatcgcccataaccgcgggcatgactattcgaatagttttactctggccaaaggtgcacaactgtacacacaaggcacaacccaatggcatgttattgtgcccattcttgcttatggtaagcgcggtaagtcttctagggattcccgagaaccggtccttaattgccatgggttcaactagaaaaaccatgcacccacaaccctccattatgtcatattttagttgaataattacaaccagtgaaacatggccagatttctcgagctcacagctcatcaagataagtgtgaataatgtaattatcccattttgtgagctagtggtaattaagcatggctaagcatataatagttccagcaagatcaacataagtgaaacaatcacaggtgggcccggcgaccccacctgtcagtcccatccccaacctcagctccatcccaaccgccgccatggccgcccactccaccgccaaatccgccacctcccgtctcctgagcttgcattcaatagcgtggactcggtcccctccatgtcctccaccatttcctccactctccccatgaaaatcggtgccggttaacccgcccaccacccccacgtcggcgccctacttcgccggccgttttcgctcctcccagccacgatttccctccccaagcgctataaaatggccccctcaccttccctcatccctttttcccctttccccgtgctccccgcacatagaaaccatttccccgcatcgctccctctctccgccgtcgccggcaagctccggccgcctctagccaccgctctcgccatcgccaccactggcgtcaccgctccacaccgcaccccggccctcacctttcttcccctaaccgtcgctgaaatcccaccgccaccgccgacccgagctacatcaatgcctaccgcctccgaccgcctttcgccgccgctcccgtccacgccgacccatgccatcgcctccctcggctccgcaaggacgaggagatcctcggtcgccactcctcctccgcagatcatcgtcggagtcccattcaccatgcgaggtgaggtcgccggtttttcctcttgctttcggcaggcgattcacgccacctcgcatctcctctccccctcctaaccctttcatttccttccttaggtacctccgaccgtcggccgccgtttctcgctcgcagaacgccgccgaaccgccgtcaccattgcctccccgaggagcccgccgccggcttccccgttgccgtctcgctgtcgccgccttggtgagcatccctcctctcctccccgctcccttccgccgcttgccgtgccgccgctcgccgtcagtagccggtggccgtgcgctgccgccgccggtggccgtccggccaggccgccgtagccgcgctccgcgcccgcgctactgccggctgtatcggacagccgactgccgcctcccattggtcccagccgcggtcgatctgggccatcggatcggcctcggtctccatccgggctacccgtgtgtccgcatacgtggccgccacgtcggtgctccgtcggagccacgtgtgcgccacgtggtgcactagcccgtgcctccgtggacttggtccacggtaggccgaagcccttgagtcaccgatgggtgggtcctgcttgtgcaccgcccgttccctctcggtgatgtcataaatcgagtttaattgcacaataattcgttaataattctagaaattcatttaaatggcttaaaacttctaaatttcatatctaattcattcgaactctgaattgagccattcaacttgcaaaattcatctaaaattgagatctacatgtttgtttacttttcatgtactgtttccttggtttttattagagtttttcctcgtttagcgtgctagcgtgtagttcccgtcgtttcggaagatcgctttcgcgaggatcagagttcggaaggttgttgtgaagaagtaaggcaagtcacacattctccttgagcattttgatcataatttacaaatgttttatcgtttgcaaataaaattgcatgtcttgctaattacatgggatccgggtattacctatctgtttggttgtgccatgtttacttgatatctggtcctttgtcaacattgggtaataaatcgactagctcatgttacttatgtgacctagctagaactttatgcttagccatgcttaataccactagctcagttgatgggataattacagtattagacctttttagtatcagaatgagctgcgtgctcgagacatctggccatgcttcatggctgtaattatccaactaaaacgcgactgaatggtgggctgtgggtgcatggttttgctagtcgcaccatggcaattaacgaccggttcacgggaaaccctgaaagaatttaccgtgcttaccacaagccagcgtgggcaacgactgggcttgtagtgtatctttcctctagccgacgtacccaggcgagggtgggtgtgatggagttgggtcagccggggtgtccggttgatcggcttccggattcaccgcggcacgagagggggactgcccgttgccagctagggacgggggcgaactctgaggtgtggtgcgatgtcacgccctgaagttcccctcctttgcgttaaattcataaaataaatcgtccaaagaaatggttcaaattaacctagagatgagttccttaattaatcaatgcaattaataatcggaaatggcgtggtggaatatttcttgagttccccatgttgcaatatattaacaggatttttattggaattttcagagccttggaaataattttaaccaattcaaaatgagcaactgcaatatttaaatctcagggaaattcctttttccttttctttttctttcccttcttttttctttgttgggccgtaggcccaacctccctcccgcacgccctctttgctaggccagcccgctcccccttccccgtcccaaagtcctccctctctccctctctccttcgggcaccgacaggtggggcccacctgtcggtcgtccctaacctcccgccgcccacttcgccccaaagccggcaaccgccgcaaccaccccacctcctccgctcctcccgtgcccacgccgcgccgttcccgcgtcctccccacgtcaccgcccatgccccgtcactcccgcccgcgcgcgcgcgctcgagagggcgggattcgatttcggatcccaccccactctctctctctctccaccccacgtcgccggtgaaatcagaggctttcccggccacgtccgcctccccctccacctataaattgctcccccgagcctcctcttccctttttcgctctcgccgccctctcctgtgcctcctaccgagcccgcgccgctcgccgctagcgccgccgcttgccgccatctctggccacgcgccgctagagccgtcgccgtgccgcgcaatcgccgccgtcgcgctcactgagcccgcccgcacctcggccgcctcttggttgccaccaatcacccccgatgccccgtttccctcgctcgctagtgagctctccattttcatccatctctggccggccactttggtcgtcgcggtcgtcctctccatccctaactcctctcctccccttctttaggtgttgttgccgcccgtccgccgtccgttcgccggccgtcgccgccgcttccatcctctgctccggtcgccgccacccctccgatgaggagcccctctcctccctacttccctctttcccccgcgcgccaccgctttccgcgcgctcgccattgcctccggccgccgccgcggggctgtgcgccatccgccaccgccgcttgccgtcgccggtggccgcgcgccccaccgctgccgcaccatggccggccggccggcttgagccgtgccgagccgccagccgccaactccctccccattgagccactacccgtggggcccacgtgctagcctcccccttgtgccgctgacatgcggggcccacctgtcggcgccgcccctcccccttgctgacgtcagccctgggcaatattgcgcaataaattgattaaggactttttctttattagtaaaaacacagtttctcttctaaaattcatatctaattcatccgagctccgtttaagtccattcaagtctcagtaaattcataaaaatccctagaatccattaaaaatggtttggtttcatgtttcagtagtcttatagcatgttttgcttgtgtgctttgtttgtcgcgtagatttcggccgtttcgtcgatccgcggttcctcgaagacgttgctgtggtctcatcagtgcgagagcaaggcaagtcatgcattacaattgatcatgttgtacccaatttacaaatatcccgcatttctattaaatgttgcattcttttacaatgtcatgtgggatgggtcctattactcagccatttattgttcaccctgtgccattgataacttgggtatcaaaatgattagatgttggtttaggaaatgcttagccatgcctagttcaactagtacacaaatggggatcacattattacatagacttattagcatagctttggattggtgccaccgcaatggtgttagttaattaaaatacactgaatggtgggctgtgggtgcatggttttgatggtcgcacccatggcaattaaggaccggttcacgggaaaccctgggagacttaccgtgcttaccacaagcgagagtgggtaactgcttgatctgaggtatagctcgaccctttcctaggcaccggtggcgagggtgggcgtgatggagttgggtcggctgtggtgtccggttgtccagctgtcggattcaccgcggtgcaagaggggaccgcccactgccttttgaggggtaggggtgaaacccatggtgtggatggttaggggagggttatgcggagggtcttgtcacggtttccccctttgcagtatcatggtgatacttcggggcatggcgacatgtgtggaatcgtgtcttgggggtacagttgtacacctctggccagagtaaaactattcgaatagccgtgcccgcggttatgggcgatcaaccagattcaccgtgattagtctcacccctagtttaacttaatgaactggtgtagttcaggtggttggttgggcctgttgcaacgtggtgtagcgttggacagtgattggttaatattgcttaattactacaattgttttactgctttcaacttctgcttttaaatgcctgctttatgcaaaagaacatttagcctcctttggatatatcctgcatcatacctcctctttcggtatgacttgctgagtacagtgggtaatactcagtcttgctctcttttcccccaccccagagctgaagatcttcctagtgggagctattttgtcgatgttggtttcatcgctgccgtcaaggattgcctgtggagtggaatcgcccgctgcaggagtcaagcttccaagtctagctcgttttatcttttccgctgcatttgtaatcttttatattttcgtaagacgtggatctatatgtcaacaattgtcgtttgtgtaccctggctggtcctagacaggggtttaatgcacatccagcttagaaattctggttcgagaatttctgggcttgacatgcaatcggttatagggggttatgcgaagggtcctgtcacggcctttttccggtatgtcgtggtggcatgtcagcgcgcggaaacgtgtcgtggggctgtgtcttgtgggtacagttgtacacctctggccagagtaaaactattcgaatagtcgtgctcgcggttatgggcggtcgaccagattcatcgtgattagtcccaccttaataaatcaactcaatgcactgtagttcaggtgggttggttgggcctgttcaatgtggtgtagcgttgatcagtggagatttaatgttactttaattactcaactgttttactgttttgctcaataaaatgctttacaaccgcctttatataaatagccacaagccatccttgtatccccttgcacgtctgcatcattggtgtgttttgctgagtacggtggttgtactcacccttgctattattcccccttttcataagtgtagtgcttctgagctgaagacgaagttagaagaccaaggctcaaacccctagtttagttttgcctgtggagtggagctgaagccccgctaggatcgcctttttccgctgctgctgttttcgtttcagtgtgaagactaagtgcctcttctgtaagtattttacgctttatttacgtttggaactgtttattacttgtcgttttgtgtaccctggctggtcttggacaatgatttaatacacaaaatagtctggaaatttgggctaaatttctgggcgtgacagcacccccttgctgacgtcatcacgtgggctttattgcgcaataaaattaagtaaggcttttctctttatagtaaaaacacatataatcttctaaaaatcataactaattcatccgagctccgtttaagtccattcaagtctcagtaaattcataaaaatccctagaatccaattaaaatggtttctcttcctatttcagtagacttatagcatgttttgtttgtgtgctttgtttgtcgtgtagtttttggccgtttcgtcgctccgtggcgatttgaagtcattgcaaagatcccatcagcgcgagagcaaggaaagtcatgcttgtcaattgatcatattgcaaatgctctacatttcctttaaattctgcattgttttataatgccactgtatgggatatttacctactgttctcagccatattctttgtatgccattttcctttgttaaccggggatttaatatacttagatgttggtttaggaattgcttggccctgcttagttgaactagtacacaaagggggaatctcattaatactagacattggttattaacatagctttagattggtgctaccgcaatggtgttagttaattaaaatacactacacggtaggctgtgtgtcggcacccgggattgaattcccgaatacctggagcgtacagtgtactagtcccatgatcagtggctagcacacgcatccacaacattgttatcacatccatacaacatatttgacatataaatagataagtggtcctcataacttaacggtgcataggtcttacatagtagttaggccgaccggccaaataaaagagtttaaacgtagcagaaaagataaagtacataagttcttcagtatgcccatctaccaaaagacacaggcaaccgactaggaataaccctagaaagaaccatcctcgaaaactccggtacccggtgcaaagtaatcgtcactaggcacctcacatcctgcatccaagtctaaaaacaacaacaagaggtgggtcaatacactaggtattggcaagtcctacccaaaccttgggaaacataggactattgcaagctgagatcaaggatggctatatttgtggctattaatgaccaaatttggtaattcaagtatcggagatgaagataaaatcgaagcagaatccaagagatagatcgttctgaaaacagaataagaatcggctgcgatcagaatcagtagagttcgagtcggacaaggtagccgattgggccaattccgacaatgtgactcggtaaacgtcgtcgggttgagttaatgtgcttcatatggattgccacgcacggattgggtcctgaaaaggcaattgtatctattaagtaggatattttatgtaatttcattagagataagtttgggcaaaagtctgtcgcaaagacttatggtatcttagagtttgttagagataagagtcgtgtccgacaagaacatattttgtatctcaggtataaatatgacccgaacccgtctaatcaaacaacaatcgttcaatacaatctcgacgcatcgcgaccctttttactttcgtttatttcgacgagttcttgcttttgggttgagctgcaccgattcgatcttccactagaggt

SEQ ID NO: 61646 - DNA, 2267 bp, Oryza sativa
  unsure (1)..(2267): unsure at all n locations
gtggtgantttataaatctattcgtgctgcctgcggtcgacttagaggatccccatcacaatctgcactgagaacaccttcagttgtcgcatgtttattgcaccgttaggacactctccagactttgtttggttaatccccgaggagaaaaggatttgaagagattgaggaggattatgtgtaaaataaatcatctcaagagaattggaatcttgtgaaagggattaatcgccacgcaagcgtctctcccacctgacagctgctacactgcaacaccacatcgaccacatttgccctagtcgatgaaactgggccccacccacgatcctggcccacatcccagtgggtcgggtaagaaacggcccaggtgcagaaagtagcaccaccattttagccacctcgggtgggcccgccttgcgagaaactagccgttaggatcgcccgctcgccgcaacgttctctttttttcccatctccttccgctcccccctcccacaatctccaattcttcatcgtagcaaaagaaaatccaccacctcactcatcacgcacgcgaggcccaaaccctagacatggcgacgtcgacggcgacggcgaggactccgaccaaggcggcggcggcggcggcgggggggagggcggccgggaacaccaccccgtccttcaagcccgcctcacgcgcgcggttcttgcacgccttcttggagaacgcgcaccccaacatcccggcggcggggcngcngcngccgcngcnggggagaccaggaccccgtccaagaaccccaccctggcgcggttctcgcacgcctcgtcggagaacgcgcacaccaacatcctggggtcccccccgccgtgaagcccggagaagttgccgaccaccgcgtccaagtgtgctaccgccnccgccgccgccaggaannagatctccacgccggcnccncnnccgccgccgcgggagaggcggttcctcgtggcgaagaaaagggcgcggcggaggcgcaacggcgccaatgaaggcggcggcggtggcggagaaggcgacttcgacttcgacaagtgcagggaggccgcccgcgaggccctgcgcacgtctcacgaggagttcttccgcaaggagcgcgccgcatcggccgcagcagcagaggagcagttgcaaaaggaggaggaggaggagaaggcggccgcgcaagaagccaagaaaggagcattggagacattggaggaggaagatgtagcggaactggaagggagcagcaaagtgagggcgctgaggaccaaagtgatgaccaaggcgttgagcagcgtccctgattctggcgctggtcgtgtcaagcaccttgtgcaggccttcgagagcatcctctccatctctggagccacctctgacgccgacagggccggtgaggggtcctgggcgctccccgggttacaggcatggaaggaagattgcgagggtaagatagggatgccgccggtgtcggtgtcctcttctgctgagttcttgaatgcaggaccgaacaggctctgttcttcacttgatgggaaaagcgacaggttggtcaatttgaacaagtgggggatatggattgtgttttggttgctgccaatgcaatagtttgatcaacaattctgtatcttttcaggttgagttgggacagccggacatcggcaggggggtgcaggagcaggcgaaatgtgaggacatacgatgaattttgtttccttttgggagttaattatgtttcatatttggcctctgatgtgaacgtatattattctttgattgtcagacatcggagtcgctaagaagcagttggaacaagaaactgaaggtcacaagccagcatccgttcaagctgagaaccgaggtaaacgatatgtttgatgcagtgtgaatcgttgttgtaaatctattgtgtcattaggccgtttaggataggagaagtgcacaaaagttttagggcccctttaaatcgcagggtagaaaaaatggaggaataggaaaaacacaggattctgacaggaattgaagtgtaaaacagaggattgcaaaatacaggaaaaacccaggaatgatcgtttgattggagcgtaggaaaaacgcaggaatcggatgagagagatagactcaaaggaaattttccaagaggttggagctcttgctaaatttcctccaaaatccacatgcaatgtgccattccataggaatttcataggaattggaaagcttcaatcctttaagggtacaagtggaaatcaatgcgcgc

SEQ ID NO: 61647 - DNA, 632 bp, Oryza sativa
gatcctaacccgtagggtcctttgccaaagtctagggtatcactggcgccggagaagaaagtcgtcggagttggaggataaggcctgaagcacaaatcgcaaagttcatccggtggaccaaaatctgcaagatttggaggtagattttcagtcaacatatcgttagcatttatcggcgaaaaaaaatgagggccctaaatgtgttgggctgatatatagcccacagtttattgggcccacttgaggaccaaacattagctctttaggcccattttttaggcccagtcgttggggaagcccgacgatggcgagcagtccgccgcaacagccgacgacggcggcgggaggcgccggcgttcttcccgccgccggcgcgcgcggtgcccgtcgccctggacgcgatcctgtcgcggcgcgtgggagctcggtttcccgccgccgacgatgtctccctctgcccgcctcgccgcgccgcgcctcgccgcgcatccgaggacggggacaagcccaatcaatgccctgccgtggcggcctcgccgccggccacctctgcaacctcgcttctcctggtagttcccctctttccatgctctgcatttccctgatctgggtgcccgtgtttttgctctcgt

SEQ ID NO: 61648 - DNA, 1826 bp, Oryza sativa
ttggtcatcagcgccaacaatatcggtgccgtcccttttatattagtgacttagcttccaccaaggggcatccaccaaggggatatggggatgacgcaaacgtcattggcaccgtcatgttggaccacggcgccaatgaattggctccatgaaaatgatcatttctaaaataagttttctaaaaggataaaaaatgtgaaaaatccaagaaaactaggcaaccaaatcaaattaaaaagaatcaattaatgatttttccactgtactgacaaatgaagctgctcggagaatatagctttttagtttaaatcataatgactctttctttaactatctctaaaatacaagttttctctaaatcagcaacccttccactttcattatcaaaaataacaatccttcctctttatgcagcaacttggaaccagcactgacgaactccatcgagctaaaaatggcagcataaaaaatacggggatggatagccaaatctagttgacaggatacgctcttatgcaggagatgagcatgaataccaccgagaagacgcaaagaacaaactgagatgccttaaggagagtctactgacaatccaagaagtgagacacaaagatgggatattacaagctaataaggaaacaaacattggaaataacagatgctacttatacttatcaggctgaggatgttctggagttatatggttaccgagttctaaaaggacaggctgaaatcatgggctgctatacctgggatttaagcggcaaaactacgcagagcaacaaaggtcctggaaaacgacaggattacatgaaacaataaacaagaacaagagaccattttgcttctactcttgttgtgaatatactatgcagcaagcaactacaagaaacccaaaacgaaaatgagtcttgggagacactacctgcaattttttaggcatgttccagcttccaagtagtttccacatcgaactatcattggttcatacagagggtatctgcaattcaaccacgacaatactgccactccaaaagtacctagttattagaacgaatgtgagcaccagaagtcagaaattcataaaaaattttcacaaagatattagtcacctgagcattaaaaaatggtccccttgtaatgaatcaccaaaactttttttacatgcaacaactatgtttcaatacacataattaagcataagagactatgtggcagctcaatatttttaaaaaaaaattgcagtaactttgtgaagaaaaccacaatcagtgtagtgagcatacacagaaaactaaacaacgaaattacagtaaaaacaagcaatattttttctattctaccataggacattagaatatgtagtgtatgaagctgctcggagaagtaagacagctttttttgtattataatgattctttctctttcttgactacatctacatacaagctctccacatcaccaatctttgctctttatgcagcaacttggaaccagcattgaacaacttctcaaagttaaaaatcacagctacagaaataaggggggtggatcacctcagcctgcatctcaattctcaaagctcattgattgatcagtattaatgaagacacaaaggacaacctgagaagctttaaggagagtactggaagtccaagaattggtagacagagctgagagattgaacctgcatcgaacaactccttggggaacaatggcgactacagcaatagggggatggatcgcctcagcctgcatatcaaagctggttgataaggtgtgttcttatgcaggagatcagtacgaataccaacgggaagacacaa

SEQ ID NO: 61649 - DNA, 3496 bp, Oryza sativa
aaagcttcaatcctttgaatcaaagggccaaataaaattcccatttgaatcaaaggatttatgtaggaatttcataggattcaaatgctataggaaattttcctatttggccctttgattcaaaggattgaagctttccaattcctatgaaattcctatggaatggcacattgcatgtggattttggaggaaatttagcaagagctccaacctcttggaaaatttcctttgagtctatctctctcatccgattcctgcgtttttcctgcgctccaatcaaacgactattcctatgtttttcctgtgttttgcaatcctctgttttacacttcaaatcctgtcagaatcctgtgtttttcctattcctccgttttttctaccctgcgattcaaaggggccctatgggttaatttgatactacagtgacaacaacagcacaatcgacctatacctggcttcgtgtcaattttgaagtgtttattaagtccattaccagccagtgttactgttcttcaaactgaaatgcgccatcaagtgacaatgggtagaatggtagcataaaagtatactttttattatgaagcgtttcaatgagttggttgtatgtgtttataaggataaacatggcaacatacatctgatgcttatggaaagattattagatatctgaaatattcttagcccaagatttacagtacttgagtgaaatgtgtcgtgccatactattctttagtgtttctctttgacatgccaattgctagtaccatgttgatacatccaatgcaacaacatttggttcaatctctgatttactttgcttctcgttggattttgcaaatacaatttgctcagtgcattgctctgtattttctacagattatgattcttttgatgacaatctctagctgttccctcaaataaactagtgcatcaaaatcaatcactcctttttttcttttttgcaacagcaacggggaagggtgaaggaacaacagtttattcaaaaagtacaagaaatgcttatggaggaagagcagcaacgtatacatattgcacaaggacttccatggacaacagatgaacctgaggtatgtctagactagagcattcttgttttctcttcaaagcaaggctttcattaccagtttgttcaaaaagcaaagtgagttggcttaaaatttgttgtttgcgcttgtttgtcctggctgttctcattgcagctaggttagttaacatatcaaaatagtcaggattgagtatatttgcacagctttttacctatttttctttgaaatcagtatgatgaataattttacctattttctatggtatcctgactctgcgtttttattctgcagtgcttgataaagccaccagtcaaagaaaccaccgagcctgttgaccttgttctgcacagtgatgtacgagcaattgaacgtgcagaatttgatcaatatgtgagcatcgcaccacaaactcattatatgtcttgtgtattatatttaagtaaaccacaacgttacttattgcatatacttggtatgcttggttgagaatgcaggtgtcagaaaggaacaagttcgctgagcaactaaggctggagagggagcggcagcagaagctggaggaggaagagatgatcaagcagctcaggaaagagctggttcctaaagctcagccaatgccgtactttgatcggccgttcattccaaaaaggtgaatatccagtttataagtgaaacttagcctgccaaatttctttttgtagcactttcactctcgtctgttgcttggaaataatgattcagtattgtcatttctttctaaagaaatcaatgctgtatatttactttgcagtagcacaccagcattatcttaccatttgcacaagttactaatactcagttctatctctggtttgttctccaaaagatctgcaaaaccagcaacagttccaaaggaaccaaaatttcatcctcggccggaaaaacagtcatggtgagtttactttcaagggagctaagaaaatgtatttacttatgaagttcattgaatctaatccagaataaatatttctgcattcacaaattgaagcatgctcttaatgcttcttatatttcaatggtgtctgacagtttatgtcgacagcgatgcatggacaccggaatgctgatttcatcatgtcttcatgatcagtcgactgtacttgctgagaaatccaaggcattgccacgcatgttctagattctttgaactatctgaaccggaaacaaaatcacattaaatttttgtatcttcagttgtcccctccagttctttttatgtacatgccttatcagtagctctgtgcttcagatgcaaccacaccgaggttgagaagttgtacaaggaacataaaagtggaaattcaaacaagaatttctatgatatgctgcagtagtattcttgtactcaaaaccttcgttcttgccaaatcaaaaataccatcgtgttcatatatataccttgggtcttagctcattttgttctggacttcttgatgaaaatttttacggcgattttcactggactgaaaataattggctgtaaaaacagtaaactggaactgaccaactgagcatctccttgtgtgctaaaaaggagctcatgtatatgcttttcaagttttaaaatgatgtatgcccataatattcctattttgttccctctgctgaatgtttggtcactgtataagtttgtatgaattactccctccaatcataaacatttggcatgatttggtcaagtattggaactttgatatcaaatatttctcaaatgtttatttttttaaaaaaaaattgtgtgtattgccttgaaaaaataccaatacataccataaatctgttatattgtataacaaaattattcaatgtaaatttgttaggtaaagttttaaaaattgtctagatttatcctaatcaccaaatatatttttaggaagtacaaaataagattaagaactaaaaggatggagtatatttgatttctccaaacgaaatttatcagacgtcaaaagaacacatgagatctactacatagtactccctcattctcataaaaaaacaaatatattcatattcatattagtgacatatactaataatatgaatctaaatatgtttgttttttacaagaccaaaagagtacaacctagcattcgttttatgggctccattaggcccaaaaagagcccatgggctagaaacgaagtcaatcaatggcccagtgatcccgcggtccaagtccaaccgccttttctgactgacaggtgggacctccgcaagctaagcttcgcgcacccaagccctctcttcctcccacttggcaggcatcccaccctccagcctccacgcgacaacgccctctctctctctctctctctctctctctctatttctccccatctccccgatccacccgtctctctccaaaccctagccgagctagatctcca

SEQ ID NO: 61650 - DNA, 1969 bp, Oryza sativa
ccacttgcaagcattgagtctgcagtctcggtatgtgaatagactaaaaataggactcgaaaatggcatcagcaggttgacccagttaagatacttagatgctccaccaggaataatttcaggcataaaattgattggcaagctcacattcctccaggaattcaaccatggcaatgcaaagaaaagaaaaagaacagcatcattatagaaaaactgtaagtatgacaagtgaattccctccttaatcatgaattatggattaaagaaaaatctataagcaaatgaatcatgtctagtttgtgggtacaatgtatatagttgtaacaaaaaatcttctgtgagaggcacaatggtacacaacaagtggttagtagttgtaaatcgtcatgcaattaatttagtaggtggtcgaattcctaataccccgatattatgattacatataacagaagatcgggaaacaacttcatgctctggttatgacaaacatacataaaaattcaattagttaactgaggattatgtaggtcactacatataacgtctaaccactgttctaaaattgcatcatatcatttgattttggctaatacttctcttctgattctattacagcaatcaagaatgcatatgcgtgcactcagccttttatggacaactgggtcactgcaaaaaactagtcagaccaggaacctcacaccagaaaaaagttcatactgtatgtaacgaagaaatcagttttttcactctcagttgcacatgatactctaagaagaatatatatcgtgaataaataactaattgtgttttctatcttgcaggcaccgtgttatttctaaaaaggaaacgacatgttttcaactgctaacatggtgagacattgtcattgcaattaaacttaaggagccggagacatcagtacatcgggagcagataggttgagctacggcagctacaggaaaattgaaggtagaccatggtccttgataatatgtgtcatgtgcaaaagctaaattgtaaataatttagctgctaagttgtgaaactcactaggccaacatgcaggaacatctcaaacaactcaggatttagatgattcggttcacatgaacaatcttcacagtgcttgttatttttatgtgaacggagtcatctaaattttccctgttcgttatcggcttcttctttatgccatgatatgcaagtcatttgtgttttccctaaaagttcacatgaacaatagtacttcacacgatagaatgtggaggacatttgagagcacaatttccaagccttttcatccttccacttctttatttgaagttgattcacctttccataaagtttcaccattcataatcttatttctacttgtccaaaatgttcttccatttttggctgtcaatttcagtgaggaagtagaggtgaaggagaactttcgtccaaaaagaatattgtttcatctagatgatgttttgttatttttctcaatttgacacttatacagcataattcggtgatatcacacattacaatttatttacttttccatgctagtaccataaaggattatttttcaaagaatagggagatatccaaggctccggtaatcattcaaaatatctgcatctcaagattacaacaatctggtactctgtaacaaagtaattcttggatgacaaaagcttcaacgccctattgtccaacacaaaacacaaacaatatgctaactaaatggaaatgcaatgaagccatatttgtgcaatcatatgtagttacaaaaagaattagtaggcccccacggacggagccaggattttgagtcactggagtcatggctttcacttgcaatagtgtcgtttttgaggggactccaactttaagtatctttagctcaaaagtcttttgtagctagaactgtgagcaagttggaattatttcattttactaaaaataaatacataaactc

SEQ ID NO: 61651 - DNA, 3075 bp, Oryza sativa
aagatatgggtaggttttgcttgtcttttgctctttgttcgttccaggatactgcagtaagtttcatttcttcatcagtaagtttcattttttttgtcaacctttgtgcggccatagaagatgaatggagaacttggattgcagcgggcttgattgtagcttcgtaagcggcggaggcggccgtgtgctgtagccttttttcttttctgtcttctcgcccttagttttcgggggcgtgtttgtaataatgcacattcttgcactctttcttaatatactctggccggcatccttttgctggcccggcaaaaaataatacattttcatgattaggcagttgaaattagatttggagttaggattctatactttcaatagctttttctaccaagcaattgcaacttttaagtgattgtgccgtttgttgccaccatagtgactgtgagtgaaaatgcattccaatgaggcctgcctggagggaggagcgatggggcgtgaggctctcacctaccacccggcggaccaccactccggtgcccgccggccaccatccaagccgcagttcggctcgtggcgcgacgtcgtgaagaaagataggggccttgccgccgctgaggaggcagcttggacggaggtccggcggaaggggagcacggagcattcactgcgggcaggtgacccaacctccaacaaacaggacagagcattcaagccgaggaaggagttcagcaaccatgacagggcattcaattcggagaaggagatccctcgctggcttctggggcgctgcttcaagtgcctaggattgggtcatcgcaagcttgactgcaagggagagacaaggtgtttccattgctggtacccgggtcacctagcgtgggcgtgtccggagaggaaggcggtctctgggggcaatccggggcggcagtgcgtctgggcgcagagaggtggccgtctgggagaagagaacaacaggggaaggtgaagcaggtggtggtaagggaggtgccgccggcgaagtcgaagatcgtcaagccggccccacaggcgacagaaaagggcgcggtgatagccatggcgggtgctaacctgggcgggtaccagatctgtgcggccacgccgccgcagttcgtggaaaagtaccgcatcggcgagcccgactcgtggctagaaagggggcgggtggtgctgtcctggacctccgggatggagcgccatgagaggtacctccaggaactctccctgatggcgtcggtgctcaagggacggccgcccgtctcgccggcagagcttgcggagacaatcgagctgcacacaggcgtgcagcagcgttacttcagggtggaggtcacgcgcccggaggatttcctgatctcgtttcggaaccagagggagaaggaggcggtcctgcggtgttcgaaggcgctgttctgtaatgaggtgcctgtttcgttcaagccgtggaacagatgctgctgggcggaggcctcggctttccagttcttcaccaagatctccctcgacggccttcccccgcacgcctgggaggaggaagccatgcacaagctggtcaacagcttggacggtcagcttgccgagctgatcccggcggcggacgcgcgctgcctcggtctcttcgcttggttcaagaatccgtccgaccttccccaccatctggacgtggaaatcccggaacgcccggccgcagggcgatggcgggaggggacgagcgcgacaccaccttccccgccgcgggagaagccggccctcacctatccggtcatcatccacgtagaagaagtcattgaccctacgccgttgcatactccgccgacctccttcgacgacaactccgatgatgaagacgtcacccggcggaacactttctcctgctgggcaggtcgctacgatggcgctggtccctggccgacggaggtgggaggcggtcatgtctacggcggtgcgaccggttcggcgggaggtctaggcgcgcgctcctttgcccccatcccaggggaggtctcggccccgccaaggcggttgcttcaacgcctggcgaccatgccggcggcggggcagtcggtgacagaggagagccaggatgatgctgtcttgacagctgcggtggtgggggtcattgacatggcagcggcggaccgggttctagaccgggctgacattgttgttcaagacatgaaggcgggggaggtgttggcgtcacagccgcattcaccgacgttggttttgcaagcgccgggtgtgtggttctctccgcaagcggtgcaagcagtggagcaaccaggggccgacgtgggaatccctaccccgctggcggcgcctgtggttgcaacggcaaaggcgcttatcgttctggacgacgactgcagctgggcgctcgtggccggtggtgtgtcgcctctttcatcgccgctccaactctccctggacgagttaaccggcggtgaactgtcggcgctcggcacggagaatgatggcgaccgtgctgagctcagtgatgaggtccgggaggccactgtggaccacgttcacgttcacggggacgacctggcttcagggcaggaagtcgcattaactccgaatgggggatatgcattaacgcgtgttgcgtcggcctcgccgcgtattagagcgagccagtcgtcttttggcacgttggccaagaagctctcttttgaggatacgatggctgaggtgtcgctcgtggagcatgggtgcgagcggccagcattgaaggcgactggcgacgcgctgagctcaacgcaggagagcaggagtgatcgtgggtttgaatcggcggcaaaggcgggagagttccgtgtctatgtgcggaagcaggcccagaagaaaccgagccatgagcaacctgggccggaggggatcggcctcatgggcttggcaggccaggatctggggcaggctgacctgggacgggctgtggctggcgtgggacaggaaatgtcggtgggccaagttgtatgtggcgaggacgagccacctcaggcccaccaagaagaagtggcccacagcgacgacgagcggccggtccaggaaact

SEQ ID NO: 61652 - DNA, 2307 bp, Oryza sativa
acataaaggcaagctatggatgtagcttactgccccctccatctcaaaatgcccttcttttttaagagattgggggagatgaagaggtatatggaaagtactatattttaaaataaattaaaatcctagagatagctatatttcgagatggagtaaatagcttaaagaaacacacctaacatctagttattcgattagcagaactactggcctaatgcattgatatgcatgccacgtagctaaattagatcattaacagcccaaatatgtttaattgaggcattattggtgctgtggtggattgacagtagcataacaaataagctactactatattgttttagctttcatgagctccagcagattagcgggctgaccgaggtcatcaaactttgtttgctggggtcattagctataaaatactgagcaattcatttggttggttgaatgccatcggggtcatctgaccccggtgatattactgtggctccacccctgatatgtgaatatcatgtatctggggctccaagctatgtctcagaaaccccgatctgagccccaacctccctgattgtctcatctgttatgagatccaagggaaaagaattcatccggattggaaccaaccaaaagaaattgaaactgggggtaggacttaggaccacaatcattcacaagaacacaaacaaaaaaatttcaccaaagaaaatgtagaaatgcatcaccaaatgaaagaatattaattggccgctggcggagagaaggcttttacttagatgaaggtggcgagtccagaaaccagaaacatcggggcatctccgccaccactgcagactcccttctctcatccagacagtagacatcgccggtgagggcggccttgtcttctttgaggttttgacaaagatgatctgactaggacgaagagcatcaaaagagcagcttccaattagaacaccttatagaatatatgactactcctagtcctagctaggacaacaccatcttgaagaaaatttcatcaagcactgaagatgctctgaacttacttgattacagaatccatgaagccatatctgaaaccatggacaaggtgacacctgaatttgttgattcttcaactgctggttatccctcttccatgatgaccatcatcattaccacttccaccactacaagcagctcaacctcaacagttaaacaaccagttcaagaaaatagatgcaaaagtgagattgtgtcttgtcaaaagttcatgctgcagcaccaaatgaatttcaaaattttgtagatgaaaccataggagcggtattgtccatcacaaatcattcagagtagtccttttagataaaggtcataggaccttgcttttcattgaaagcaaagcaaggaactgcaggtatttccaacatacaggataatatcaggttttctggtcagaccccagtcatctaacagacataactcaacaagttttaacagaacatcctaaagacagtaaactaggactataaaccttcccctggcttcacctagtcaaagtgatagcacatacctaatagacacaatgtacaactccagcaaagataaaacaccaagcagctacatccagcaagactagtatcaggtcagccaactccagaatgtggtaatcgccaagcttttcatggcatcatgtagcgctgaagacaagagttccacccaactgacttcatcagataacagatgggtcttacactgcaaatgtaaagacaattcaaaaggagataatcagaggggatgaggcaagtttatttctgaagattgtaccatttctggtcaacaagagttgccagcaaacaacaataaatagcataaagtcaactctagcacttttggacccaaaccaataaccaaaagaaaaaagtcaaaatttgaaggaattctgctccagttcagagcatctctgcaaatgcaccacaaagcaacaggccaacagcaattgggaatttgaaaaggatatgattagcagtttcaaattcccaacacaactaataaaattcagagccattgcagttccttttctcaactggactgcagattggattctatctttataagccaaccagagaaaatgtttcattttcatggagaaaggagctgatcaaatatccttcaacctcagatcagtcacatcagcaaaagaaaaagaaaaaaaaaagaggctatcaacatgtcctgaagtggtaatttcatcgagatgtaggagagtatgcattataagaccataggacactatgaagaaacaattcatgcagcaaaataggg

SEQ ID NO: 61653 - DNA, 2388 bp, Oryza sativa
gtttgaggagaaaaactacgatgcacctcgttatgttgtatactcgttccgtcccaaaaaaaagacaaccttgtaatatgatgggatatatctatccagattcgttgtactaagatgtattacatcctaatacgatgttggctttttttttacggaggaaataggtaagagtaggagggtggttaagagtaaaatgtgaaaaaaaattgaatgagaagtgattgatagaacaattagtaatatatggtaacaattattttttagataatttttttggagaaaaggcgcaaagcgcccaactttttactagaaatcatatgagttcatacaacaataaacaaaataaacgcgaaaaggctggggattttccagcttatatgaggcgcaaacatgcaacacgcatagcacttagacagcgcaaagtctacacacaattaacaagtctggcaccgcggacaattctgaaggattaagacaatttttttaggctgtgtttagattggcccaaagtttagaatttggttgaaattagagacgatgtgactgaaaagttgtgtgtgtatgaaatgtttgatgtgatggaaagttggaagtttgaaaaaaaaaactttgcaactaaacacacccttagataaattttaattctaaaaatataattactatgagatcggatgtgctgtattttaggacggaaaaccgaggcggctacactggaaggccgctgaaacctcggctggtttttgcggtcccctcgcgcggtccagccgctgctcggcgttgctccgacctacctgagctcccgaacccagtccaagccgggttgtacgggaaccaccgacactttctctgtcaaaactagctggaactattacatggcgctcacaccaacacaatgacaggtagcgacccgtgatttgggtggtggtgatcgcaccaacccaagtgtactccaccgagaaccagctccgtaaatgggacaaaacccaaccccactcactaaggctcatgagtggaatcactccaaaggtggggttaattgcatttggtcttgtggatatgcacgtgatttgtccctactgtttactaccactctttctgatctatgtagataagaccagaaacaactttgtaacagaattatcctatctaggaatacatttatatcgctctcttttatattataggtcatgctttaattttttttatagctaaactttttatagtttgattgaatttataaaaaaaaaatgtaacaacattttcaacacaaaacatacatattatcaaaataattaaaactactaatttgatattgtagatattattaaaatttcctataaatttaattaaacttgaaaaaatcataaaaaaatcaaagagatatgtaatataaagtagttaatacactagtaagagacatgagaaaaaactacgttcaccatatacaatatgcctcaaatcaaaatataaagattacaacttagtgtagtaccggagtcatggatgcatgaccctattcaacaggatacaaatttttaatatccacgaatataagttcggtgttacgtgtgcagtggtgtagtggtgcgcagtatccgcatatgcgtttgctgtgtgcccgcgaaaaaaaacagagtactgtttaccctgacacgtacaaagcctgtaaacaaacgtgccacgtcatatcgtgcggcgcggaggaataaatacaggaggtgcaagcggcacgctggggcagaaggcaggcaaaaggcacactcattcgcgggccgcacgtgcagcggcggcgcggcgcgggtggatcgccgacggcgagaggagcaatggtggcgcccggcggcggaggaggaggggcggcgtcgtggccgtcggagggggaggtaaggtgccccgccccagtggcattggtcgctctcgtagagcggtgcgggtggttccgatcccgcgcggccccgtagatttttcgcgtttctgcttcagtgctttgtttgatttggggggcgaatgcttgcggggctggggatcgcgacttctccggcgaaatattgctgcgccggcggcagcaccggcggggcggtgaccccccgtggccatcgatcgatggcggcgtcacagtgtagtagaattacctgctttcccactgcttggttggtggtcaatctacatctaattaccatgtttgcaaaaacattcaaatatgcacctcttttattattattgttgttgttgttgttgttgttgttatttggaaaggaatcgattttagtttttcagtttggtagagtggtggtgcataataaaagagaggaaagtatggattggcagtacacgtgagatggtaatgttagctcgaattgatgtggcaaccatggtccatggatgcta

SEQ ID NO: 61654 - DNA, 3149 bp, Oryza sativa
cagatcgagaagcggacactggaatgggcaccgatggccctcttcctccagaggacaaggatgccgtcgcaggaggcctcctccacgcagaagacggagctgtcgaaccgggcgacggggtggaggagccggcgccggcggtcgacggcgaggacgtcgccgtttctgcagccggtgacgagggggagggagggctggtggcggtggtgggcgaggaggaagtcgcgggtggaggtgaggcggcgccatgcgcggcacaccaggcggcagcggaggaggggtttggggggaagccgtaccaggatgtcccagacgacgaggacctccgggagggcgacgccggagctgagcggcggcgggagtcctgtcgccgccgccgccgccgccagtggagtgaagtgacgaggccagagacgggctgacggcggagatacccttttgggcctttggctttttctttcttttttttttttttttgaaaattcgatcagcagcacagagaaaccccgttaacagagaaacccttttggcctttggtaccgttttctttgctgtgctatgatcgaattttctccacagagaaacccgttaacaaatttctcacttcgattggaagcacatatcatcggttttcctactatacataacactttcatcacattttgagctaacggtgttagattaaagtagaaaaatttatcctgtaataactaattttgagttaacggaagtgctatatattgaaggaaaatcgatgacatgtgcttctagtcaaagtgaaaaattccttgtgctattttttcgtactggtttttttttcctatggatcgaactctctcttttttgggccggtagagccacgactcattaaacgttcattttcatcttgaacatcagagacaatttcttacgttcaaggcattaaatttcaatcaccttaaaatttcaatttcatttctaaaatttcttctaactgaaatgtgacttcatacatctccttatcatcatcctccttttgccttttccctgtactttactattgaaccatttttttaactcaaatgtgacttcatacataagcatttcaggggtagtcaaaacaaatattaagggtagagcaatggggttcataacgcccactttgatcctcaccatatttggagttgtgacaaacagtccctcaatattcaatatcttgtacagccccaaacatgacccaacttcataaaatgccaaatgattcttcatttcaaggcagaccaatcatgcacatccacccgcacaatgtgtaatttgccggcagcagcagccccttgagtccatttcttgataaaaaaaattctcatttcagctcctttaagcttaaaatcctcaaaatctgctagtgcacctaggttccctttgataggaagtcccattggattgtgctttggctttccaattccaattcgatttgaattgcatattaaggctgtgttcgagaggaggggttgtctcccggcacgcaaaacgaagcatatattattgcatgattaattaagtattgttttttttgaaaattggattaatatgattttttaaaacaactttcgtattgaaattttttgtaaaaaacacaatgtttagcggtttgaaaagcatgcgtgcaaaaaacgagagaagtgagttaggaaaagtgggggaagaacacagcctaaacccctcttccacttgtttcgctactagtacaccaccaaaaaggattgacactatccccgttggattggcatgctctttactcacaaccgcccttgcgttttggatgagaatgtaacccaacccatttgctgcacaacccacaaatttcttactctccaaatagcattctaaagtacgatgattgtccctcccacatatgacacaaagaaacttgaacattgcaatctctaattgtatgaccatgaatcttacacctactgcaaaaacctttgagatcagcttgcgattttaccagttgagtcagctcatctgtcgcctgctcttttccttctagacttgctttgcccgatctctgggtctccgcttgcgactccgatcaggatgccactgctgcggattcgtttgtttatgaatccgcagcctatatgtgcccctgcattagcttctcttgatgtgcttgagcaaccccctctattttgcttctgctgcacctcaatagtcattgccttggtatggtgggcgacatggttgccacctattcggcatgagtttctctcccatcagctctcctcgtgctgccttcaccgccgagacgaaatcccttgaatcaccggattttgtccccttccagatcccacccctcccaccgatgctctccctcggccactttcttccactactcgccaatgttctccatcccgccgccaaatccctcatgaaaatccggcacaaccctcctcagatgatgaaatgggttcgagatgtgggggaatggtggcgtgggagctaggtgcctaggtttacccttgattcgagtggatcgagagaggaaaaggggaaaaggggtggatcaagtttttttttactcaacagctgtgcttccaaaaacatgcggccacagctcacagcagaaaaatgactcgttgttttgcttcaaaatgaaaagttggcctctgctctctacctccagtacatcaagatacagggcaaaaacattcacaaattcagtcaccacgtacacgaccatggttacagttaagaattcacaaattcaagttatcaacagtacagtacaagctgatgcacagctctaaaaattcaagcaccacatgattaggttactaagatttcggcaacaccatgtcaccatcactaggtctgcgagcgtgaaattgaatttattccaaggaacacgtaacaattctggaggccgagtgagctatgccagtatgctcttgtgcaggagatcaaagcaaccttaggtgcaggtgcaaccgtgcagctgagagatgtcgaaacaagaattcaagcatggaagactggcaaactacttatcaagctgaagatgttgacttatttgattaccgaatccatgaagctacatctgaagccatggaacactgaatttgttgattcaatccctctttccatgatggctagtccaccaagca

SEQ ID NO: 61655 - DNA, 12071 bp, Oryza sativa
  unsure (1)..(12071): unsure at all n locations
cccgcaagggcgttcggccgcttcctctcggcccaagtgcgcggtcgctccgccccccgcgccgnncggcggggcccgggaatgcgcgcgaggcatccaccgcggtcgccgccgcggggcccggcgtcatcgcccccaacgcggccccggtccgccccccgatgatggtgtacgaccgcatcgccgaggccgtcaacgccaggctccgtcggctcgagcacccggacccccgcttcctccgttacgcgagcccagtccccgcccacgccgaccacaccgccatcctcgccgggccgaagacccgcgtcacgacgctccccaacgggctccgcgtcgccacggagtcttcgctcgcctcgcgcaccgccaccgttggcgtgtggatcgacgccgggagcaggtacgagacgaaggactcggccggggtcgcgcatttcgtcgagcacatgctgttcaagggcacgggtgaccgcaacgccgcgcagctcgaggaggagatcgagaacatcggcggccacctcaacgcatacacgtcgcgggagcagacgacctactatgccaaagtactcgacaaggatgtgccgcgtgcacttaatattcttgcggacattctgcagcactcaaagttggaagagtcccgcattgaacgtgagcgcgatgttattctgcgagagatggaagaggtttgcttccttatgcttagatgtgaacatcccttaattaatcatcttcattgtgatggtggctgatttatgttactagttgttggcgttctggtgtagattatatatgcattatatattacctttaggcccatgataaattagataagctgcattcaaatgcaaattcaacacgacagatgctggatggaaataacttcaccttatcctgttgtgttatgggtatttttatatgatgcgaaatcttctaaatcttccttttggattaagtacatttatgttagacatatagacatactaattttgaagcgttgcggttgttcacatgaattttttctatagattgtttcttttgctttatttatcctaattgtggaaaccaatatttatctaatcctttgattgactagctaaggcacactgtgtcataattcactagctaaggccttttttttttttctgtttgaggggcatcggcataacttctgactgttgctatcttatattaggttgagggacaatatgaggaagttatattcgatcatctccatgcaactgcattccagtacacttctcttggcagaccaatcttgggttctgcagaaaatgtcaagtcaattacccaagaggacctccagaagtatattgaaacacattatacggctcctagaatggtacatgataatgaatttattgaatttttttattcacagatttattgttttatagtacctctattgctgcagttggatggaccattttcactagtaaatatcatacgcttctatatgttttcaggttatcactgctgctggtgctgttaagcatgatgatattgtagagatggcaacaaaactgtttaatgacctaccaactgaccctacaacaacaagcatgttggtttctacccaaccagcctgctttactggttctgaggtgtgtttgacgcttacctgcactatctattgntaatatggcttgatctcagantatgctactcaaaaggtccgcatcattgatgatgacatgccccttgctcaatttgctgttgcctttaatggagcatcatggatagatcctgattctattgccttgatggtcatgcaatccatgcttggctcatggaacaagagtgctggaggagggaaacacatggggtatttttttctttctctagctcttggggttntatcagngtttctatatggaccaaaaatttgttttgtctactgactgatgatcatcctacataacttttacaggtcagagcttgtacaaagggtagcgatcaatgacattgctgagaatataatggcatttaatacaaattacaaggacactggcctctttggtgtcaacgctgttgctaaggtagtctttgcttgaatgtctatttatcaagcaaaagtttatattaagtgctcgaactggtcttttattcttatatgtttttcatagtgatgtatgtctgaagtgcaaatcattggtcatgcaatccttcctatccatggttaccataataataattgtccgaacccttcaaatgttatggttagagtaattgaacaaaaattcaggcctacagagctctgtataactgatctgtgaaagtgatgatggtgttcctgtaccaattcttgcttctgctttttcgtcgaatgaagtgttaaacttgattacttggcacagatatactcatgggttgcttagatgaagtggatgtttttgtgtgtatgtgtgtgtgtgtgtgtgtgtgtgtgtgtgtgtgtgttttgcattgtggggttattcttcccctactttggctagcaagtttgaaatatcttggcaaacttggtagtctagcgcaatatgcaaaattttcctctgtcggacatgagcatggtacatacacgatattgctcttcttttttcttgggtccacttgatttgtctgttcgattttatagcactttgttgatcgagggcttctcgaaatgcacagtagtattgtgataatattgttgctagtgttcacaccctccttttttatgatggttttgtatcacctattttgcagcctgactgcttggatgatttggcttttgcaatcatgcaagagattagcaaactgtcataccgggttactgaggaagatgttatccgtgcacgtaatcaggtatctctttgaattactactgatttgggccacaatatagtactatgcacttcagcttcacattctcattactttggtctgacttccagctgaaatcttccatccaactgcacctcgatggttccactgctgttgttgaggatattggccgtcaggtattaccaggttttagctatgtgatgtcacatcacattcttgattaatgccatccacactagcttatttttttcttttttctcagttactcatctatggtcgaagaattcctattcctgagctttttgcaagaatagatgcagttgacgcaagcacagtcaagcgagtggccaaccgtttcatttttgaccaggtaattgttattttgccagcatacagatatggcatgtagaatatttgattttctgtactactttaaatgatataatggtggtgtccaagtctgcctccaacgccgggccataaggtccccacacgaccacacgtgcttttgctttagatatggcattatatgcctaatcaactaactatgctgtaacctatatttttttgcttttgctatactactttaaatgatgctagtggtgctgtccgagtctatctccaatgccacaagctgacatgtggggccataaggtccccacacgaccacacgtgaatatgcttttgctttcgatatggcacttttatatgcctaactatgctataaactgtattttttttgcttttgcttttatctcttataatatcagttgcaatgcatggtcctttagctagtttttcatagtattaatatgctgaacctaccaaattttagtcacttgtatcatgtttttcatgaggcatgctttgttatggagctgccagtaatcctctctttcacactaatcactagtgataaacgcgtgttttctttccttaccatcctacagaatagtttactggttacttgtgtacatatagtttcaatgctatgcttttgctttgctgtgagcaacaaattctcattctgtgaacccaagatgcacagatttttaggagcaagtatttttggtggcttgggcaaatattgcgctttatgtgaagagcaatacaaacgttacatcatatgaacttaaattttgctcagtgggcaggaggccaatattcattgtcattatctctttttctcaggatatcgctattgctgcaatgggacccattcagggtcttccggactacaactggttcaggcgccggacctacatgctccgttactagactctccaaccgatgtactatgtttacattctgcaaaggcaagataattgcctcttttggcatcagtatattatggcctcgtccatgcacattgtgtgtgcgacgtggaggaaatttttttgagcaccattttccttgttttctttgtccaaaaccaacaaagctgtcaataatgataggcaaattcaactgacgtggcttacttgagttgccacccgttgtttctacgatgaatcgttacccctacttatccttttttttattgcaagattgctttctttttcttggaataatttgatgaagctgcttatgtaaagatgatagttttgctgtgtcgactattgacaactgcacgaggtgcgaattgtaccgatctgttaatctcttattgcctcttggagaaacttggctgttggttcgttgtgttgtagtatttgggaaggtatggcggtgaatggttcgaacgaggcggtaacagccatccatgtgtctccttgtgcggtgttcacgctccatcgccttttccggctgctctttttaagtcatggcgaaattgttgtgcgttacgtttccagtcacgctcgcacggccttggcgcttgagcagttggcatcatccgttcgccgggcgtcgcgacttggactgattctgtattaggttgtgtttagttccacgctgaaattagaaatttgactaaaattgaaagtgtgaagaaaaaagttacaagtttatgtgtgtaggaaagttttgatgtgatggaaaagttagaaatttgaagaaaatgtttggaactaaactcggccttagttgttcattggtttgtttacacacggtggatggcgatagagagtattgagatatactccctggcatttccaaggccaagacgacctaatatcccagtttatagtgaatctggaagagcggagtattatcttgtcttatctcattttttaagttaagatacagatcttatcttaatttttggtagcatattttctaaatagctaaacgatatattttatgcgaaaactttctatataaaagttaaattaaaatatcagataaatatattttttaaatttaaaataattaaaacctaattaattatatactaatagctttatcgtcctgtgtactcgtacttaaagatcctcgggccatggtgtccgccgctttaggacagctagttactttccgctctgcgcgcctgaaggcctgaaccaaggaggctcaggctgatcggatcggcaagaacggcaacaaaccgtctcgccgtccgctactccgatgtggatcttgacaggtcgtgggagtgcgcggcgcgcgctgctgtgccgccgggaggggaaggtggggtacaggccatgtttagttgtttaggtatgaaatttttttatgtatacggactcacatttaaagtattaaatgtagattaataagatttcgtttgtaaactacgagacgaatctcttaagcctaattaattcgtcattaataaatgtttattgtagtatcacattgtaaaataatggcgtaattagccttaaaagattcgtctcacaatttacatacaaactgtgtaattggtttttttttcacatttaatgttccatgcataaatgctccatgcatgtgtccaaacatttgatgtgatggaaaagttggaagtgggagtaaacacagcctttggctactggggtgcgctggtcacgcgtgtttctttttccccagcggcaaagctcctcaacaagaacagtaactcacaatttttgacttgagtttttgatacaagtcagttcaaacatgcaagaaccatgaacgctcagacttgcaaccatctcctccctgtcaaaatatacgaacagcaaaaataagaaagatgtttaactaatcacagccgttgaatagagatagatggataggattggagctaatgccaccctctgcattagccgaatccggacttccaatttgaagctgacaaggtgcagagtgcagtactaccccttttcactcgtgtgctaacagaccagacgattcagtgatacattctatcgtatcacaaacaaaacaaaaaccacaaaacatttccgagatatgcagggtatcgtatattcgtatatgtgcagaccaataaatctatcggatgtatggaaatggcgcccaaactattgtagcactacttctcagctggagttcaggtcttcaggagggccttgaaccactgcaccgagttcttggggtatctcttgaggttatccttgtagtccacgaagtagagcccgaatctcgaggagtatccggccgcccactcccagttgtccagcagagaccacgcgaagtacccacgtacgtcgcacccgtcctccctgcaacatcaccatccacggaggactaattaaggcttttattgtagaagaaaatatatatctacactttgaatgcatataaccaatatttgcaatgtgaaattagcaaagaatcgtagttgctgtagctttacttgatggaagcagccagattggtgaggtagtcattgtggtatttgatcctcttgctgtccttgagggcgtccttgatggaaatgaacgggttgttgctgtcatccatccctgaatcatcatcagctatacactgtcacaactctggtgtaatcttgggttcacgactgctagtttcatgcgcaaaaatatgggtaaagcaaggattcatgctcttaccgttttcagtgatgtacactggtgggctgttgtacctttccttgacatagttcatcaggctcctcatccctcggggcacaatgtacagccatatcgaatttgcctgcgaaacaacagcacacctcgtttcaaattcagtgtgacattgcaaaattcgcaatggtcatccggagtccacaagattaattctggtgccaaactcaccctatctccaattggcttcccattcttgaatgctgcaaaagcgcaaaccatcaccaagaaaaagaagaaatcagcatccataccattaccagaattatgggtgaggattctctaccataatattattatcattatagtcactggtatgtgggtcacacctttctatcgtagggttagtgtttacttcctccgtttcagaatgtaaatcattctaacatttcccacattcatattaaacatcattatgaatgtgagaaatgttagaatgacttacactgtgaaacagagggagtacaatgatagtgtcactaggtagaggatatgaaccctggaatcacactaaaaaccaagcacgaaaatggcgaaggagaactcacggaggctgacggtgccggtgtctgccaaggtgttgttgagcaatgtcccgatgatgttggtgttgttgtgcctcgtgtagtaggtggtgtagtggtttatgccgacgaaatccagcgcccccttgacgacggcggcctcatccgccgtgaacctcggcagcctctcccccaccctcgccctcatcgtcgccgggtagtcgccgaagaagaacggatcagcaaaccttccattgcaaacaatgcagccggtcaatcatactgtaacatgtgtgatatgttttccttagaaaaaaagaacatgtcgattcggcactgttcttttcaactcactaaaaatggaatacgtttctaaaaaaaaaaaacttttttgttgtattgtttagaccacttttttcaggccatctgttaagtttatcttttaagatatttatttacccaagtagataatccgcgacaataatctaaatcaaatatagccgaagtcgaagcagaggtagataatgactaatgagaagacgataagaccggtgtatgaaaagggaggtgaagagagcttagctcaccatcctagctgaaactcctgcgctctcttggccgcctcgatgtcgatcgtggtgttggacatcggctcgaaccacatcacgtcgaacgctatcccaagctgcccgttctgcgtcgcctgcgattcccactccatccgtatagtaagataaagatcgataatgggaagaacgcagcagcaacacattgacatgggaagaaattcagaacggatcagtttgtcaccttgtattttgtcctgtagatgctggcggcggcggcgtgggcgaggatgaagtggtgggcgacgacgtagggctcggtgccggagttgccggccttgcagtagaggtggagcagcacggagcagcggccgggggcctggagccctgcgtcgtagccctggatggccaccgtgtgcggctcgttgagcgtgatccagtgcttcaccctgtccccgaactccctgaagcacgtctccgcgtacgccgcgaaatcgtccctgcatttttggataggtacattcaccaagatggttagtgtacttacttaattaactgaaactaccactgggattagtaattctgtcatgaagattgatgctggattagttcaagtgtaagttctctgcatttttttgatacattcattcatcaagatcgttaatttctcctacttagttaactgaaattgccattgggattggtaactctgccatgaagattgttgctgggttagttgaaagtgtacgtttttggtgttttcaggtgtttagtgctagcttcgaggaatgatcttaggtgcttgtaggatggtgttttcagtatgaaccctttctttagttgatgtgtatctcttttttatcaatgaaatgaggcagaacttcttcctttgtttttttttttaaaaaaaaggaaattgaattgtaagtgtgtaactggttagttaattgagggagacgacactcacactatctgcctgtcaagccagcccttgtacttgtcttcaagggcctgggggaggtcccagtggtagagtgtcacatatggctgaattcctgaaagattgttatactttttcagcaaattcagaagctgtcaagatgacctgaatttatcactttcaaatctgtgtgctcaccttttgctagaagtgcatcgatcagcttgttgtagtggtcgataccagcttgattgacttgaccaacaccatctggagtaagcacgagatgatgcaaaggctaattagaatatggggacagaaagtgcaggtaaaaatttctgactgaagacgcagtttgacatcatggtcgacttcgctagtttctcagttggagaccacgtacttgggtagattcttgaccatgctatcgagaaccgatacgcatccatccccatgtctgccatgagctgtatatcctcctgaaaaaagcatccatttcgtaggctacatcgattatattgtgctcattttgcaggataaatggataagatatgaatacgtgtgcacttgatctgaaagatagagagaatcagagagagtggtgctcacctcgaaacggtggtactgatcaactgcaacatcagcattgctgaagtcggtgatctttcctgcacaaaaagatgagaaataagcaaaacattagcgttacggtagtgactagctgcaactactagtcctgagaacacctggttaaggttaaagatcagccagtattacgaaagatgaacacagatgccaactaattcttacccactaggcccactatcttaagctacatgagcactaccttagttatccctactactgaattacatgtactactaattatgaaaggtaggtgagatctagtatcaaatagcacaattgcggtcttgtttgctccattatccaactttgggtgaagaaagttgcgacaagcttcaagcactaactatactgtctatctaggtaccatgtctgcactctgcacaagagacgagatgtacaagtggcacgatccaatgattggattctccacaaaaggggagctttcggctttcgtattgcagttttaggctatatttgaaagatattctgacaactacagcttcttataaaataaggaactcacttaatagtatagcttttcatttagatcttaggaagctacatttgtagaatctagaagagctaaaagctgaaaaaaagcacaacctttttagattgacagaagctgactatccacgagttgtttattaaaatcttaagctctcctcaaacacacccctagtgtcctataataaacgtgttcagaaatgaaatcaccacgaatgtgcttgaacttgataggtataagtaggagtatttgctttgcagaaacgccctaatttgatatgacgacaggcagattaatctggaataaactttgcagtactgagaaaagaaaaacgtgtagcaatacgtacgtaccaaaggtgtgcgcgaacgtgtcccagatggtctgccctctcccgtcctccttcacagctccctcgtactacgaaataaaaaaaaacaaaaacccactgtttattcacatcaaaatacatacacgaatctgaatcagactcacagtgctgctatttgcatggtcgcgtcggtatttttagcgtagcgtgtcttgtcgtcaaacgaacaaaccaactgaatctggttaccgtacctataccgtttccaaactaatataataagtaacaatttttacaaatatttatcattcctaaaatttagttttttttaattctatcaatgttacattgaaattggcactaaataattaattcataatataaaaatatctcaattattttcgatcgtttttataaaaatgataaaataatgataccgtttatgatcatttccgattgttttcgtgtctactctggtcaccaagcagagctccagggggtttctctccatgctggtgaagatgtgaggatttgttcagagctttcaaatgtgcctattccctcagtaaagaaactttacctcaaaaacttcaatgaccgccttcgctgtgtgaattggaagttcatctggtgcaacagagcacctctaaaagtgcaattttttgcctggcttctagcaaaggaaaggttaccaacgaaacataatctaattaaaaaaggaatcgtttcctctgctacttgtgacatctgcaaccttgaagtggaagacggaagtcatttttgtctaaattgccccttcgctcaaggcttctgggaggcaataggtttaagccctcgaatacacatggttactgatatggccaatcttaaacccgatgggaatctgcctgaattgcacttcagggtgttctatctgctatgtttttggtccttgtggaaacatcgccatgacgttgtcttcaggaacatgtccccgtctctgcaatcggttcttcgcaaatgtatggaggaatgtggtctttggctagaacgcctcaaatttgagcatcgctctgtaataacttcttggaagcttatcttttcggctccacttcaaactctgacgaatgtgtaacaaactttgtagccctcctttttaatgaaaattcaggtggggaatccccccccccccccccccggtgacttatctaaaaaaatactctggtcaccaagccttctcttccgggcgccacgatctcacgatggccgcgccgcgcgcgcgggagacggcgagagaatgcgtgagaagctgggcgccggcgcgccgcgcggcgcggggtggtggtggactgggcggtggtgtctcgcggcgcggagccagccaaccgccaaggcgcccccaactactcctggtccgcgcgcctctggcgatcgaattcgcggtaggccgcgcggggccagggcccagggccacgtccccccatgcgttctcgtcttctcctcgcaagcggacgcggcacgtgaaccgctgctggtggtggaggtggttccgatcgtttccgcggaattttccacggaccacggccaaaaccgcctgcgcaacggcgagcgacgatcagacgcaacgcacgcacgcacgctgcgcacatttttttttaagaaaaaatgatcaccttaacatgggggactctgggaacatggtccaatgttgttccggtttg

SEQ ID NO: 61656 - DNA, 1680 bp, Oryza sativa
tcatagtactattcaagagcacattttctcatatatcaaagataactagataaggtattctattctaagtaggaattgcgtcagaaaaaaagggaaattacagggcacaaggtggctgtccacatcatctgcatccatgctgactggaaggatgatcactcattctgtttcaccttctcctgttcttgataccaacctttatccttatccaaccttcttgtgtttttcaccccaactgctgggattctgggagcatattagtagaatattacctaaccaatttgcacacactagctgccaaagatgccatccctaggaagccatgttggaacagaccacttgaagcatcggtgctcacacgacaaaaccataaaactccagcagctgtttcttttcttgttgtcattgccagacatgggagagacggcagaaggtgttgaagcaggcgagaaatatgtgagcataccacagttggctggagttggaactcttctctccaatggaggaaaggtgagactgatcatagtatttgatagccctgatcttcagcttagcttgtgttctgttgttctgataaatattctctaattttcttgtggatatactatttggcatccaagcatgatttaaatatagcaaataaacatcaatacatagaagtactccagggattggctgttctgtttcatgatcaaatctgagatctctgcataagtataaactgcgtaacatggcatagtttttccaaatgagtatcagtattaaaccttcacactatgcagtactgaaaaaatatgtttgcttttggtttcagaaagagaagaattagttgtctcctaaatttgtcattgtgtatcaaaaacagaaatgcatctgtcgtccattgaagggaagagaatgtgcctcttcttctcggctcactggtgcaggccatgcaggaactttaccccaaagttgctccagatatacaggaaactcaggaatacttgcaagaatatggagataatcttcatatcacttgaccgcgacgagatcagcttcttggactacttcaaaggcatgccatggcttgccttgccttttgacactggcctaaggcaaaaattatgtgtgcaatttgacattgagcatatcccagcattgattcctctgtcaacaacgctatctcatggatttcgagtcgaagaggatgcagtgaagctggttgaggagtatggagtagatgcctacccctttggtgcaaagaggagaagtgaactggagggtatggatgatgccaggagacaaggaggtaatcttctgcaacttcttggatgcaaggaaagagaatatgtcataagtgcagatggcataaaggtgaccaaaatcataacctataaattcgtaatttgcttgtttatgcattgcgtatgtttaggtaaaatataaggctaaatgatgcagactatgatagatggtgccagtatatagatacatgctatgacagtaacctgctaacaagaaccccaacagattgcactaatacaagctaatatatgagcacagtcatcaaaatcttaatgattgtataaccattaaactgagtaaactggcaatgctagattaataatagtaatctagtcacaaacaatgaaaccaacaaaatatgaattaggtgaagctttatgaagctacatgaga

SEQ ID NO: 61657 - DNA, 1589 bp, Oryza sativa
ggtaaagtgttcaaaacagacggaaggagaataatttcaaaatatggtgcaatggcattcccttttacagaatcaagagcttatgagttggaagaagttctcaaaaaggaaagggacagcctgcctcaccgagtgagagatcaccgtcatgagcatgagcttgagttggacatggctaaggcttatgtatgcgatgagtgccaacagaaagggcaaaactgggtcttctcttgcaagcagtgcaacttcgatctccatccaacctgtgcgcaagaaagtactgatgtaaacatctgagatatttatacttcaaatatactgacaacaatgatgtatgcgtttatgtatattgtgtccaacagatctagtgctaatgggcactggaaaaaaaaaacttttaagatctagtactacgggactcaacactcaatagaaaaaacagctaacgttctgtgtccctgaatgcaagattaacagatggaatctatgggtgcacattccaagttccaacaacaaaatagttatgtaatgatttttttcaatagaagtattcatatgtgactatatataatcttggcaagggatgttccaaagatttatgtaactcatgcactcatgaactgatggaccatctcatatagctatccacgcagctatttcatcaaacaccaagcgtgcagccgtgcaggctcaacctcaagactttaagagaagaatatcatcttattttcacgaacagcaatagaaaaacatcacgaccgcaatcctcatataccaggcaacaacgaggtagtctcagaactgtagcgtgattggattctgaacggctttttcagatttgaacaacctatacagcgatccgaagcacttaccacaacttcacaagcacttcgaccaatcgaatgtggccacagctgaaaactctctgagatttctcaacggagagcctgaaaacagcgacatttcctcgatccacgtagccttcgcggatttggcaggaaaaatcaggggagaggatgataaaagagactgaacaatttaaaacgggagaattggacggcagcaaatttagcaaatatccccttgtacatattcacaaaagggactacatttgttaaatattaaactaaggtcctttgtcatttccaataaactctttgacagcctcaacccattgcagccatggtttttcacgtcaaactttaactgtctgccttatttaaaaaaaaatttaaaacataaatcacgagtaaaatactatttatattttatcatctcataataacaaaaatactaattataaaattttttaaataagacggacaattaaaattaggcgaaaaacttatggttgcacttgaaatgagacggagagagtattaagtaagggtaaagggtccgtacaattggttatttttttctaatatttactttgttgttcttatttcttattaggagtattttttttttccaaactactaaacgatatgttttatataaaaatattcatagaaaagttataaaaatcatatttacctatacaaaaattaaaattaaaacttaattaattatatcctggtgaatcattt

SEQ ID NO: 61658 - DNA, 1493 bp, Oryza sativa
attaatagaatatgaatattactagctatgacaaaacacccgttgggggaagtttcagacgacaatagtaccttcttttgcctattcagattgtttctttgagacttaaccatgcccacttagctaaattgcagtacttttacatgtatgaaacataactagaaaccagcccatgtctgctccttagacaatcaggatggaagcctcatttgacagagtctgcctgcccctatgcaggatatcagtattactaccagagggatgatgcgacagatagactaaacaaaaatgctacagtacagcttgtgcagtatgctcttatgcaggagattaaagcaaccgtgcgtgcagctgagagatgtcaaaacaagaattcaagcatagcaaactggaaaagtacttatcaagttgaatatgttccgtacttacttgcttatctaatccttgaagctatatgtgaagccatggacaaggtgaccaatgaatttgttcattcttcagctgcttgttctccctattccatgatgaccaccatcatcaccaccacttccgtcgctaatagcagctcaaactcaacagttacacattcatcttatattctcaaatgcattttttctccgatgaagaccttaatggcttaattgatttagtaaacatatttgatagtattgatgaacatatgccaacattcctggagatagattaataaatgcttgcaaacactagcttcgatggcacagaacctctttgccaggcgaatccttttttggtaggatccatggaagtaaagaaattgaaaggaaaacttttggataagaatgacggtagttgaaattgcaggtgctggcatgactgctttactgcgccaaatgtaaacagccctgctgtgaatgcgtgcttcaaccatttaacagttcaattttttcaagatatcaactattgtttccaactaattataaaaatcactaaacaatataacttcctggaagaagacaaacatgcccaacaattgcagaatgcaatggactctgtcagtaactaccgcgaactgttcatttcattgaacactgggctctaccgtaaccatttcattaagagtttttagagcattagagcactcccttgagtgtaaaaaacatagcaaatcaaatgtgcacaacatcccggttcaggaaaatacaagcaaaaaaccaggttaatgtttatagtgcaacaccaagtaagtttcatttttttttagataaaaccatgtgagcagtattgttcatcattaatcagtgagagttgtttccaccttggaccaaaagactatcgacatgtcgtatttgtaattcaatcaagacgtagtaggttttgcattataagtcacaatgaaccaactattcatgtggccaaatacaattattgtatcctggttgcacattcatctacaataagttcagctaagaagttttcatacataaaagcacaattcagaaaataataagtttgtg

SEQ ID NO: 61659 - DNA, 1243 bp, Oryza sativa
caaccccaagaacatgaatccggagatcagcgggaggtcaccgaattggcgcgtggtcgggttacagatggagtattgcggggggccggtgttccgggagatgagaaggagtccatcgcaggacgaatccaggtagtcggcggtgctggcgtaccgggcgaccggatggagccgcgcggcggcgcccctgcggcggccgagggtgagggtgaggacgtcgatgaggtacataatatcggcgtagtcgcaggcggcgatgagggggagggagggctggtggcggtggtgggcgaggaggaagtcgcgggtggatgtgaggcggcgccatgcgcggcagaccaagcggcagcggaggaggggcttggggggtaggcgtaccaggatctcccagaccacgagctcctccgggagcgggaggccggggctcaccggcggcagccctcgcgttgccgcctccgccatggtcgccgtcgcggcagcggcggtggagccgtggaaggaggtgaggcgaggcgacctttttcccttttttgagaggggaaaggcgaggtgacttgggttgggtaggagctttgaatgagccttgggccttttcctttatgggccagcggagctatgtgactaattaaggaataagtttatctgaggtctcttaacttatcaacgaatccgattttcgtcctttaaccggaaaaccagatacaacgggtccctcaactgttaaaaccggtggtctcattttagatggcagtcgctgtgcaccacccctcctcactcacgcttggagagaggacaaaggagatgggagagagatgaatacatgggagttggggagagaggaggaagaagaggggtgagaatgacatgtcggatttgttgacagttaagggacctcatatgaacttattccactaattaaatggtgattttcgtgttgagggctagtttagcacagttctagctccatgtcaaatagtttcaactccaccaaaaatagaagcggagttgggtagagttctctcacaaaataaactagatgaatggagctgggtttaggctgctacacaactccacttcagacccaactcctgtagctaaattcaatgtaaggaaagtatctttcatgccatatataatatactctctctgtcccaaaatataataatttagtgcatgtttggtagagctacaactcctaaatttagcttcaaaagttgggtatggagtggagttgttaaactgc

SEQ ID NO: 61660 - DNA, 14563 bp, Oryza sativa
  unsure (1)..(14563): unsure at all n locations
cactgcgttatanatcatatgctcgcatgcctgcaggccgactttagaggtatccccaatccggccaagacgagagacacacataaattccagaaacaaaagcaaagtttgtttcttattccatttgcacttccatccggctatccccccttaatttggtaactaatcatccctgatcaagtcgtacgtacgtgtgttcaaccactgtacgactaaaacggcaaaaaggatgaacaaacaagtttgtctctgaaaccgaacaacagattctccacaagtttatctctcaaaacaacaatgggaaatccatccgtgactaacctggtacgcggcggaggcggtgccgaagacgaacccctcggggaagctgcccctggttagccctcctccgctctgctgcgcaatgcatcctcgcagcgacgacgacgcgacgccgaagacgacgacgaggacggcgaccgcctccagcctcgccgtgctgcatcgcccactactactctttatcctccccatctcgcagagagaaggtacgggagatcgtggtgtgtgggctccaaactgcacggactgatggtggatgatgagatgagatgagtatttatagcggcagaaatggaggcatgcacgctcccactaataaccaatttttcgcttgggatgtgatctctctcggtgtgtatgtatgtagtagtgagctcttgctttaagggatggaagtgtgaagcgtggttgggactctatcggttgcctgtgaccgtaatggtttattagtgattaaaacattatagataagaacttttacaaatctgtttttgacggcttaaaaaactaatggttattttaccatccttgagaagatatctagagatatcatattttatagtgtataatttgctacctctaaatactaaaaattgtagtgtaaaatttaagtaccataaggtactttattaaggactataaagtttctcaaaaactaatgatgaagaaaaactacgttagaaaagcattgatccaaatcaagttttaaaatttaaattttggcaacaacttataagtactagggtagacgatgaggtcctttggttaggtgagaaatgaaggaacagcgaaagtgtgggaggagaaagcattctgctagtcctgcttgcatgatgccatgattgatcagtgatcagtgttattattggggaatcaaacattttaaatttgtaactactatgaaatggtgattgctgtttgattataacatgattggcgtgcttctattggggcatcaaattaatgtattaaataagtaccatggaatggagtaaaaaatggataaatttgagatcagggtacgtatttataacaatttttaacagtgtgctatttttatcctagtgcactagccggatgaatgaaatgtccattatctagaaaaaggtgtactattttagtatttttatccactatttgaatgcatattatctgtgaaaaaaaatcaatgctttctttcggcatgtaatgtttttaacaggatcagatagcatggatacttgtgaataggcaggttaattggagcaaattgaccagttcaagtatttaaataagcacaaatcgagccagtttttaggggtttgatcaccttgcctgcatgcggacatctgttgaaaaggactgcgtctgcattgatcctagataaattaaagacgtgaataacatctgcatcaacgtggttcagatttacaaggaacctaatcgcgtgtgttcccctgtctactttcagagagtttggcatgttccaaggttgtcatgattagttcgttatcatctcgcatgtttccaaccacaaaccgtgcaatttgccgcaaacaaatgcacaattgatacagatgatcccttgcacgtacggaccatcacaaaacgaatacatgggagtggattctaatccctcgagaggatatcccctcgtatatctttttcttctaaattcgatgtaaatagttgtgaaaaaatctgaaaaaaattgacaatgtagagtataatggtacctactagtccaccaaaattcatgttcaaattcgatctacaaatcaagaaacaaaaaaaaacaaatttagatataaacagtacgctactattcatacgctgaatttgtcttttttatatctcgacgtttgagttgagtttggacttaagattttgtaaagttatatatatgtgttgtatgaatgttgtcaaatttttccagaatttttcataaccgtttagatggtttttgagtaaacgagggaacatcccctcgagggattagaatagtttccccgcatacattgcctccatacttgtgagaggcactattgcatcatatatgcagttctctatatatcaatataattgtctgttagcttatttctttatatctcgctttgctttggctgcctccacccaatcatttgatttcgcgtcttagtttgccagctcaaatcaatctccatggtgcatgtacacatgcacagatcatcagtgctgaactgctgatacaattagtaatgtactgtaccagtatagaagtttctttttcagatatatgcgaacctatcgatatataatatcggtgtcatgtccatgctcgtctcgatcgatcatacagatactacaccggaggccagctggctggcgctatctgaaccatttcatattcttgtgttcattctgaatatatattctgaatggactcgatgatgatctgaaccctcctttttctgagcttctaccctaggactaggaacatcagactggaagttttgaaggtttgttgtgtgaaacgacaagtgttgattgatacacgggacatgggggggcgaaacgtgtaggcgctcgcgactccactccactcttgcgcatctctcggtcgatctcctcgtgttggtcgccgtctccttcatggcgatgatttgctggcctcactggaagtacgaaatcggtgtgaagcggcgagcgaacttgtaggcgactcatgcacgcgtcagatcggaccagacctgacctgacctgcagcggattaatcctccgtcccaaaataacccagatcaatcttaacaaagcctctgtttgactacacttatttccatatattgtgtgacagccaatagccactgtgtttctttatgcagctgtagctggtccaaacacttattaatattcgttgttttaacatatatcaaattcagagcagagaaaagagttatcttggaacgaaaatagtagagtgtgtttacaccaaatttgtcacctataaacaaaataggggaaaattgccaaagtttgaaaagtgccgggtttccttcacagggccggttagaccgcaggtatgtgggcggtctgaccgcggcctgaactctagtctgaccgaatgtatgtggccggtcagatcgtcagggtccgagcccgagtctgttttcgtcgggtttcggatttccttacttgggaagacatgtttcgggtttctttggtttctatcccgagttggacatggaggtgggtctgtagaggataagaccaacctctatttaagggacaaggccggttcaattgtaatccctaaacacacaatatacttgaatcgccttttcttttatctttacttttcagttatgttttccactttaccctagttttagtccatctttgtcaatttgtgccgtaaatcgtccgccgccgctgcgagagtgcgacacctctttgtaggtttgtcctgaaaatcttccgatttgcccacgagacgggtagttatcctcatatcaatctaaatcggcctagatgctgattttgatctctaaatcggctccgttagccggtttagctgttttccataaaacccatcttaatttggccgggggttccgctagagtcgaggtggttggtgactccatatcaccgcaaggcgtttaagtgctgcgatcgtgcttatcaacttatcatataaagttgctaacagattgtaccgagtactttcagttcagagattcagaaacaagctgtgtctcggtctaagcttgtgcgcttccgcggctttcacattcgccgcaagcgagttgcatgcactgcattgcgagtcgctggcgtgcgttgcagtctgaataatttgatttgtgggagtatactgcactgattgcgaccccaatcccgaccgaccttagctggctagtgtatgtgcttcggttcttcgattcattcctgcaataatgtttgatcatgcatagtgtgaacgacacctttgtcatcgtttaggcgttgtgttgttcgtctcgtcttgtttatgatatgatgaaatcttcgttcacattcagaaatcaaattcagagcaggcaatgcgcgtgccggtgccggtattcgttggtttatatattcgacaggcccatgataattaattggatcggtggagactggaactatgccgccgaacagctgggatactctgtgttactactactgatgatgcagaagcaagaaacaactgactacagaggcgagaggggaatttaattatttactacttttagctttgtcacttatccaaatacccttttagatttgcgcttaataatttgtcaccggagagaggtgagttcttaactatttctcacttttgcctatgtggcgtgcccgcgtggaaaatagcgtggaccccacccgtcagcccctccctcaccttcttctccacctccggtcgccgtttctctacctatcaggtcgagatccgccccgtgggggaggttgggcgggcgctggtgccagcgcacaagcttgacgcggtggagggaggcctaccagtgcggtgtgaggttggcgagcgtggtggggtcgcggtagtagacagtgagcgaggtcacctgtaacgccgcgcttttagtgggacgttaaaaactaattcggcaaaatcctaattgcgaaaatttcgttttttgtgtgcgagtctaagtcatgccgtggatctcagtttaaatccatcattgttccctctcgtcgccatcaaaatcctctacctctaaaatgttaattccgattcaacttcctagatcaattctgaaattcaaatccttcctttgaatcctcgccaaatacttctacgaatccagaattattcaaattccgcctcgaatccttcccttgacttcaccttatgttcctagagtcaaagtatcatggttaaattccaaaatccttctcaaattctctccaattcaaaaacaccctccaaatcagttccctcggaaaaagtctaaattacgtccctcttggttgtgggccgtttctcccttgctcggcccattctctcctctcgggcgctcctcctcctccccgcacgtgcactgcacgcgccgagagagagaggcagcgcctctcttcttcctctctccttcctcgctctctctctctctctctctctctgcttcctttctctctctcctctcgccgcgctatgcaccgtcgccgtgattcgattttcgccgccgccatttgaacccgccaccgcttttggttcccgcgcacgcgccggtcgtgactgaccgcccggtcgccacctgtccttgccgtcgccgtctgtcgccgagcaccgggggagccggtgcgtgcgtggacgcgtgacgaggagcttcaggcgccacctttcctcccttactactcggccgcgcaccctcggtgccgcgtcgtcccgcccgcgcgaccgttttgccgtgacttcattcgtgccgtcaacgccgctcctctcttgtggtgagcttcccaccgtgttcttcgactcgatgaatgcagtgtggtcaccctcatgctctcgcgcttagacgccgcgccgcgcccgtcgccgttcgccatagctcgccgtccgccttgccctgccccggaggtcgctcaccgtcgccatgacttcctaggctagctcgtcgccgcccgtcgcttgaaacgagttcccggaaccgtgtagaagctccttccccggtgaattggacttccgttgccccggcgagttttccccttctctcggccggcaatggccgccgctgcaatccgccgccgtaggcccttctcccaccgattccttgcgccgtgaccctccccgtgtccccttgaacctccccggcgagccgccgaggccgcccgcctcgccggctgcgcccgcgccgtgccacccatcccgccgccgcacggctgtcgtcgccggccgccgtcgcgccacctctccctcatccgagccggtgaatggaaccgccttgattccctctcgcttccggtgcccgccgcctacgccggttcgtcgccgttcgccggcggcgttgcgccgtcgtgagccgtccgatcccgggcagctcctcctctctcctgcgcctacgtggaagtccacgtggacgccacctcagcccacccggccccgcttgacctcggtcagccgcctccctccgttcctcactcgcgcgcggggtccacggagagccgagaggctgcgcgtgggcccgccgcacaccgcatccacccgcgcgccgcgcgtggaccgctttcccccgaaccctagcgccgccctcgcgtgcgcccatcccaccgtgggccgtgtcaccaataagcgggccccacccgggaccccgcacggtgcaatcggtccaccggacccgcccccatttctcccgtgccctaatgggccgacttccgcgctcgcccggcccaatacggctcggcggagccgcgcaagccatcgggccgcgccctaagccgcccaacgaagtctgattcacgtccctcctttatttctttccaaaaaggatttaataaatcctttttcctttagacagaaattccttaatccttccaaaattcatatctcttgatccactcgtccgaacgcctccgttccacttccaataattccgtaaaattgagatctattcaatggcactattatttagtctaaataggatattcttttggtcttttgtttaggttttttatcgtttgcgtatagtcgcggctaccggatttccgtcgatcgtggatttctcgaagattcgtgaagctccgtgaaggccttgagcaaggcaagtcaccctttgaccaattgctcctataattggaaaatcattactattttgtttgcaagttgcattattagaatcactcacgtttaatttgcttggcctcggtttgtgtgccaaaccgacggacctacccagtagtcgcgctaattcctgtaggccatactaccctgattccttgtcgctccacttttgtggtacctcggtatccgtgctctctgagcgcgtataccaaatatcccacatacaccgttgtttgtcgaaaacttgggaaatgggtttgagaagccttgaaaacccgacatgtggtgtcggcgtgtttgaaaataaaataaattgtgaaaactcgcgatgcgggggttgtgcctatgtggcactatcccgtattcgcatataaggaccgattcctgtgggaaattcatccgagcatataacaagtgcgaccacatgggtgcaatgggacgcccctggctgagtaaatagcaaaccagggaagtcttgatcccaagagacatgtggattcaacgaggtggtgtcgggtagaaccctcgggcttcctggcatagtatggtatgggacctaacctgttgtcggtctgggacccctctcgttggcatatggcaaccctgtgtcggctttcgaaatgccttatcatgaaagccttagggtctcccgacgtggctgatctcacgggctgggtgatccgggttagtaatgtcgtgtgggtaaagtgtaccccctctacagaggttaactaactgttcaaacagccatgcccacagtcatgggcggatgtgaggtgtttcatgtagcgtagatttgtttgcttgtgctttgtgaaaagttgttggggtgtgggaatcgttatcagaatcagcctatgtggtagatggatgacctgagtggtcaagaaacgaatctgtgtgattcgggatgtctacgagcattatagactaagcttcccgagtggaagcggattgttgtgctgctgggcagctggactctaagagtccgagaaaatgaaaaggctctgggagccgattaatcaagtgaaatggctctgggagccgagaagtaatgatctgacccgggaggtcggtacattaccaattgagttgttagaaaacatctcttaaagtcgaatcgagacgcaagtctcttttcggcccaaaagagctgttgaaaaaccagggtttcgttctggttcccagccgtcgcctgtggtgttgggtgttagtccgttggttccgctgctgctgcttctgttgttggtgtttcctcgtccgtgtcatcggttgtattctcgggctgttctgagctgcaacctaagttaaggtaaataagtcctctatttattataaggattgcaatgattcatatttgtcaccgtgggtaccagcgctatgtcctgggactggtactgagatcgcggttttgtaggaagcggttcgcgccatttttcttacgacacgctcctgtcaagtgccgttgtatggcggtgcccgattagggtgtgacatcaccgccgggaagcaacctgcaagatgggtggcgatggaggcgttctactcggagatttcctcggggtggtacaggttcatccccgacgacgttgacgacgacggcgtgccgccgccaccgggcgagacgaaagagaggagcgggtgcccccacgacgagacaagcgagaggtcgaggcggtctagcaccggaaggagaacaccggcgagaggaacaagaaccctggcgagctaaggtggaggagaaaagacagtcggaggtggagaataaggtgaggggaggggctgattggtggtgtccatatcgtttttcacacgggcacaccacgatgcctcgccacgtaggcaagagtggcaaatactcacatcccttcctaggttgagtttttttggacggagggagtagttaaaaaatcacctctctctccagtggtaaattattaaacgctaacctaatagggacatttggataagtgataaatctaaaagtggcaaatagttaaattccctgaggcgagaaggcatgttccgatgtccggcgttgaatgtgcccgtgtgtcatgtcacgttcccaatcgagtatgtgaaactgaattcctttagctctggatctgaaatgtgctgactggttatgaactatctcatcaggagacaaactacctgccggcatgggcgcgtgctgtgctaggaataagttcacttaccgctttcatcttaaggttaaatttatttagcatccttaaaccatgataaagcccaatcaagtcccagcgttcgatagttagtctgtgctggttctctctgatggaatgagaagccaaggtggcaatggccgccgtcgtctcactctggcgccgtcttggacaacttcttccaagggactagcagctagcctttcgccggcgaagtcctcttctgaagaatgtgagcgcgcttgttttcggcttggccgcttggtggaggcggcggcggcttctgcgacaagaccaagagctgtgcatggatcgtccgctgcgtttgatcaggtaaatgaatacggtgattcatcgggatctcgtttttcgattttgcaggatgcgtctggtgacgattccggtcatagtttggcagacttggaaagtgcggtaaaaccctggagcggtcctcttccgtctccgaggaggtcgccaccgagaacgttggacgctatggtttcttcagctctgcaaggtaattttcagagcaacacactggcttcggttttgggcacagttacaaaggtgtgaggatgatggggaatttctaaaggtcgcatgccgcaggttggagtcgatggttatgcaactatttgccaattatgggtggaggttcacaaatagacttcaataaatgtgttctccttattttggcttggttacctttgtttttgtttggtgtgttctttttatctgaactacactctcttctggagtgctactttgtaataattggctgtaactctttttcagcaaaggctggaatgttatattccattatcttaaaaaaaaaagtcccagcgttcaaaaaacatggtgtcctcctcctcaaggtgagctaaagctgaattttgatggatctttcttcagtgaaaacaaaactggagggtggggttttgcaatccgggatcatgcggggagtgctgtgcttgctgtgcagggaggattgattcggtgcaggatgctctaagtgccaaggctgttgcttgtttgcatgcgttgcgagctgcagtagatcatgggttctcgcacatttttgtggaggcaggctctgtcaccctggtgaatgccttggagtcttcttactgtgtccgaactacggcgggtgtcatcttcaggcagattaaagcgatgattcatttggattttgttatgatcacagtgtcttttactggtcgctcatgtaataactgtgctcatgaacttgcttatcaaggagttagttgggacccgggtcatatgtccatttgggctgaccccctcccagattttgtacagtccctggtggtttgtgattacactaaaccaatgtgataataaagagcacgtttcctcaacgtgaagaaagggaagagagcagataaaaaaaataaggaaagagagggagaggggtatatgcgagattgaggtaaaatagatggagacaaggatttttatataggtccggaccccttatctgacaggtaagagctctacatcctgttggtcgaagccggtgtattatctatgttgatctgcttccccctctccttctagggggcttgtatttatacccatagatgccccattgtttgagtaaaactagtgagaccaatatggatacaatccgagtagtcattgtcgtttctatatagaactttattcgtcattccttatccgaaactccttatatatacgaggtataattccgtataagacttggtatgtgatgggccctgccgagcttagtcgattactattgagtatgtggtatccatgaccctgacaatatgggcctcatatgtttttttttttctgctgacatgttatgttggtgaaaccattcatctatattgtcatgggacctgatttggatgattttacttagacgagaggtgaacattttattgtagtttaggaatgcccattaaactcgacgtaaatacgagggatgtcaagtggacttctgctactgctgctgcccaacgctacctctctcgacgttattcgagatgggccataatgaggtccagcaaggaaggaacaacagttcaattgatgggccatggcctccaggatcccgggacccagcggtatctagttgatcaccgcatatgactcatttcctcaatcttggttgcgtcaaaatgtgattatgatgcattagtgatttgaaaggggttctttggcaaatgtggtaggaaataatattccacttattaaagcttgacattatatattatccatacattcttcccatatattttttcctctttttttggcaaaaaagtagagagactctaccttgtatccattaatgaaaatggtgtgtcaaagagtacaggccaagctgccaaattcagaaagacagaagaaatactgaaaataatgggaacagaatgtaagagaaagtaagaataatcacaagagaaaaaacaaaagaactaaaacttgaaagttaaggtgtaagacagtttagctgagcttgcatgctcagttagtaatgtgcactcggaagcttggtttggctctgttttcctaggttttgatgtcatccttgattttgtggagtaggtttgataatgtgcagtttttttgctgaaacacattgtcattccagcacaagccgcgaagtagattggccatctttgtccttttttcgaacggctcacctaatttaattttgttctaaccgttcacttagagttatattatttcgcctatgcttataagccaaaatttaaattttcgtttgcaaatatgtcatttcgtttattccacgaataagcgaaacgatggcccccgttaattatttccctttctccaatctcttacagtgtgcatttgcgaaacgggatctacagtgttaaatagtcactcgtttttttgcacggttggagaagtctttgggatttttttctgtttgagtcggcacgttttgggctttcgcagagaggtgaaaatcaattgctatcacaccggcacacgaccaatgttgactgagcccactctttgtgactcgtttgcactagacaaaatcagggagaccgagcatctttcacccctgcaagttgcgaaggaaaaatccgtcaccctgtttctgaccaactcttcgtgttctcaccgggaaagaaagagagcaacagctaaattttatttttaaaacacactgtttatagtttagtagttcgtgaaacgtgaacctataaaatattacttcatttatcctataatataagacgtgcacaaattacaatatttaactttaaaaatattttaccaacaattattataatataaattagattttatttgctaaaattaatattattggattgacatttaaatttactttaatatgattataattttattgcaataaaccttatagtatagtatatgagaaactataaattaaagaagattagttttaaagactgtgctgagtttgaccatatcttatattatgggatggagagagtagcagcttaaaaaaagtaacgaaaacatacaaacattttaaagcgtcgtctcgagagctttgactgttcgacaagtccaaatataacaattcagatcctctgttgacatgtggagccgagggtatgttggacccatatatcagctattgaggaccctcactcaaaatataggtgcaaacatctcgtgaaaaacgcacaacaattttcacaatgggcacgtacgttgagttagaatctgatggccatgatcaaaagccagaacgaacaaaaacgcctaacaaatctttcaccaaaagcacccagctcatcacgttatccgaacggaaagatggtagatatgagagatgagagaccaggtcatcgccaaaaaccgtaaaagcaaaccttgtcccgtgcggacacccattccccccttcccctttctgttagacacccgccttcacgtcacgggagcgcatctccaccgcacgatccagatccgacggcctccacgttccggggcccacctgtcagtgagcgccagcgtggaggagggggcacgcacgattcgtctcctccccatccctctaaacccctcccctcccccccaccacctccgccttgcgcgttgtttcttctcctctcttcgtctctctctctctctcgtcgcgttggatttgacgagctcgtcaccaccggctgcggcggcgaggcaggcatccgcactcctcggcgtcgggccgtcgtcgttgtccgctacctggtagatccgcgtgttcccttcctcgtcatgtctcgtgtctggatctcgcggaggcgatgcgtttcagattcagtggcttgtcgttagaattacgtttttgcggcgaccactttttgatcggtgaaaaagcgggaagtgggtgttccggtggtggattcgtgctcagtttggggatttttttttgtgggggctgatctgggtgctacgtgcgcgcgtgtgatggaacgctcggttggtcgtgcggtgtagatgtaggcctgatgctagcgaaatttgttctagatccaagctggttgatccatgaggattgctttagaaaaaaattttagggatgccatagttttagtgggacttcatatttgtcatatgagcgttacatggccagcagccagttaccctgttcatttatcgggcgtgtgattcatctatgcatgttgtcagattgacatggaaagcgtgtcatgtattcattctgtgattcatatgatggatgcggatcatcagcttccttttgtgcagcccgggcctagccagagttatctttttcaccgaactgtttcaatcaagtctgcatgaggaactgagaattttttttattattatttcattgtgatgtgatcatattgtttgatttcaagttcatgcagctgaataagcattcatgtttgcacattatttaagaaagaagcctattattgttcatgttaatgtgggtttccattttttttttcaattgcgccctcctgtttatggtgaagaataacttctctagtttgttaggttctattatgattcagtgttttttttcttaaatgaagtgtgatatactgtctaaagtctgaactaccaagtttgaaatttttttacaagacacatgttttataattttgtgtgcattgtacaaaatcttgacctatttttttgcttggtcacaggaaaagatggctggtggctttagggtattgcatcttgtcaggccttttctggggttcctgcctgaagtacagagtgctgataggaaaataccatttag

SEQ ID NO: 61661 - DNA, 3308 bp, Oryza sativa
cgtggcagtttaagaaagcaaataaaaagaacatggacagttgatcggaagaggcaaagcaagaactggagaagtggaaaagtaaaccatgtcaatgaagaatttatagtggggcgagctaggtcaatggtttccgaagatgaggtgcttggatctcggaaatgctgttctgcgatcgatcgctctggggatggggcagcgatcgatcccctcccttcacctggttttcttttttggtaccgcattacttttctattttagtaaatttttacacctaaagtttatacatctcaagtttacacatctaaagtttagagaccaaaagtttataagtcaaaagtttatatatccgatttaaatttgaatttgaattcaaatatttttttatatatagtatttctgtaaatctaaagtttatacacctaaagtttatagatctaaagtttataagtcaaaagtttatatacccgtttcaaatttgaatttgaattatatctgattcaaatttgaatttgaatttaaatattttctatatatagtatttctatacatctaaagtttatacacctaaagtttatagattcaaagtttataagtcaaaagtttacatacccgattcaaatttgaatttgaattacatctgattcaaatttgaatttgaattcaaatattttctatatatagtatttctatacatctaaagtttatacacctaaagtttataaacccaaagtttataagtcaaaagtttacatacccgattcaaattttaatttgaattcaaattttttatatatagtatatctatacataaatttttctaacttttgtttttttaaaaattttgtgtggtgtactgtagtagaaagagaagaaggggaggaggaaggaggagaagagggaggagtatagggggttgcgatcgatcacccattagcctccccccttgatcggaagacacagaaacgcaccgattttgctaaacgtttgtcgcgtgatttctcatcgaaaatttgacgtttttctggccgtcggatggtgcgctagattggtggtggatttcgcgtggggagccacgtgggccgatctggtccgagctcgtgtcgtcctagccgttttctcgctctctcgcctgcgctttcttttctcgttctctctctccctttcttttctcgttcgctccggagagagtgagagctctcgcaaaataaatctccttcccggtgagttggtttctcgattttctccgtaaaaatcgatttctttaaccattgaaaaataagacaattgaaactaaaattatacatgtaaatttagttgatatgacatgtaagtgcactgtaattttgataaaaatattgtgtaagtaaatttgtattagttattttatttcaaatataaaattacaatcctatataactaaaattacatatgtaaatttagttgatatgacatgtaaatgcactgtaattttgataaaaatgttgtgtaaataaatttgtattagttattttattttgtagtccgttagatacaaatccaagggaagaaaaaatctagacccgagtgatggataggcggtcccgaaacgcacatgcactggacatactagacaggtaagcacggcgtaacgccgcgcggtagctgtcgtgcaccgtttttctttttatacggtggctcaatatctgttaaatattacacatggtcgcatacgcggcaacttgagcaggattatgtgcgctacgactacaatttcatatttttgtgttggagaaggcacttagactgaatgctagaatgtgtgtgtatccagtgctatttttagaagaacccctgcgtctatatacgaaaccttcttacgcaatacataaagaaaattaaaccaataatattattgcccaaggaacgtcacacacaagtgtaaataataccgagcaaatatatatcaaagttgatatctgcacttagcatttgaacacggggacaaaaaatagtaatatcccgatattcaagaaaagagtaattcatccaacatccaaaactaagtatattaatagacaaaacataaatgacagagaaacatctgtaggctatttcttgtgcagtagctccacacatcaagacagaaaggattaacatgtgtaaatcaaatagcaaaattcgcttaactcgcaaagttctctactaaatgccaaatatatatatatcctaaacatttgtataaaatgacatacaacaattgagcaaaaagtatcagtgtgaagttaaggtttagtgctcaactatgacgctagcacactattttgtccttctgcagagaaaacaatcccaaccatagagataattagatacaattaggaaatttgaaaatactaaagactaactccaaaatccaaatccaataaccccacggcaataacacaaggaaaagcactattttcgcggcaattaccccgcagctcccagggccccaactgctcgttcgagtaataccgttggagacctcgacaccagcgccatctcttcgtgccactcacgcttcacgtccctgctcctcctcgcatgtgacccgactcacgcacctactaccttgttctggcccttgtttagttccaaactttttcttcaaacttctaacttttccatcacatcaaaactttcctacactcacaaacttccaacttttccgtcacatcgttctaatttcaaacaaacttccaattttagtatggagtaaacacacccgtaaaatctttttctatatggttcagaataaatatatatacccatcaacctatgttttcaatacttttagggaccacggatccattgtgagtcaattctatcctaaaatagcccggaattctatcctaaaatacaaaggagtgattgatttaattaggaatagtaaatttaattgcagaaaaaaaaagtaagattaggctgctgttgaaggcttacacttcacaagttgacataacatgcatatacttgcatgtctgtagcgcttaactgcttgtacaaaactacaacctatgattttgtctggaagaacatttataagattgtgttttctaggttttgtttttttcccatgccttgccaaatgagatattcagaaaaccagattacttggtctgaatccatttttccatattaccatttggagaagattaacatactgctgtgctattacttatttggaaattgtgttatatgcatagattgtttaacttagtctacaggagaagttgtattttttgtatatacataggagatcacttttgctactttgagcagctgtcaac

SEQ ID NO: 61662 - DNA, 1397 bp, Oryza sativa
ctcccacacgaaaaacagagtggtccattagcacatgattaattaagtattaagtaatttttttttcaaaaatagattaatttgaatttttaagcactttcatatagaaattttttgcaaaaaatgtaccgtttaacagtttgaaaagcgtacgcgcgaaaaacaagagagtgggctgaaatgaacacagcggcacggccatgcgtccatgcccgacaccgaatgtctcaatgatgttctgcacatcaaccttaacgatatcgatgctgcagggggcaaggtaggcgtgacgctcaccgtagaaggtaggcatgggcagtatggtgtgggtggacggaccccatgtcgagtacgtacgtagaaggaaaccatgatgatgtccgggtggctggttcctcgatcgtcacccctgtgactgcacccggtacgccaacgtcgcctcataccacacctacggtccgtccccttcactgtccgggtcgcacactcacattactccagtatcccgccatcgcatttctcacgtacacctatcgaacacaacaaaacataagacaccaaccaaacaagaaatatgcatggcagcggaaaaaggtatgacaacacacaggaaacaactcaagtagcactgaagaaataaagaaagaatatatattgatgtgaagaatgtatgggaaaacaacgagatggtcggacttaaatagcaaaagaaagagccaataaagtgagagaaaaaataccacatacttaaggagcaaggaggagcataaacattggaaagaagagacacatgacaacacacatgagcagcatgagagcacgcagcacgcgcatgtcggcacgaggcaagcagaagcagctagctagatgtgtgcaacattgtagcttgccatgcatggactgtaagaagataaggagagagaaacaatccttagctcacaagctaaaacaaacgacaagaacataatactgcgtgtactgtaagaaataacgaatcaggaaggggcacgttagatataaccggccgttaccggctaagtaaaacacaacgtaaaataaaatggaaaaaatcaccgacacgtacgtgggcaccatgtgaagaaagttggccaccagtaacatacaccggatacgtcaccccaataggaaatcaaccggtcaccaaatcagtggaaaactgtaaaaaaaaatcagcaggacacgcggcaagcaatggaagagactaaaaaaatttcaaaaaaccaggaaaatcggaacctgatcggtgactactaggtaagtatttcgatgcttcgcctggtgggcctcgaccatggttcattttccagcagcagaccaataaaaacgatctaatcctaccatacaagttcaaatcaacagttcaaaagcaatcaagg

SEQ ID NO: 61663 - DNA, 573 bp, Oryza sativa
ggttatttccgagcatttggtgcgcaacatccagccggatcttcagaattaccaaggggtcaatttgaactatcaatatcagccgccatcacctcaagttcaataccagcaggcagaatcggctcaacaccagtttgttccttagtacaaccaatttgagcccatgccacagcagcctcaaggaacgcctcaacatcaaccatgggccgatctaatcgcagatgtcatgaaggagcagtttgggcttaggccgaaagatgctggaaatttataccgacagccatatcctgaatggtttgagagagttcctctacctaaccggttcaaggttccagatttttcaaagttctcagggcaagatagcacatcaacttatgaacatgttagccgattcttagctcaatgtggtgaagcatcggctgtggatgccttgaaggttaggttgtttcggttgtctttgtctggatcggctttcacttggttttcttctttgccatatgggtcaattaacagttgggccgatttggagaagcattttcacagctatttctatagtggggtacatgagatgaa

SEQ ID NO: 61664 - DNA, 59897 bp, Oryza sativa
  unsure (1)..(59897): unsure at all n locations
tttattactttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggatatgaaaaagaaacacgctatgtctttgcctccaattactaactatttgcaggaagtgcgtaatcacgaaaaggaggagagagatatgaaagagccaccaattccactgttcacactcaagttcgagacacctccatcatctaaagaggacatccaaggtaaagtaaatggtactgaaattaatcaaggtgagtgcattgttaacgaagtaaatttgtccacttttcatgcaaaagtagagcaaccgttagtggaaccaaatgctggaattcttttgtcacaagttgatttactcgctgttcctggtgataaagaaaagttgtgtgataatgcttcacttatatccatgccacaactagtgaatgaacatgctattcctagtgtttccttgtgtgctaattttaagcatgctgttcatattgttaatgaagttgaggaacgtaaattgctatcttctttaaatactttgggctatgttcagtttgatgattttggtgagctcgataatttgaaggagaaattatttgctaagtatgatttgccatgtctaactaatgctatttttcatatctttggcaaatataatgatagaggaatatatttggtgcatagagttttcatttgtttggatttagagaaacatgttattgctaatcacactatttcgagtttctctagttttgattggatgaaacaggttattttgaatggactatatgaagaacaccatatggaaaaaccgaggacggttttccgtgaagaaggggaggatgatgtgaccatggctactacggatacatccgttgctcacatcatagatgaacaacaagatatcaagttcgagtcctccaagtgccaaaatccaattcggccacctgctacactgcagacttcaaacggccgccgaagctccatacgacctccgttttcaggccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagttaccccttcagggtttcttgggttttgtttagatgaaagtttagccattgctacttcgcttgcagcgcgcgtgtcggctagaccgtccgtctgcttgtattcgaaaccccaacttatcatttgtattaaattcctatttgcagtatcagattgcttttatcttgttcttgcttgtttcttcgatttgcttgcaggaatagggttgatctgcactggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgagaggaactcaaggttcatcaatctccctctctctccccctcggcccaagctgagccgcccactcgcgcgtgcgcgtgttcgcccgctgacaggtggggcccgcttgtcggggtcgtcgtcttcctcgcgccgaaaccctagccgcgccgcaccgccgccgcctttccaattcggccgcacctttcccgatccggtgaaatcgattgaggggaaatgcttcccgagatctcctctacctttttccttttggaatctatcgctatttcgctttggaaatcgccggattcgagctcgaatcggattcgtttctttccctttaaccctaacctttccatcgcatcgccgaccgccgtgggccttcgccgtcgcttcctagcctctataaaagggatccctaggcccttcgctacccgtcgccaccctcgctttcgcctctcgtcgctggtagagccctagcgccgtgccgcttagcgccgccgttcgtccagccgtgcgccgccgtcgctctggtcgtcgctcggggaagccatcgccgggttcgccaagtcgtcaccgtcccagtcccgccctccgttttcaccgaggatcgtcggagcaccgccgtcgtcgtcgacccgatcgtcgccgccgcttctaccttgacgccgatgccgtccgttgatcttccgccgttgatttggtcaccggtgagttcgccgcgtcgcccgcatcgttttggtgcccttcgttagcgctgtcgtgccgtagttcaccggcgagcttgcgccgtccggtcatcgccggtgatgacgtcatcgccgacgtcatcgtcgccgtgtctcgtgcaccggtcgtgggccgatggatcctggccgtccgttgtggataggatagatctcggccgttcgttccgtgagccgcagccgtgcgcccggtccaccgtgcacccgaacccgctgacgcaataatcctcttttccttttcaaaaataattctttattgcgtcataattcaattaaaatccatataaatgctttaatccggtttaatatttaaaaattcataactaattcattgtaactcggtttaatgtggttccagttgcaaaagttgaataaaataaagatctacatattaaaattatccataaattgaattaaatttatttaatcctttttaaataggctgtaattagatttaatcttgtaaaattcgtaataaattcatatgaagtcagaatgaggctgttcaagtctcatgtttgtttactttatatgtattgtttatttagtttttattagtctttttcctcgttttgcgtgttagcttgtcgtttccgtcgtttcgaaggttcgcgagtgcgccggaagtgttcaagaagattaattgaagacccgttattacaaggcaagtcacacagatcctaaacacaattcctttgagcatgttgatcctatatttaaattctctatttgtttcaactgtgcatttattttttaatgtcaccgggtggtgtgaacttattcctttgttatggcctgtttgcattgattactctattccttgataccttgtgttattataatttgactagttgagctttatatattggttcagctagatgttagacataattgcttagccatgcttagaaacattagcacacaattgggataactaatgcttcactattatttaatgatggcttaatgatagctcacaatggtcaatcgtgattggttgattaattaatgtgccaactaaaacttgataatggtgggttgtgagcacatggttttgatgatagtgctcatgacaattaaggaccggttcatgattttcggttgtgaatcatttaccgtgccaaccacaagccagaatgggcaacggctggacactttgtataacaaggctcactgcggagcaccagactgagaagtggcggagataagcccacgggggtcgctggggagtccatgccttgtttaagagggtgattatgatccaggaacggtgcactgctttgggttgtgttatgcgaggggtcttgtcacaatcactcaacatggtgacgtgtctggccgggcacggtaacatgctggtgggttgtgtcttgtgggtacaatggtacacctctggccagagtaaaacaattcgaatagccgtgcccgcggttatgggcgggtcgaacaatgtctttcgtgattagtcccacactactcattaataataatgtggtaattgatggtaattaatttagctcctggtttggaatggtacattcctggtttggagataaatctgtgcagccgggtatggttgttcaggatggttgggcctgtgcagcatgggtgtgctgttcagagttgattaatattgatgattaattactctactgttttacaatttttactatttgctaaatgcttcttttgcaaatgaaccctatattatgccattctttggtatccttgtgcacttgcatatttgctgtgtggcttgctgagtatgtcatatgctcaccttgctataatcaatcaaacctcagttgaaaacaagttgcgaaggagaagacgtttggcttataccccagttgagctgcctgtgggagtggagccggagcttcgctagaccgtaattccactgcagttttcttttcttttgtaagtatgtaacgttattatattgatgaatctttatattaaattgtcagtttgtgtacctcggcttattcctggacgaggatttaatgcaaaaattagttcggaaattactagtgaatttttgggcgtgacatagctaccggaaagtccaggccacccgcccgaagtgtctgacccaccgattggatcgccaatcgctttcgccgccatcaacccgagcaccacgtctggtcgtctccctgttgattgcagccatcgaacggtttagaccgccgcctgaagtgtccgattccaccgatcaaaattccgttgatcgccgccatgctccaccttgcgtccatgtctgtccctggacaccccgtgtagtcgtcgcggcgtggagcacctccctcgcacctctaccatggatctcccgtaggctctgataccacttgttataaaactggccttgaaatcacatcggaaaccaaacgcggaagaaacgctataggagatccaaacatgatgacgacaccgaggcacgatatttgataacggacttcagccgaggcctacatctccggggcactgattacgggcgctcctgtaacgccccgattttcgttcgggattaaaaatcatttaataatccatttcctagaaattaaataaaagttaaatcaattcaatcaagtgaaattattgggagagttaaaattttcctttaaaaatcattggtcgggaatattttgtaatattccttctgccctaaaatactcggagctcaagaagtaattataataatacaaagttcatttaatcaactgaattaaaaagaaaacaagttaaaatctccctttctttgtctttgggccgccccggcccaattccccttttccctcccatggcccgcgccctctctctctctcggttagcctcccactcctctcttgggccgtcggcccgtttccccactccctcacgaagtctgctttgcctccaccttccaactatccctccctctgtccccgacaggtgggacccgtggaccctacctgtcatctcctacctccggctcccctctcccaacggccatggccgccccgtgctccccacatcgccgccaatcccgcacgccccgcgttcaaatccgtgcggacgtggttaccgcccactcctccaccccttccccctcttctcccctccaaaaccgccgctgaactgccccacttcaccacgtcgccggagcccaccccatcgtcggttgccgcctctcccgggatcgatcccgccttcccgagcctataaaagggatccccgggctctcctcttccgtttcctcctcctccccgagctccccgcgctctctcccactttccccacgcgagcccaagcgccgccgctcgccggcgaccctccaaccggccgccaccgctgctcctgccgccgccgctccgcacgaccgccaccaacgtcttcgccacgtcgtgccgtaacccagcatcccctccacttccccattttgtcgccggaaccacctccccacggtgctcccactccccaccactcaccggcgtgctccagccgccgcctcccgccgcactagccaccaccgagccgcgatgacaccaccatcggcatcgccgtgccgatctccaccccggcccctactacattttcccattccgtctccggaacgccgccgccacgcgcaccacctctcttcgtcgccattgccacctccagccgcgtcacaatgccgctttggtccacgccgacccacgccgtcgcctcccttggcttcgcaaggacggggagatcctcggccactggccctcttcgccggaaatccgctcgagctccacccccctcggtcaccggtgagatcctcctaaaattgtcgtggtcggtagtcgtttccggttacctcgcaccagtcctcacctccctaacccctcaatgatcttccttagatcaaggctgagctcgtccgccccttcccgagcgacgcccgtcaccggagctccgtcgcgccgtcttcccgaggagccccgccgccgccgttccttgccgtcggccgctcgtttgccgtcgtgccgctcggtgagcactcccttccctctcccccttcctccccttcgtcggccacctcctgtgcctgctcgtgacgcgccgccaccacttgtggtcgtccgaccgggtcgccgtcgccgcgctccgcgctccacgccgctaccggttgtgtcgggcagccggatgccgcctccccttgtcgcgccgcaccaccactccctagcgtgcgtcgccgctccccgcaccatcgccggtggccgcgctgccgcgtgctgtcgctcggtcaggccggcctgagccgtgcctgtgtcccggctgcgccgccccatggccgcccgatcggctagggccgatccgggccgtcagttcccgtggaccggcggtggaccgcctcgatggtcccggtccacgatggaccggtgcccttgtgttgccgatcggtggggccagcttgccggcgccgcccctcccccttatgacgtcagcaacccccttttcctttggaaaaataattaataattgcgtcataaatcatatttaattctagaaattcatttaaatggctcaaaacttctaaaattcatatctaattcatttgaactccaaattgggccattgaacttgcaaaattcatctaaaattgagatcaacatgtttgtttactttttatgtactgtttcctaggtttttattagagtttttccttgttttgcgtgccggcatgtagaatccgtcatttcagaagtccgcggtcgcgaggatcagagttcggaagatcgtttgaagaagcaaggcaagtcacacattcgccttgagtattttgaccctactttacaaattttttccgtctgcaaataaatatgcatcgttttgctaattacatgggaataggtttcacctatctgcttgcttgtgccatattatttgatatctgtcctttgtcaactttggatgatagatcgactagcttgggttactatgatgacctagctagaactttatacttagccatgcttaattaccactagctcagttgatgggataattgcagaattagacatgttagtatcatgacgagttgcgtgctcgagacatccggccatgtttcatgctcataattatccaactaaaacatgactgaatggtgggctgtgggtgcatggttttgctggtcgcacccatggcaactaaggaccggtttgcgggaaaccctagaagacatacagcacttgccacaagcgggaataggtaactacctaatttgaagtatagctttccgctggctgacgcatccaggcaagggtgagcgtgatggagttcggatgggccctgcgacggcctatgcggctttctgattcgcctaggcacgagaggggactgcccaccgcctgttgggggcgggggtgaaacctgaggtgtggtgtgcttggtcagagggggttatatggagggtcttgtcacaatcactcgacatggtgacgtgtccggccgggcacggtgacatgccggtggattatgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggtgtagcgttgatcagtggagatctaatttactttaattaatcaactgttttactgttttgctcaataaaatgttttacaaccgcctttatgcaaatagccacaaaccacccttgtatccccttgcacgtctacatcattggtgtgacttgctgagtacggtggttgtactcagccttgctattattccccttttttagaagtgtagtgcttctgagctgaggatgaagttagaggaccaaggctcagaccccagttgagttttgcctgtggagtggagctgaagccccgctaggatcgcctttttctgctgctgtcgtttcttttcggtgcgaggactaagagcctcttctgtaagtattttacgctttatttacgtttggaactgtatattacttgtcgttttgtgtaccctggctggtcctggacagggatttaatacacaaaatagtctagaaatttggtctaaatttctgccacaccctaaaaatcccaaatataaaaattgttgcttaattggaattattagaaataattttaaaagcctagaagagaagatctaatttttaattaataaattccaatataaaatttggctagataaaattttattaaatactttgcttaattctatagttcatagatttttctgggatttatttgagctaaggaagtatttttaataaatggaattgcttttcatgaataatttaaaatgaaaaaggtttaaaaatctctcttttggctttgggccgaaagtcggcccaaacttctctctctctctcccttggcccaatccggcccgcagccgagccgccgctcgcgcgcgcgcgctcgcccgctgacaggtggggcccgcttgtcggggtcttcgtcttcctcgcgccgaaaccctagccgcgccgcgtcgccgccgcctttccaattcggccgcatctttcccgattcggtgaaatcgtttgaggggaaatgctccccgggatctcctctacctttttacttttggaatcgatcgctaaatcggtttggaaaccgtcggattcgagctcgaatcggattcgtttctttccctctaaccctaatctttccatcacgtcgctggccgccgtgggccttcgccgccgctccctagcccctataaaaggttccccaggccctccgctacccgtcgccaccctcgctctcgtctctcgtcgccggtagagctctagcaccgtgccgcttagcgccgccgtcgccgttgttcgttcagccctgcgtcgccgtcgctccagtcgtcgtcgtcgctcggggaggtcaccgtcgtggtcgccaagccgtcgccgatctcgtccgcccctccgttttcgctgaggaccgccggagcaccgccgccgtcgtcgacccgatcatctccgccgcttcgacctcgtcaccggtgagttcgccgcgtcgcccgcatcattttggtgcccttcgttagcgccgtcgtgtcgtcgttcgccggcgagcttgcgccatccggtcgccgccggtggtgacgtcatcaccgacgtcatcgtcgccgtgtcccgtggactggtcgtgcgccgatagatcccggccgttcgttttggatggatcgatctcgatcgttcgttttcgtgagccgccgtcgtgcacccggtccaccgtgaaccctagccgatgacgcaataattccctttcccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgagctgttttggtgattttgttcttttctctttagattccgacgttccgggagagtccgattttgtaggagaagattttgaggaattccaaggctagcaaggcaagtcacaaaaatcccaaacaaccctttgagtatgttgatcccgtttaaagctattgtttctattcaactattgcacttattttcgaatgtcattgggtggaattaagctattgcttgttatggccctttttgttcttgattactttattctttgataccttgggttattataacttgactagttgagctttatatattggttcagctagatattagatatgattgcttagccatgcttagaaacattagcacactattgggataactaatgcttcactattatttaatgatggcttaatgatagctcacggtggttaatcgtgattgattaattaattaatttgccaactaaaacctgataatggtgggttgtgagcatatggttttgatggttgtgctcatgacaattaagaaccggttcacgattttcggttgtgaaacgtttaccgtgccaaccacaagccagcatgggcaacggctttactttctgtatagtatggttcatagtagagcaccagactgtgaagtgtcggagataagcccacgggggtcgctggggagtccataccttttttataagggggtgattatgatccgggaacggtgcactgctttgaattgtattatatagagggtattgtcacaatctctattcgggtacttgtcaagtatcgcgacgcatggttgacatgatgttgaggttgtgtcttgtgggtacagtggtacacctctggccagagtttaaactattcgaatagccgtgcccgcggttatgggcgggtctaacaatgtctttcgtgattagtctcacccctctcactatattaaatgatgatgttaataatttgattaactcctggtttggaatggttaattcctggtttggagattgaactgtacagccggggttggttgttcagaatggttgggcctatgcaacagggtatgttgtatagcgttggattaatattgtttaattattatttaactgttttattaaattctgaagtatttattaaatgttgtttatgcaaatgagactatactatgccatcctttgttatcctgtgcacttgcatatttgctgcgtggcttgctgagtatgtcatatactcaccttgcaatcattcatcagaggaggagttctacagcgatgccgatggagtggatgattaggcgtagccctggtcaagctgcctgtggaggggagtcgcctgcgctatttatttatttttccactgcttagaactttattgattgagaggaactatctacctctgtaatgacattttattcgcttattaattagagtaataattgtactctattatcaatttgttattgtgtacctcagctgattcctggacgagggtttctacacatgtaagcgtttggaattttggatagaaattccgggcgtgacatttctgggcgtgacagctcctcccggatccagcatattacagcgtatcagagttacaatgactcacggcaggtcgccgccggcagccgcttcctctcgctatgctatgttgccatgcggttacaacaggcatgcccctctatttatgagagagcctaggatagagtccgactcttactctagtcctaatacctagtacaactccaagtcctaaactgtaaccgactacgtacatatatttgacacaaactctaacagtatggtccctgctctggccctgcaagatctgattttgttacctggatgaagaatgtgcatattggtcagaaccaaaatttctctttttctaggggactttaatttttacatgtcggtggaggatagaaataagtctagggcaaatataaatgatattttcatctttaatgatattatcagctttttgggattattagagatccctttgaaaggtagaaggttcacatggagcaacatgcaacagagcccactcctagagagacttgattgggttttttgttctgcctcttggactctgtcttttcctaatacaactgtagttcctctcacttgaaacatttctgatcatgtgccttgcgttgtcaaaatcgacaccaagatccccatgtctccaatttttagatttgaaagtttttgggtgcaagttgaggggttttttgacattgtggctcagatttgggctttagatcctgggtttgatgatactgccaaatgtatatcttataagctcaagttgcttaggaaaagacttattcattggagcaaaggtctctccaaattagcttccctcctcacaaattctaacagagttattgattttttttgatctaatagaggaaaccgggcagctcactgttcaggagtggaatttcagagaaattgtcaaagttcagattctcaagctcttagagtttagaaatcaatattggaaaaaaaggtgcacacgtagatagatgctattaggggaggaaaatacaaagttctttcaatccattgccactgagagatttagagcaaactcaatttctcatgtttatgatttcagtggtgttggcggttgttaaatgccgattctataccgccaatatctgcataaaatccagataataaagcatccaacatagtaataggtgttaaatctcacattttccacaagtgttgttgtatatttgtatgcagatgataaacctagaaggtaggaggaaaatcaaactaaagtggagaaggaaacatatccatacaaggatggactttgaactttatcaaaacactagagaatcagcccaaaaactccgagaattggatagagcaggatcagaggaggagatgggccaaaggccatgctaggaggggccagccatgcaaagaggccgaaccaacatctcagccatttaggctggggtttggcatggacgctcctcatcactccctgatggcagttgcagggaatttccgacaattcgtatagtgattaccgtcgtaaatgtccaatttaaggagcttcactccttcacttctccacacacttccaagcttgagctaaactataagagactattgtactatttgtatactataattaggaagagagtagagtagaagaagtcggaagaattctggagctatcagtaatcttctcctatttcttttattctgtttattacactaatattaatagaattatcttcctgaataatttaaatttatcctgtgagaattatttcttggttagttcctaaatagcatataggattattgttcactgtaatcaactaaaatatactgattgctttggtgagttataaatactaaagtagatattaattgcttagacgtggtgtttatgtaattattatccagtaattgctgcgtatcccacagtacgtttgaggtgggtgtagaggtggtgacagccctcaggagcacttaagtcctccctgtctgtgtacggagtagagcgacatctgggaacagcgggttgccagcgcctgaagtattgtgttatgattaaaattaagctttccctagacactgtttcccaccagtgaatcctcactatcctagcctacctttgcttggtttccttggatgaaccggaggaagaattaatcacacacattcccttggatttgatacccttggaacactccgtaggggaagtgctacatcggtatatccgtgcgattgcggattttatctgtgatcgtatgaaataccaacaagcatttatggcaccgttgccgaggaacggttgctgattatttccgaacccagttcatcctcgtatctctttattttcatttttattctaccttcacccctgctacctagagaagtattcatgttcaattattctcaaccatggagcaacctctctttgagctgtctgctcctagggatgaattctatgagccacctccttcatcgtagccaatttatacaattggctatgaaattcgccccgaactaatctgcatggttagggagaatccttttttctagtcttgatctagaaaatccctaccatcatctgtgggactttgagcaagtttgctcatgccttaagattcgtggcatgaagcaagaaactgtacggtggaagttgtttccgttctcccttcaagagagagcgaagcaatggtacacatctaccgtaggatgtgtagacggtagttgggaaaagttgcgagacaggttctgtcttgccttcttcccagttacccgtattaccgcccatcgagtagaaatcctcagtttccggcagatcaataacgaatcaatcggtgcagcctagtccagattcactaatctagtgcagtccagaccaaccttgtctttacccaagtatgtgcttttacaacattttcatacgggtctagaaacagagtctgcattctatctggacataacccccggatgatcattcatgcataaaatgtcgtcagaaggaaaagtaattttagatcgcattctagaaaatacttccttcatgacgcaatgcgatgaacctctgctggaggcattcgtgtccaagatagagaagccttcgacagtcgaatcacaacctgaactttccacttcgaccgactcgactgatgaagtagttcccgagccgccatccattcagaatgaagaaattcagacttcggattgtgctccaattttattcagggatggccttgatgaagactacggcaacaccctgaattatttcagtaaaaagatgctgattgttcctttgccacctcccgatcctatggaacttgcattcctaagacaaactgtctgggacgttacatccataatgagtgacgaacggctaagggaggcagagctttcatccgaagtaatttggataaataccgctccctgagttattccttatcgtctagaagggaacggcattggcattctttacagtcaaactatcggggttaatctcatttctgagtcatttgcatttgtttacctaagcgataaagcaataaccccgacatacaaattcttcaagcactcaaatggaaaaatcattgaaggatttggaattgtgcaagatgtacatgtccgctttcaagatagggaggcagtcttggattttcatgtctttaaaatccaagactttgacattttggtcgggtgccaattgagcaactcctcataaacacgctcgattaaacagcctcaagataactttgggagggaacgaattttcagttccattctcgcaggcaaggtttgcctcgaccgactctctcccagaagatgagtatgtggtggaagtaacggaagttctctctcacgagtctcctgagacccttctggaaaatgaagtccctaacttcataaaagaggaagcggaacccagtgagactctcgagcttccaatcatagaaccgccgcctcgacctccgattgcgctgaaacctctgcctcaaggcctacgctatgctttcctgcacggcaataaggaagctcatgtcatcataagtaacaagctttctgaagatgagactcaacgtcttctagctgtgttagaaaagcatcgctctgttcttggctactctctctaggatctcaaaggaaataatcttgcgctttgcactcatcgtatccctattgagcccgagagtactccctccagggaaccacaatgacggctcaataatacgatgcgagaagttgtaaagaaagaggttctaaaactcctgcacaccgagattattatctcgtcccatacattgagtgagttagcacagtccaggttgtgccgaagaaaggacgaatgacggtcgttgcaaatgctcaaaataaacttattccgcaacgaaccataactggatggaggatgtgcatagattataggaagcttaacaaggctaagcaacggatcatttcctgctatgtttcattaacaaaatgttagaacggctggcaaatcattcctttttctgtttccttgatgggtgttccgggtatcatcaaattcccatccatccagaggaccagagtaagaccacgttcacatgtccatacctatgcttatcgtaggatgtccttcggactgtgcaacactcctaaatcttttcaaaggtgtatgatgtccattttcttggatatgatcgaggacattacggaagtcttcatggacgacttctcggtctatggaaaaaccttcggtcattgtctacagaatttggataaggtcttacaacaatgccaagaaaaggacctggtactcaattgggaaaagtgtcattttatggtccttaaagggattgtacttggtcatagggtgtccgaacatggaattaaagttgatcgtgctaagatcgatgtgattgatcaacttcctcctcctgtgaatatcaaggggatccgttgtttcttgggtcacgccggcttttatagaagattcatcaaggacttctctacaattgcctgactactgacaaacctgctagctaaagaagctccctttgagttcgatgacgcgtgtctaaaattctttgaaattctcaaaaaggcactcatctctactccaatcatccaaccccctgattggacactaccctttgaaattatgtgtgatgcaagcgatttcgctgttggtgtggtcttgggccaaaccaaggataaaaagcatcatgcaatctgctatcctagcaaaactctaaccggagctcagtttaattatgcaactactaaaaaagagctgctcgcggttgtttttgctatcgataagtttacactgatcatgctgctctaaaatacctgctcactaagaaagatcctaaaccacgtctcttgtgatggattttgctactccaagaatttgacttagaacttaaggataaaaagggagtagaaaattccatagcagatcatttgtctaggctgcaaatcactaacacgctcgcaggaacagtcgataaatggttttctaagagatgacatgctgatgatggtgcacgactccaactcatggtatgccaacatagtgaactacatggtgttaaagtacataccacccggagaaaatcaaaggaagctgaaatacgagagtcaccgtcatatatgggatgagccatacctgtatagggtttgctctgatggtctattgagaagatgcgtgccaactgaagagggacttaagatcatagaacgatgccacgcctcgccttatggtggacattacagtgcattccgcacccaggcaaagatttggcaatgtggtttcttctggccgacaatgtacgaagactcaaaggaatttgtcagaagatgcccaagctgctgtaggatcgagatgtcgactagaggggggtgaataggcgatttaaaactaagtggcacgtaatcaaaactaacctatgttgctagggtcggtgagagacaagtctaactaagcaactaagttatgttttgcaatcctagggtgaaagtggttcaagtgtatcactaggaaagtaaatcacacaactaaattaagttttgcaatcctagggtgatatggccacaaataagtttttatgaaatataaattgcacaaatgtaaatgcaacaaataaatgagacaagagacaaggaatttttcactgaggttcggaaactcgccgatttcctaatccccgttgaggtgagcccaactccaccactcaaccacgaagccgccgcacgcccccttcgtcaaggggtgggcagggcaggagttggcccaaggagaggactacccaagcctcgatcactaggggtagttctttcttcactccgaaggtggtgaactccaaaccactcacaaaccagcgccgggcctcctccacgatctcctcggagaggtcaccggcaacacctccacaagccgtctaggaggcggcaacctcccagagtaaaaagcgatgacccggctcggagatgatcaagtgccacactagctctacaatggaagcaaatgcacttgactcttggctaatcaaccctctaacacactaagtggatgaatacaaagctcaagtgagtgtgggagaggtgcaaggggtgtatgcaattgaagtgggtgccaagagagtccccttgctgctggtgggggaggtaagtccactcgtgatccgccatttcctaaccctgcaggaactaatgggatgtcaaaagaaacgccatctactgactcggctgacaaggagatttagccagagaaaatcgtgccgcaggactactgcgacacacggttgctgccattccctcagcggagtaggaaaccgtcagtggacgagcagttcactcgttttgttgaagtaatccagaagatccacatcaacatgccgttgttcgacactatgcaagtaccaacatacgcctgttatctcaaggacatactcaacaacaagagaccgctcccaacaatggaggtggtcaagctgacggaacactgcagcaacgtcatactccacaagctcccagagaagaagaaagatccggggtgtcccacgatcacctgctcgatcggggcacaacaattcgaccaggccttgtgcgaccttggagccagcgtcagcgtcatgccaaaagacgtctttgacaagctcaacttcacggtgttggcaccaacaccgatgcgcctccaactggctgactcgttagtccgttacccggcggggatagtgaaggatgtgctagtcaagatacgggatttcttcatcccggttgattttgtggtgctagacatggacacagggaaggagaccattcctggggcatccatcctggggcatccattccttagcaccgcaagagccaacattgacgtgggaacggggagtatctgtttccatatcaatgggaaggaggaaaagtttgagtttcaaccgaggatggaacaatgctccatggtcagaatcaagtacgggccaaacccacagaatattcaagtggtcgaagtggagccacccaagacggatagcctgataaagttcatgcagaacttcctggaaaaggaaacaacaatacccaggaaccgttattggaggacgccggtaaaatcacctgtaccggccaagaagttagagcagccggctcagaagaagccgtcttccgaaccgaaatcaaagaaggtgtggaaggaaaagccaaagacgcccgctccatcacctctggagacgggtggaaaatccgtgcactgaatcgaaaggaggtacggtcttgcacgtcggactttaaatgacgcgaccttccccaacaggtaaattggaatgtatccgcacatttgctttcaacaatttgaatttttgcatcaccacatgtttgaatttcaaaattgcatttagggtttttgaaatttaaggaaatccttcaaatgaatttttcagagcaaaccaaaataaaattttcaacgaaaattcactgtgccacgaccgcactgaccgttggattccaacggccgaaagtggggccgattgggcccacaaggggttcggccgaacaccctggttcggccgaaccggccaggccaacggtcggctccttcctcttttgaggcaacggctagtgggtcccacaggtcagttttgaccgttatgggtgcactacttaagccacccggccgagagagggaattccaccctatttcaatacattttcatgacgagtctagtactcgctcatcagccgatgtcttgacggaagacgccgacgctctgcgacaactcctgagcgacgttgacctttaccttatcagtaatcgggagagacaagccaactacatgctgagcgaccgggagtatgctcacacacgagaatactcaccggagttgctgaaaaagataggtatggatgttgaatttcgttctatttggaaatctgttggttggcagaaatttgttgtggtagatgagcctggttctcgtttgcttactttgaaagaaatataagatggtatttcttttcgcattttccgtaaggagttcacgctcacatggaaaggcttgagtatacttcttggtttcacgattcctgtaaaatcgatctctagaaaggaatttctgggttcgagaaaaataggttttgggaagatatttctattgctccaatttgcaagaaacctagaacgaatgatatccataattctacacttaggctcatgcacaaatggattgctatgactttgtttcctagaggtgatttaagacccattaggggagatgaattaattatcatgtttgccatggttagaaagtataaagttctctgctcctgttgaatgcacttctctgattactcagaaagaaaaaggcctaggggtcgttagcgaccagattgcttttatctcagccgctcgtccgtgtattgatgaggcctatctagtgcaagggcatattttgaaacatggagcagatggatatttgaaatactttttccccgattgtacaaatgaaatcatgttgctaaatgcgaggtatcatttgtacaactgtcatgaactaaccattcccctgcagaccatagaagaatctcgtgcaggtggaacatacacggagacgcgcaacatgacaaggaacgaacaaggaagttcatcatcctcgacactcgtgcagatgtatgaggcaggttgggcaccaactggggatgcaaccggatggacccaagctccacgccatagcatcgtagtctcaacctgggcaagcgccagtgaggaccggtggcatacgcctcgtgacatccactgggggaacaaccaaccctccagatcaagtggtgtgcctcaatctccaaatgaatggcgctcaagttcttctcgttgggacttgggtgaaatcactaggagaatggacacccttgatgtgcagacgggggagatccagtatgacctcgcggaacacatagctcaaacgcaagaatggcaacaatctgctgatgctcagttcgccaacatcaacaacaagatgcaacaacagcatgctgacctttaggcgtactttcgctttcaggggttcaatccttatcaaggaccctaagcgaaagccaagcttggggggagacctcgctccccccactaaggtaacttgtatcacattgcatattttcgtttccaattgcatcctataaaacttgaaaacaacataaaaatttgcaaaatagaaaataccaaaaagataggataggtttgagtcatgctaggtaagacaagctagttcactttgttgaaatgatgaatagttgctctattttatatctctgatatatgggttcttggtaagtgctctctcaaagattgaataaaagtagccaacaattatccgggaacctgaggtaaatgtgctacacttactgatctaagtctaagctgttgcaagatatgagatagtaaatatgagtagctacgatcctgatactagtttgacttgaattccggatgttttgtttttcaaaatgataaaattgaaagttccttatttgatataaattcctaccagagccaaaaatgtgctatcatgattaaacaatatacattttggttactttccattccattgaactttgtcaaactcttgtgacttgtgtagatacttctcatgctctatgatcaagatcgtatacccacatatatgcacatgctatactcctacactgggagctaagcaatattccattccatttccatattaccaccaaaataaattctccatgttttcatatgctttcttctcctaaaagaaaagaaaaatcctttttaaaaaaagaaagaagagaaaggagggaaaggcatggttatgaaaaaaaaataaagttatgctccatcaagcatgagcatgattgaaaaaaaaatgtaatcatgccctcccctaatcaataaaagaaggatttttgggagaagaaagtaagcacaaaggagaagcatttttcttttatttttcctcatataccatttccatcatataccacacacacattatgcacgatcttgatcttgagtatgtttagttatctgctctagtctaagtttttgacttagtaataaatgtgaatgcgagtatgccatgtttgatccttaccaagctccacatatcaaaaaccttagagtaggaatcaataaggcaacatttggtgaggaattcattttgatacacttagagagactgagtgaatcacttgaggaacttggttttcttttccaaaatcatttgaaaacttccggaacaagagttgaataaagatcgggtgattggtgctctaattgctgttctgtctttcaaccgcccaaggcaaggagaagcagtgtctcgtgggaatcaggggtaagggtaagccaccatgccaaacattatttaacctaagagagagtacatatatcttgcacctgtatctttgagatatgtagcatagtagcaactcctgatcaacaaccaagtctatgtttcctttcgtccttcactcgggacgagcaaaggttcaagcttggggggttttgttgacggtcgttatcgatcagtttcgaccgtcaatattactaaaataggagagaactagtgatgcttgcaatgcataaatatgttataataataatattccactagtattaggtctactagtaaagaatgatcgtaaagtggaggagaatcgacatcaacaccaatgataaatcaatcagacgatgtcgaggaccagacttatgtatgaatgggccaagaactcagaattgacaagatgaattgggccaaaattcacaagtctgcggagtggagcaatagaggaggccaccagccgaaattgggctggattgggccagccccaggttcggccgaaccaatcctagcgccgttggatcctggttttggcgtggacgtccaggactgcatcccaatgacggttagagggcacttcggacaattccccttccacaaccgtcatacctacctctatataaggagctcactctcttcacttcaacacacacctcaagcaagagctctctcattcctctcaagtttagtttagtagtatctagctcgtggaatagaattagaataggaatcaggagtccggaagtcttcggaagagttcaggtatggctctagtagctttcctttcctcttttgtaagctttgtacttttattagaatactcttctaaatacatttctggtattgaaatactttccgagtatatgagtaccaactttacattatgttcttgttataatgaatgtacggctagcttatttgggagatgctttggtgcgggtataatgtttgtttatgcaattactctatgtcatgacgatgatattagagtagtatctggtagtttaggcgtggtgtctagattacgggatatcattatttggggttatatattgcggatgagaggtgggccgatgatggtgatagctcagtatgggtattcctccgtgcctatatataatcctaagttaatttccgagggagagtattcctccgtatttagccccggttggatggtcatgacgggctgtcgtaacgaactcggcagtcagggtggcttctcgaagtaccaggagggcatcggatagagggtattagctagtatatcagttaactagaatgtatgtatactatgtatattagaagtataggaatagattatccttctcttttctttccacctagcttatattatttattatgaggatgagtagtaatggttgtgtgtcactctacccttggattatcataacccctgcttagaatataattatcacaagtaatatataaattattagttgagttctctctacatgatcttcccacgggataaaataaatacgatacccttggaatactcttgggtgaaatgctacaatggtatatccgtgcgcttgcggatgaactttgtaaccataatataccagaagtatttctgcgccattgctgggaattatatttctagtaatgtcgttaagaaataccaacaattggcctcccatagcgccaccgctggtcaccaagggggccggttagaccggcatagtgcttgtggtcagaccggccactacctgccagtcagaccggtatacaagccgcgatcagaccggatctggtcagtcatcccagtgacagcaagaaatgagaaaattaactcaagtcaacatgcgcgtgacctaatgtggcaatatgaatcatctctttgtctagatcattacccttcttaatagtacggcaaagctaaaattaaactagcaaattttgatcgctcaactcctcgatcaatttaacattaaaacactagttttaccgtcttcctttccttttgctttgcgccatcaattttagtccacaataatcatctatgcgcacacataatgtgaacctaacttaaaatatatagctcaatagaacggttagtccacaaaaacaacaggggcctagatgcttcagctgccagaggcaaggaagaatagctgctcgcgacgcaatgcccctcacatacaacctacaagtcgagatattcgatgtgtggggtattgactttatgggaccatttcccaagtcccgtaattgcgagtatattctggtggcagtcaactatgtctccaagtgggttgaggctatgccgtgcagcgccgcggatgcgaagcatgccaagaagatgttcacagaaatcatcttcccgaggtttggtaccccaaggatggtcataagtgatggaggctcgctcttcgtcgacaaaactttccgagacctcctgtgagacatgggagccaaacacaacgttgctacaccttaccatccatataccagcggtcaagcaaaacgtcaaacaaacaaattaagaacattctgcaaaatacggtcaacaaaatgggcataggatggaaggataagctaccagatgcactgtgggcatacccgacagcttacaagacacccattggaatgtccccctatcagattgtctacggaagtcatgccgactccctgtagaacttgggcacagagcatacaaggccatcagaaactagaatatggattttgagggagtaggagattggaggaaaatgcagttggctgagctagaagaatggagagaaaaagcatatcacaactctaggatatacaaagaaaggatgaagcgctggcctgataaaagaataaagatcaagaaattcaagccaggagacaaggtcctaatgttcaactccagagttaagcttttcggccatggaaaagtacgaagcaattgggaaggaccgtttgacatcatcgacacctcttcgcacggagcgataacactctgcgacgactcaggtaacatatttaaggtaaacggtcaacgtttaaaaattttccttgagccgaataaaacttcagatgaagaagtggatattattgaattaattgattatgaaccatgatgatctcatctaaagcatgcttagttgtcatttttgtgcctagaataagattgtgtgggcctaggaagaaaattggcagccagccggacccaccagggttcggccaaaccccgaaccagggtgacgcccaactggacccgttttcgaatgacagcccccccccccaactcgtttgtagtctgttgtgatgtgcattcggaggtagatcaatcggatcaagcaccagagctctagttctttctcctcctccacctttgcaaaccctcctcttcacctcactcaattccttgctccctctgctcaaaccaccaatggctggcaaatccttaatgccatacattggctcttcctcaaactccacatataaccttgaaggagagccaacaccggccaatcaattgatcccggtggagaattatacaatggaaggggtgaacgcactctgggctcaaccccttgcgacggtgctgggctcccctgcgaatctagagcccatcggcgagctccctagttcttctgaaccaggggttcggccgaacccatctcggccccattcagcagcacgctccctctccccgatgcacgtcacatagacaaaagtacagggtgattcgcctgcgcgacggccgacaatgggcgagctcagccttttgaaggcgaggcgtctattccaagatgacgagaaggccgctccgcttcccgttgagtaatatgtggtcactctctacaccaaggcaggggatgaggtgctccacaagtataccacaaccactgctgctccgtccacccctaagagggatcgcttttgcattcagggagtgcgaactcccggcggtggatatggtaaaggcttgctccgtccattgacggcatcggagaagaagggggtagcggaatcctgcatccctccacctatgaaggtgaagcgtcatttgacgcatcctcctatcattagggcgcccaggcaattccaagaagatgaagtaaaatcgtcggagccctcggtccacaagctcgccgttcaagtgaagaaattccgtaaggagaacatagagcttagggatcgcaatgcgaagctaggggtagaactcgctgaacttaggaacaatatagacacccttagttgcggtttgtgcgctaagatcaatcgcgcattcctagaaatgggaaaggagaataaatactatgctaactacatgtctccttttccattaataatgtagttagtaggtgcttagtttctttattacttcttgatcgttgtaagcatctgttgtcaataatgtggctcattggccttaaccccaatgattgccgattttattttatgatgattaataaagtttaggtttcaaataagtgtgggggagataccttggctttctgatgtgcaaactctgaaaatgtgactaaatatctgaactcctgtgaggcactgaactctgtagaaaattgcagggtgattgggcaccagggtggttcggccaaacccaaaccagtgctggccacaatcaccctcagttttcactagtaagcaggtcagcacgtccactgcctctatatctccaccattgtatagtacaagagctaggaattcagagaataattggttcaagcataattgaaaagataaaacttccaactaatggaatttccgatgattaatcttgtatatattttattctcagctgaacttgttgcttgtgcacaaccatccatgtttagagaaccttattcatctaagtatttgttacatgagagatggttaaagatcaaagaaattcttgcaacatttgtcatgactcttgggaatttgtttttcgaaataaaaattctttcaaacctcacttctctaaatgatttcataattatacctaccaaggccatatgcaagtatatcaatgatgaaccatattgcgcatatgactgtttgacattatattgagctttgccaaatttatgtgactcgtgctagatatctttcatactctcatgatcaaggggtcatatccactttcatttccatataaccacataagctaagcttctacattggaagttggctttccacaaaaagttttattcaaataaactcctactttagaccatgctttcttctcctggaaaatcattggcaacaagaaaaggtggaaaaggcatgactatgaaaaaaaaagagaaaataaaaatgcttgccttcaaagtgcggagcatgatgaaaaaggtagccatgccccttccttatgtatgcaaggaaaattgaagaagaaagtataggaaaaaagagaaacattttatttcatcattccacgaaaatattttacactttccaccataaataaagacccttgatctaggagtatgattgatgatcttcttgagtccatgtatttggctttgcaatatatatgatgcaggtatgtcacaatttatccctaccgagccccacataacagcctgtagaatagggtgaattttggcacaatccgccttggagaggatccacaaagtcagaaacacttgagtgacagagagaaagtcagtaagaggaaaagagctattttgtgaaaaattcataaaaccccatgagtctgacagaggaagtaggaaggactggaatcatgaccgttccatttatcaattacccaagatgataagataaccactgataaagttcacaggtacaggtatggttttgaataatctatatgcttgagttatatcttggaaaatttcattctacactgacctttactcagggacgactaaagagctaagtgtgggtggttttgttggcagctgttaaatatcgattctataccgccaacatctgcttaaagtacagataataaaacatccaacatagtaataggtgttaaatctcacattttctacaagtgttggtgtatatttgtatgcagatgataaaccccgaagttgggaggaaaatcacactaaagtggagaaggaaccatatccatataaggatgggctttcaactttattaaaacatttgagaatcagcccaaaactctgaaaattagatagagtaggatcagaggaggagatgggccaaaggccaggccaggagggcccagccatggtttggccgaaccaacatctcagtcgttcaggctggggtttggcattgatgctcctgatcactccctgatggcggttgcggagtatttccgacaattcgcatagtgataaccgtcataactgtcctatttaaggagtttcactcattcacttctccacacacttccaatcttgagctgaattataagagactctattgtactatttgtatactataattaggaagagagtagagcagaagaagtcggaagaattccggagctgtcggtaatcttctcctacttcttttattctgtttattactctgatattaatagaattatcttcctgagtaatttagatttatcttgtgagaattatttttgggttagttcctaaatagcatatgggattattgttcactataatcaactaaaatatagtgattgctttggtgagttatatacactaaagtagatattaattgcttagacgtggtgtttaggtaattattatccagtaattgttgtgtatcccacagtacgtttgaggtgggtgtagaggtggtgacagccctcaagagcacttaagacctccctgtccgggtacgtagtagagcgacatctgggaacagcgggttgccagtgcctgaagtattacattaggattaaacttaagctttccctagacattgtttcttactagtgaatcctctctatcctggcctaccactgcttgctgtcctttgatgaacaggaggaagaattaatcacactcgttccctttgatccgatacccttggaatactccgtagaggaagtgttacattggtatatccgtgcgcttgcggattttatctgttatcgtaagaaataccaacaagtggccaagtggtttctttgtatgaacagaaggctgctttgttcttatcaaagttttaaaaatagaatgggagtttctacattccccacaatgatctttgatctgcaaaaatttcttctttgctaatcataacttggacagtcttgtagatcctttctctacacatgaaattgacaaccttatcaagataattgctgtagacaaggcccctagtcctgatggtttcaatgggctctttttgaaaagctactgtcctattattgcacaggattattacagactagctgctcattttcatgctgaatgcactgatctacagggtttgaataattccttcataactctggtgctaaagaagacttcccctaaaactgtgaatgacttcaggcctatttcactcatggggatcagtttaaagttcataacaaagttgatagctagtttaaagttcataacaaagttgatagctgatagattgcacggggtgatcttaaagttaatcagtgaaaatcagtatggttttatcaatgtcagtaatccaaaagagagaaaaatatactaaaactggactttgagaaagcttttgacataatagagcattctgtcataatctcagttatgcaacatatggattttctagaaaaatggcttcactaggttcaaatggtgttctcaacagctaactctgcaatgctcctcaatggtgtcctaaggaaatcattcagctgtaaaagaggggtcaggcaaggtgaccctctttctcccttgctatttgtgctgggagctgggctgcttcaaagagtagtgaataaagcttttcagatggatctgttatccaagcctatcaatgaaaatggtggcactagtttcccaattatccaatatgctgatgatactctggttttgttgatggcatcccttttaggttttttgtttcaaagccatccttaattcttttgctcaatccactggttttaaagttaatttcaacaagtctagcatgtaccctctcaatctcactgctgagaaatctgacttgatggctggtttgctgggttgttctattggaactctccttttcacctacctggggctgcccatggggaaagaaggctcacagcaagttcaatgttcctcccctaaggtggtaggctgaccttaatcaattcagttctttcagcaatccctacctactatatgtgttccctacagtttcctattacagttgtcaatgccattgatacagcaaggaaaaattgtctttggagaggaaacaacccaatttctacaaggaaatctttggcatcctgggatctggtctgtaggccaaaggataagggaggtttcggtatagtgaatctcaaagtgcagaacatagcattgttgctaaaacacctggtgaaactttacaaaggtgtaaatctgccatgggtcaatttggtatggaattattacttctctgtaaaggtacctcatttggtttttaataagggttccttttggttaagagacatctaggccctctcagccttgttcagaggtattgcaaaatgttccatccagtctgagaaatcttatcttttttgggatgacttgtggaataaggaactgcatagctccaaatttcctgctctgcatgctctagctttatataaggaggaatcaattagctgaatgtgatctaggactttggaggattgtttcatgatgcctctttctacccaggtttatggggattttttgcaactttaggacttcttgaatcctctgaatttgaatgatgcacagggtgacaattggtgttttatttggaattcagagatatatacctccaagcggttctataagcttaacttcatgtctttgagcccttctaggccttttgtttggttatggaagaccaagtgtgttatgaaagtcaatgattttgcatggcttttattttgtgacaggctgaacatacgagatatgcttgatagaaggcattctgcaaaggaggatgatgatctcacctgccccttatgtcctgaaggacggagggaaactcggctacatctcatttttacattccctttcagtatgtgatgttggcaatctttgggaattgtttggaatcataatttggagttctttcacctcgtaattcttgcaaaatggaggttcagtagaaatgacagaaagagcttcttggaaattttctttttagcatcatggcacatatggaagcagaaaaatgggctcattttttataatattattccatcatttcaatcttggaaggccttgttcgccaaagaaattcttctacatctatgtagaatgaaggatcctttaaagcaattaatctgttttttattggttacaaactttgtagcttggcaaaatttgctgcagcacacgcaaaaatcatgtaattggctaagagacaccgtaaaaacatgacactgccaatgaacactacaaaagttatgtagttagctataggacaccggaggcattattttataatttccgggctaaaaaaagggagagaaatttcgaaatgacgggaatgcccccctctactccttcttcctttcttctcactgcagccaacatgtgggcttgcagagagtgttgtcgtcctcctgtcgccaacgctcaacgccagctgccgtccccgacctcgacgccaccgttgcctccacttgctgccacacccacgctcagaccacctccctccacctcatctcctccctcctcgccccgcccacagctcccctcctccgcgagctgccatcgcctccacttgctgccgcgcccacgcccagaccacctccctccacctcatctcctccctcctcgccccgcccacatctcccctcctccgtgacgccctcgctcgcgcccgcacttaccccgccgaattccgcaacggggacatcaatctcaccatcctccgcccatgccgctcctcggccgcctccccacgcgcacccgcccaccgcctctcttcctctggtgcttgctcgtcatccagaacatgagccgctacatgcgcggtgtgtccaccacgtcgatgtagttgacgacggttaggcaaacctgcaagatggggaggctgcgtctagcgacgagcaggaaggcgaggtccctgttctccatgacgacgcagccgaggcgggggaagacggcgtagtggaaggggcccgggtgcacggcgaagacgcgggacacggcgccattgacgtcgccaccaccgcgtccctccggtgcgaggtgcacgttgacgagcgctaggggaagcggtgagcacgtagaacaggaagatggataggcagatcgacaacggcaaagccatcgacactcggggggcaatccgggcgtttcaaaaaaaatctcaccgctttcatcccgaaaatgataaaataatgagttcggtgtcctacggccaattacataacttttgtagcgtccataggtagtgtcacgtttttacggtatccctcagctaattacactttttacgtgtcctgtagcaaattttgccatagctttaagatcttgctatatgtaaatctctctttaatgaaaatacactgttagacaaagccggttttttcaggtcaacaagatagagccgatgtacacaaatgaaaaagccattaacatacaattaatcaattttaacgggaaatgagataaaatttacaacttgatttaccaaatcaagcgctcaagtgtgagatgcgtgaacaagcgctcaagtgtgtacgcctcgtgtttgtgtcaagtggcctcaattggaagggaagtaaatatgtgcatttctgtgaaagttattactagtactgagcatgctaaagcttttacatgcgccgaaccatatggttcatggagaaaacgtacaaccaaacaatcgcaaattttcttcgccgtgtgggccaagctccgtgcgaacaaccaaagatgctctttttgaatcttgattagttagttggttgtttgtacagtacaacccaggatagatttagctgtgttcgaaccccttctcccggcacgcaaaacaaaactcgtattgttgcatgattaattaagtattatttttaaaaaaaaaatgaatcaatatgattttttaagataactttcatatagaaagtttttcataaagcacaccatttagcaatgtgaaaagtggatgcgcgaaaaacgaaagaggtgggttgggaaaatgggaggaagaacacagcctatagttgaaggcagtaaagttcttttctgctttaaggcccgttgatttatacaaaatatataaaatttggaggatttttagtcttgtagaaatattccgtacgaaggcatttgagacaagagattaaatcccatcttatcctttgaaattccataagtaaggaatggacaacctataaaaattgtgaagaaaatttagtaatagatgtaacctcatcaaaattttattttgagtttatctctcttatcgaatttatgtgtttttctgcgttgaatcaaatggttatttaagcgtttttaatgtgttttacattctttattagaatactacgttgtttctatcaaagagggcctaatagagacgctaacaaagcatattttgaatttgtcgttgtttgtaactccggaatgtgtgtgtcaacataaatataccagagtacgatgaagcacaaaacgtttctgtttacacctaaaattggcatgaatgttcaaattaaggaaaattgctaagatttgggaaaaatcgctggtttcctccatagggccagtctgaccggcgtgtattggccagtcagaccgttgattgagggtcggtctgaccggtggcatgtggtcgatcagaccggtagagtccgagaccgagtctgtttttgtcaggtctcggaattccttgctcgagagactatgcttttggtttcctttggtttctataccgagttgaacgtggaggagaatctgtaggagacaagaccaacccctatataagggacaaagccggttcaattggaggagaatccacatacaacccaatttagccaattgaatcgctttttgaatatttcaaatctagttttagtctagttcgtccatctttatcgatctgcgtcataaatcgtccaccttagctgcaagagggcgaaatccttttgtaggtttgtctcgtaaaccttccgcttatccacgaaacgggtagttatctattgttttaactaaattggctctgctagccggtttaatctattaaaacccatcttaatcaccataaaatgtttaggtgtttcaaccgtgattgtcttcatgtaaaaaaaaaagttgccaacaacttcttgttcaatcgacttgtttattactgattttaaggggtcctaatagtagagaatgacgaagcaaattttgcatttgccgttgtttctaactccggaacgtatgcgtgatgaagcgcaacgcgtttcttgtctaatcgactagtttatttctactacacagccgtagccctagaaacaacgggacgtaccatacatatgcttccttagcgaacccgcaaatcggccataaacacggtgtgccgtagctctgttgccactaccgctcgcccacacattgtcattatgtcaacccatcattacgaagcgcagaggtacactgatccacccagagacatactcatatccctacgtacatcggtacaggtatacgcgaccggccgcggcagggccacaccgacgccctttccggctttcatcccgacccgacctagctaatctatcagccgcccacgcccaggcttttatcaaaacagtccatggtgcacctaccgaccgacgttgtaaagaaacagcagagatccacagtgctgtcaaaaaacccaaccccacgttcccaccatctattcattcttaaatctcgaactctctgctgctgccgccaggcgccccagatccactcgctcgtctcgtctctccgctctcttccggacttccactagtcgcacactagcactcgccactcgccagtcgctacgactagtagctccacctctgtagcctaaagcccaccccccaacaccaccctctgtgaagtagcttgtcctcttcgccgaggccgaggtgacgcacatggcgctgcctcctcctctgctccgcttcttcatcgtcgccgtgctgctcagctcggtcgccgcatgggtggcggcggcgacgacgctgcacgagcgcgacgcggcggcgctcagggacgtccgggcggggctgcgggacctgccggggtcccggttcttcgaatcctgggatgacgccaccgacccgtgcgactatgccggcgtcgtgtgcgagcccgacgaggacgacccggccgcgctccgcgtgtccgtgctgacgctcggcaccggcctcaccgactctcccggcctggctggcacgctcccggcctcgcttgccagcctcactgcgctcacggacttcgtcctttatccaggacgcgtcgcgggagctattccgacggacattgggtcgggtctccggcgcctcaggctgctgtccatgtccggcaaccagctgaccgggcagatacccgagtccctcgccgggctgccagatctgcacacgctcgacctcggcaataaccacctcgacggctccattcccagcggcttgctgctgccgtcttcgcagagcctcaaggtgctcatcctagcgaacaatggcggcctctccgggcagattccagaccaattttccagctcacagcttttccatgtcgacctaagccggaattccatcactggctcgctcccaccgctggcgcagacagtccgctacttctccgtcgcggcgaactcaatgcaggggagcctcgacggcgcgttcggcaacggttcggctccgaccgacttggccttcctcgacctctcgatgaacaacttctcgggttcaatcccgcgggagttgttcgcgctcccgagcgcgtcgtcccttcttctgtcccgcaataacttcaccgggtccctcgccgtgccagcgttcgcatcggagcgtgccgcaacgccgccgtggtcggttgtggacgtcagccacaatggcatcacgggggaggtcccggaggagctagcggccgtggagagcctgtacgtgaacaacaaccggatgtacggcgaggtgccggaggcggtggcccgtagcgtgttcgccggccgcatgacgaccttctacgcgcagcacaacttcctgacgggcttcccggtgccgccgctgccgctgccggactccgcagcgctgtgcctctcttacaattgcatggagctaccgtccgcttctgccgccaacgggtgccccaccatcggcggcccaatggagtccaggcccgccgaccagtgccggagcagcaccgcagccaacgccggcagcagcggaggggacggctgagccgccaacattcctcaaggctgacaggtggggcccacctggttcagctcatcagctgggcacgggtgggggcgtgaggaagggacggccaggatagctaagcctggctcacacattttcgttttgtccgtttgtttcgggtgtggttttcatgtgattgggtttgaattcatcggcatccgggcttgtcgtcgggcgcgcaacggttacacggctacaaggttagcgcgttcttgtgcgtgtgtgcaattactcgctctggtagtttgtacgctgcgtctgtgttactctgttcattgtgagtagctggcagtgtccatttaaacaactctgttcatactctactaagtcagctaatgtaaagggaggcactattttagggggtgtttattttttaaagtacatgtcacattggatgtttggacgctaatttgaagtattaaatatagactaataaaaaaactaatttcataaatgcgagctaatctgcgagacgaattttttaagcctaattaatctataattatgaaaagtttactgtagcatcacattgtcaaatcatggcgtaattagactcaaaagattcgtctcgcgaattagtccaaggttatggaatgggttttgtaattagtgtatgtttaatactctaaattagtgtccaaacatccgatgtgatagggacttggggaataaatccatgtttcccaaacaggcccttagaaaaaaatatcaaatcatctcacttgttgatccatgtttggagtctcgacagagttcgcggtatcggcggttaagagttcacggtatcgacggttaccgtactctagtaactaggtggtaatgttggtatttcttacgataacacataaatatgcaagtgcacggataccgttgtaccatttcagttatgcgtattttcaagggcatcgtatttatattttttaggaagacggtgctacgaagacatacttatatcttttcaatccatttataactaattcaccatagtctagacatgagttataataagaggcaattacgtttttggccctgctttttcgagttgctcatttgaccttctttttttacaaacgaggatgagacttggccctattccgtgaaggcaacatgacggtgttaactcacgacaaaagttccatttatacccttgtgaatttaacgcggtttctcaaagttttttattcaatacagttttgtgcacttattagtatatatcaaattgcgtcaaacacaaatacatggtacaaatttatgtctaccaaaaacaaacaaaaataccatgtcaagcaacaggacaccgcgccacagacggctaactcctgagcccatccatgcggagcagccgccggcactactcctccctccgcccaccggctccgctgctccgacccggccaccgactgtgcagctccgaccctctgcgagccaccatcgcctcaccgtcagtgctccctccctccttgcagaaccgtcgtctccccactaaagtccgccaccgccgacctgccagagccagatgcaccacatgcgcatctcgacgccgccgaatgcgccatgcgcgtgcctcggcgccaccgaattcgtcgcctcgttgccgagcctccgccagatccacctagtcgcccgttgagccgccgctgccacttctccgcctcgtcgagccgccgctcctcctcttcgtcaagccaccgccatccctcccatgccgctgctgccgccgctcctccgccttgtcgagccgccacccaccctactcctcgtcgagctgccgccactcctcctcttaatctagccacccccatccctcccatgacacggctgcgcggttgctgttgcacgaggagggtggcgggaggaagttcctcttagggtctggtgagaaagaggaaagggagaggataaggatttcaagcttcggtgagagagagagaggagaggaagaggataaggaaccaatgttgatgtgtacaagggtattttggtcaattgtggctcataaaaacatttttttctaaaccctaatggtgtgatgaaaccagggttagacgacaactccaattttttaaaaatagggccaaatgagcaaactttaaaaagtagggtgaaattagtggttatgcttcagaacatggtcaaagaagcaattgttccttataataaagtttgatgaggtagcgaacacacatagaagattcacatataatagaatgtctagttggaaatagcctaaggcgaggttgggaatgaagttgcatttatccccttagtgggttttggtgatcaataacaatagggttaagggactaatgagttttattgagcaatacttaggtgttttagtcccaagatgacattgtgtgatcaagagatgcttggagaccccccacaacatagattcgagcggaatcggaactcgaagtgtgcataggctagtttatttcttgtaattgggttttaggaaaaactgtactattaagaggggttctagatgtggttctgggatacaacaagtgctcttagtgagatccaagtgtcaaaatatttttaagagctatttttgagaatagccctacctaggacatatcaggttggctggaagttccggaccgttgaagggtgaaaatttcctaaatgttgtctggaacttcctggaaattccagacctgttttctagttcaaaaatgtgagtaacggctagataacgtcacctagccattatatatatccaaatcatccacaactcactctttggccatttcacttttgcttttccactccatagctgttgctagcctctcccaagagtttctttgcttcctccacccaatcttgagccattcttgagagagagtgagattttgagggtgaaggagaagatttggagaagatttgaaggctaggattggtgtgagcacttggggtatcttgtgggctgacatctcggtgcttactgctcttggagatcatctcttagacggttaggtgccgcccgcgagcttcctttgcaattgtggatgtcccgggaaagtttgtgaaggtattcctcactttcgcaaggaaatgaagtaagtgagtaaagaagcttgtgctgaagtcctagaggttttcctagtagagcaactcacacttgtgatgttttctagaaggatgttgagttggatcttggtggtcactcaaattatagaaaatgacctagaggtgttggggttgaaggctgtggatttcgttcaagatttttgtacaagtgaggcaaggggttaatcgagacccggctctttggagcacctcaacggagagtaggatcgcgagatccgaacttcgggaaaaaaatccaccttgtcccttcagtgatgtttctgtgcatgtgtctatgatattgctacctctctgtttgcctatgattcaactcgtgaaatttggctgagttcctgttagtgttatctgaatttctctgttgcccggaagttctagtccaagaacactagaacttccggtgttctaactaggaggttccgggcctgttaaattttaccgcagcgatttgtttttgagatttcaggcaagcctattcacccccttcccgccccccttctaggctacatctgtgcgcattcaattggtatcagagcttcatgctcctgattcaagcttcaccgcttggagtgatccaagatgtcgcacttagagggagataaagagttggatgaaaatggtgatggatcaactagcaagggaacgtctacacctaagggagcctctatttcttttgattacaacaaacttaccattccctctcataactttgtctccgtgccttccctgcgttctcctcaatttgatgggacatattacgccgcttggaagcacaagatgaagttgcgtacatctaatctctttgcaccctagcatttggaaagttgtgtgcacatgtgttgatgttccaaatgaagacatggagtttaccacggagcaagagaaagcaatacacctcaatgcacaagccgccaatgccattctctctgccttgnnnnnnnnnnnnnnnnnnnnnnnngatggacttgaggaagccatggaaatttgggatactttgcaattggctcatgagggttcacccgccgtgcgtgagtccaagattgagttgttggagggaagagttggacggttcgtcatggatgacaaggagacccctcaagaaatgtatgataggatgatgctccttgtcaacaagattagaggacttgggagtgaagatatgacaaatcattttgttaagagactccttcgtgtctttgttccaagaaatcccatacttgtgtcaatgatccgtgagagaaaggactacaagaggctttctccaagtgatatacttggacggatcgtgtcaaatgagatgcttgaagaagaagctcgtgaattgaagcaaatggtcaagaatgccgccatgatcaagaaccaagagataggtttgaaggccaatcaagaagaagattcaagtggtggtgaagaaagtgaagatgaggagatggccctaatcgtcaatagattcaagcacttccttcgcaagagtggatatgggaaaggaagaaaggaagatgacaagggcaagaggcaatccaagcgagcatgcttcaaatgtggcgagtatggccattttatcgcggattgccccaagaccaatgaagcaaagcacaaggtggtcaagaagaagcctgatcgtgctcatgttgcggaggcacacatggcggaagtgtggtactccggagatgaaggctctcccaaggctatggagaagggagatggagatggtggcgtggctactgtcgccatcaagtcctcatcaacaaaggagcgcctcttcaacatcttgagtgacgacgacaacgactcctaccaccactcgtgcttcatggaccatgggcgcaaggtaatgcctatccaaaagccctctcttgatgatgataacactagtgatgaggatagtgacaatgaacttgattagatgtttaagaattttagcaaaccggccatgaaacaattgtcaaaattaatgaaagctttggatagtaaagagagatttcttgagaggcaagaagacttgcttattctagaaaagaaaaaaaaaccttgccttagaagaagatctagctaaggagggtgagaggattgaattactacaatatgagatttctttgcttaatgattccatggctagtttgacgagtgtgaacgaaactcttcaagaggaacttgtggttttggataaaaaaccatataaatcttgaagtggaaattgacactcttcggaatagcgcatcctctctaaatgaaactcctatgacacctatgccttctattagtgttggttgtgctagatgctataattatgatttgagttcatatgctactaaccttgaagctatggaggcccttgaaaagaaaaatgagaggttaggtactttggtaaagtatggatgcatgaagacataccactccaaagacgctctctacaagaccattgctacaaatccaaacaaagatggacatgagcttggtttttctgatgaaagtcctgtgtccaaacgtgttgtggtgaatgggaagattttcttgatgtttgtaagagaaggaaaggctccacaagaaagtgaggtgactctaccctttgttggtcagagacccggagcttccggacaaaatgtccagaacttcctggcacctgtcaggatcatcgtcctcctcgcgccgtcgccgcagccaaaccctagccgagccgcgccgccgtctccttccaaattcggctgccactttcccgatccggccaaattaatagaggggaaatgatccccgagatctcctctaccttttcccttttggaatcatcagctaaaatcgcttggaaagtgtcggatttgagctcgattcggattcctctttccttccgaaccctaaaactttccttctcgttgccggccgccgtgggccttcgtcgccgccccctacccgctataaaaggatccccggtaccccctctactcgccgccacccttgctttagttcgccgccgcccgtagcgctctagccgcgtcaagccgtgcgccgccgtcgccgccgcgagttcagccgagcaccgccgccgctccggtcgtcgtttttgctcgggaaggccgccatcgtgatcgccaagctgttgccgacctcgtccacccctccgtcgtcgccgaggaacgccggaagaccgccgtcgtcgtctacccgatcgtctccgccgcttcgacctcatcaccgtcgtcgtccggtcgccgtccgccgccgttcgtgcctcggtaaggatcgccgcgtcgcccactacgcgtagatgccctccgtttgcgccgccgcgccgtcgttcgccggcaagcatgcgcgcccgagccgccgctggtggtgacgtcatcaccgacatcatcgacgccgtccgccgtagaccgcgatgaaccgatttgatctcggccgttcgttttggatagggtagatcccgaccgttcatttccgtagaccgccgcggtgcacctggtccaccgtgaacccgagccgttgacgcaataatccctttttccttttcaaaaataattcattattgcgtcataattcaattaaaatctatataaatgatttaatccgatttaatctttgaaaattcataactaattcatcttagctcggatttagttggttcaagtctctagatttttctaaaattgagatctacatgttaaaaatatccacatgtactgttcatgcttgttaatgtgctgttttggtgattttgctcttttctccttagattccgacgttcccagagagtccgatttcgcaggagaagactttgaagagttccaaggccagcaaggcaagccacacagatcccaaacaaccctttgagcatgttgatcccgtttaaagctattgtttctattcaactattgcattttatttttgaatgtcattgggtggaaataacctattgccttgttatagcccttttgttcttgattacctattctttgtcacttgggtaataatttgattagctagaacattatatagttttagctaaagtgaataggatgcttagccatgcttagagacactagctcatataaatgggatacttatgactcacttttatttcatgatgacttaatgatagctcacgatggttaatcgtgattggttaattaattaatttgccaattaaaacctgataatggtgggttgtgagcacatggttttgatggtctcgtgctcatgacaattaaggaccggttcacgattttcggttgtgaaacatttaccgtgccaaccacaagccagcgtgagcaacggctttactttctgtatagtatggttcattgtagagcaccagactgtgaagtggcggagataagcccacgggagtcactggggagtccatgccttgtttacaagggggtgactatgatccgggaacggtgcactgctttgaattgtgttatgcagagggtattgtcacaatctctattcgggtacttgttaagtatcgcgacgcatggttgacatgatgttgaggttgtgtcttgtgggtacagtgatacatctctggccagagtttaaactattcgaatagccgtgcccgcggttatgggcgggtctaacaatgtctttcgtgattagtttcacacttctcaccatattaaatgatgcggttaataacctgttagctcctggtttggaatggtatattcctgttatggagatagaactgtgcagccgggattggttgtttagaatggttgggcctatgcaatagggtatgttgtatagcgttggattaatactatttaattaaatactctactgttttattaaattctaaaatatttattaaatgctgtttatgcaaatgagactatactatgccatcctttgttatcccgtgcacttgcatatttgctgcgtggcttgctgagtatgtcatatactcaccttgcaatcattcatcagaggaggagttctacagtgatgttgatggtgtggaggattagacgtagcccttggtcaagctgcctatggagtggagtcgtctgcgccgtttatcttatttttccgctgtttagaactttattgtttgagaggaactatctacctctgtaatgacattttattcgcttattaattagagtaataattgtactctattatcaatttgttattgtgtgcctcggctgattcctggacgagggtttacacacatgtaagcgtttggaattttggatagaaattccgggcgtgacattgggggaggacccgacaggtgggccccacctgtcggcgaccccgggagagagaggagggggcgcgggcttagctgggccatggccttcggccggcccagcaagggcacgggagggagaaggaaatgggccggcggcccattagggaaaaaaggaggaaaaaggaaaattaaaaagggaaaagaatttccagggatttaaatattgcttgtgctcatttttaattggttaaaattatttctagagctctgaaaattccactaaaaatcttgttagcatatttcgacatgtagaactcaagaaaaattccacatgccaattccgattattatttgcattaatttaattagggtttcactcttgcttttacactggtattttctcgagactatttataaattcaatttaggcttgggagaagaaattcagggtgtgacatcttggttgttttcctttattgtgaattttctcaccaccttgcttttcatacttattcaaaagcatatcgaaagtcacctcagtcttcttaggagctttggaacttgaagcttcactcctattctccttccaaacatcaacctccggattctttggcaccatcatctttggcctaggctctccaatgaacacttttttccccttagtggattcggcttgctctggccgaatcaataccttcttatcattgaaatcaattgtgttcaccgggaaaggatcatgatcaagcttcatcttggaaccatcagtgaatttcaatcgtccttcatctatggccgattgaatctgtcgtcgaaatacattgcaatcattagtagaatgagaatgagaatcatgctatttacaataagctcgacgtttcaattcctcttgagatggtatgacatggcctttaggcaatctaattatcttttcttgcaaaagataataaaaaaatcttatcacatttggccacgtcaaaactatacttaatctcactttgtcgatctttacgaggagtcggcattaaattagaacaaacaaaaggattatttttgttagtccatgaccactcaacaacatatatatcatgatcaccatcatcatcataatcactagcctcagggtaatcaatcaaattaacattaggcttcttaccatagggtctaacaaatttcttactatttttaacccgactttcttgagccagagccttttgcatgagttgactaacatcaagaaattgttggccttctaatctttctttaataggagcaattaaaccattaaaagcaagatcagccaagtctctatcagttatattcaagctataacatcggtttctaacatccctaaatctcttgatataatcaatgacatattcactgtatttttgcctaatcgatgttaaatcacttaggctaagtttagtttaaccagtatagaaataatcatgaaatatttgctctaattgaggccaagtatggatagaatttgccggtaaaaaagtaaaccatgtaaaagcagtaccggacaaagataaagaaaacaagcgcaatttataagtatcagaactactagcctcaccacattgcgctaagaattgacctacatgctcccatgtggtcctactatcctcaccactaaatttggtaaattcggaaactctataaccacgaggatatgggatgttgtcataataatcaggatacgacttttggtaaaccttagcatgattcctagcttcaatcctgaatttatccctaataataccactaatcaattcctccatattctcaggcctatgctgatttggtggtgggtttggtggcctaagaggttgcggttgcggcgcaatataattatattggccatacctagtattgggaggatatcccctagtaggattattgtaaacatttgggatatgtgggggaacttgggtattaacagtagatacaggggaatcatgtactggaatatggtataaaaacccattatttgtcattggatcaatcccctgtattgggatgattgcgccggtctgactggtccagggcctggtttgaccgatctggggtccaatctgaccgtagggaggaaacccggtctgaccggccatctgtcctgtatgaccagcggcgaacgtgcggtctgaccgcccatctggcctgtctgaccggcggcgaacgcgcagtctgactggccgtctggcccggtcagaccggctgaatgcacagcttctccctcaccggttgtttgcatatttgccccatcggttttgctataaatttgatctacaggggctttactagtactggtagaggctttatctttaggttggaaatcggctataaaagaactgaatctattccttataaaatcatcaatacgctcattaaaacgagattcaaacgatgcatctaatttattatttaaagcagcaatggatgaatctattgtatttgctatgagttgttggataggagttgttacctcttcagtacttaccacatcaaaattaggtttaggcaacaatccatgcttgagaaccacaccttgacgagtcctggtgcacgatctcatcaacaccttgaggtgttcctccatgatcttgcgtgcttccccatcaagatcctccaacgagattggaataatattggatggttcaacctccggtttggttgttggcggcttcgtcatggtggcgtcgaagttgagatgacgttgagcagatttccccagcggagtcgccaaaattcgtgctggcaaccttttgtaacaagttgacaagcacgatcgcaacacctaaatgacttacggtgatcctagagtcgctaaccacctcaatctagccaaagctaaatcaagatgggttttgataaactaaatcggctagcggagccgatctagatagaactatggataactactcgtttcgtgggcaaaacggaaggttttcaggataaacctacaaagagctgtcgcactctcgcagtggcggtggacgatttacgacgcaaattgataaagatggacaaactaaactagtactagaaacaaaagtaaaagaacgatttgattaattgatagttgattgcttgtttacaattgaaccggccttgtcccttatataggggttggtcttgccctctacaggccctcctccacgtccaactcaggctaaaaatagatggaaacacgaaacatgcaaggaaacccgagattcgatgaaaacggagtctgactcggactctgccgatcagaccggccacatgccggcggtctgaccggcccactagcggtggtctgaccggccaacacacggtggtcagaccggccctttcagaggaaaaccggtagatcgttcaaattttggcaatttctctattttaatcctaggtgccaaatttgggtgtaaacacaaccattgcatatctgaaaatttgtgagcaatataaaaccttttcatttctagatctaaggtaagaatgaaaacatggtgtgtgcttgcatgtgcataatgagcatgatatgacttgagctctttcatgtaccccaaataaatcacttaaaacagcaaaaacctggaaattacagatttcacttaaccctctttgctaatccaccataaattaatcataatccatttaggggtgaaacctggtcgaggctgtagaccaaaactccctctaccaccatcttttaaaccacagcaaggcaccgacaagtagagtcaaaggctcaatagtgctgcagttaaggagtagggcaaaattctttgttttccccatctctctcaacctctcactgccagtgggccacagggcgatgtgggacccactggaaagcctcacaagcccttcacccggccccaccatctacgacgcgtgcgccatgcctcccacacgtcgcacacgccggccgagttctctccacgtcaaccaccttgacgatctccaccattcaacccgccactccaccgaaagtctcctcctctcaccccgagtctgttacgtggaagagccaaggaaatccatccttcgctcgccgggaacggaagcatcttcatcagtgccggtaagatctttgccgtcgccatttccgcattggtgagcttcgccgcaaaccgagcacgggaacgtgatccacttaccacacttaatccatccgtgcattttggatccagttgcgaaggtccaaatcgtcgcttaatcgcaattcacactctcgccgccgacgagccctagctgctgcacggccacgttctggcgctccggtggactccaagacgagccactacaccatcatcttcgatatctcaaaagagcccaagagcccaagcactcgaagctaggtagccggccggagcgagtagaacaagcattcttccccaattccggccgctggcgtcaaccttcgattctagccgtcccggcgagcctcacatcgtttcctggcacacgcaccagtgcaccacccttgggacctcactaacatcatgcgtaccatgttgcaagctagatcgagccgtcactgccatcccggagtggagcgtcgccaccgaggagttccgcgagccgcgcgccgtcgccaatgaggcttcaccaacccctcacagccactcggcgagtcccctaagtgcccaagacaacgcatgcaagcatcaacacccctagatccagcctctagagtgacatgcaacacaaaccgagagccatcaccgtggccattgagtccgatcaccattatttgcaacaagaccaccgatggcttcgccatgaacccctctacgttttggcctttggtcgctcaccgagatcagcctccgtccgccgccagcgatggtgagaacttcgccgccgcgccgtgccctgcttcctagcccccatcacgctgacatgtcggacccacataattaggcgctgaggattacacttagcaaaagtttaaaacttgcaaggttctaaatgtgaaatatgttaagacttacatgtgggatcttgacctgaaagtaattacctaaatcttgggtattcttaatgaatctcccttttaccacgtgttttgatcacgggttgaatcctggaaacctcaggggcctttttgcatattagccattccctgaccataggaccccatctatttaaaacccgaaaatatgaaagaaaataactaaaacattatcctttcaacagaaaaacattcaaacttgaaattcatataaaatcgaataaaactcattttgacataaaaccaacttctttagaatcgtaagattatgaaatttaatgtggtaaactaaaagatacacttactgtataagaaatacccctaaaatttttataaagaataattaccataaaacgtacttcaacttgtaaaattggaaggaaattcatttttactcaaatggagtgaaccaaatttctgtagaatcagtaacatgtgaacttcaatttagtaaaataaaatttggaccttccgtggcaagatcagtacaaaaaagattgtatagcaaaataatcaccaaacatatagcccaatttctaaaattcataagaaattcctcctaactcaaaatacagtgaaccaagccccgctaagtccacagccatgtactcttaaacactgtaaaaaaaagtacctttagtataatgatcatctctaaacttttacgtacgtagtaaaacaagcactaaactacaaggtataacttgtgaacatcatttaaaatgcacttggtaagaccagtaaagatatacttttcattcttgataaccaaaacctggaacaccctaggacatacaatgtctcccaagttaatataacaaattatcaacatagaccatattactagttgtaaaatacataagaaaatcatacaaactcaaaaaattatgaaaccaattgggttaatcttgtaaaacaatcctctttcacctctgtaaattcaaatttaacaaaatcacctatcaaaagtatttcacaacactacctaggtaaataataccctatgtcagcacaaatttggaaattcataactgataaataaaaagagataaaatagaaattcattcacctaaattcacccactatggaaaaattatgtattttagagtattttgtatttttcacatattttggtatttaattgcataccatgtattatatagatatttgtgttaacggtgaaagtctgacttaggtgctgaccatattgctcaagatcaaggcagtttctccccacctcgtttgatcaccttgaaccctatgatttggggaatgaaattgttattttcaaaatagcacatgtattttgttaatacatgtgcccaacttagtaaatagtagatatgcccaacttgctcaacttggtaaatattagatatgctcaacttgttgcattaaccaccttgaatatttgtgcgctcctctgtttgtacccctacgaatggttagagcacactacctatgctcgattgggtctatacatgctttatatgctactacttgcttaggcaagcctataactatacaaatattcatttttagcactttataaatgcaattttgggcatttatttatttcttgacagaagcgaaaatgtttagtatttgtgaactaaaatgagaataaaatggttttagacttgggcgacaactgttgtacgtatggtggtagttgtacaccgatagggggagtgtttgcccacatccacatgtgctattcatggggaggccttagctaattaagttatttaatgactaactttgcattttggtaggccgagaaagaacgggcagtgcctattgacccgtaatggtagtagggctatctagaggagctatccatgtgtgtgtgtttcatgtgaggatgattcattccctcgtgtgtgtgtgtgtgtgtgtgcgtgtgtgtgtgtgtgatccgtggggggacaactaactattccacctcacagaatgggtgtctaagtttgttcaatacaacagtattgtgccttgtggggaaccgggttggttgcgcctatggcgttaggtttaagccatgggccagccacctagcgatgttacagtctagatgtagcatggagtaatacacatcatgctggtgcaaggctaggcattagataatgtaaaggcttcgttgtatcctctagaccacattcaacatgtagaatgtggtagtgcttcgcgagcacgagacaaactagattgttcataacatatgggtaaaactgtacaaactctacagagtctaaaactaatcgattaaccgtgctcacggtcaagagcgacttggtgaggtgtcatgagtatagttttatacttttaaattgtgtttgtgaaattgtgacttggaaatggtgattcgaatttgtttagatgattttggatgatgagattatgccttgttgccgaggcaacaagggtaataatgtgaatttgctatgatctgtattatggaacaattatactctactttaaaaatgatttacaaattccttttgcaaatggttgtgaaacaaaacttgctccaaaaacaaaactacaaatagccatccttaaattataagccttgcatgtagaatgttatgaatgtactgactcttgccatacatatttaactttgttttgcaggtgtcagacctagtttattttgagtgatcgggtaccgttgtttctttaggacttgattctattagtggtctacccctagtcgactgcttgtggtttgggtagccaagcttccgtgaatctaattatatttgaccggtcaacctatgtatattccataatagtgttataaactgaattttattaaagttacaccctattttatatgtgtaacattgctttagatgaaactgtgggactagtgcttatcttgtgaactagtcctacatgagtatgagtttagagcatttgagatgttattgagctctagcgattttgtcaagtctcctttgtgtggtttgacagacatgtctcaggctaaagttgactagcacgcttagtcctagctagcaatatgtcacaccctgaagttcttctcccaagcctaaattcatttaataaattatcgcaagaaagctaattgtttaaggcaagagagaaaccctaaattaataaatgcaaataataatcagaattggcatgtggaatttctcttgggttctacatgtcaaaataagctaacaggatttttagtggaattttcagagccctagaaataattttaactaattaaaatttagcacaagcattaaaaatccctagaaaaatccttttcctttttcttttcttttccctccctttttcttccttcttgggccgccgcccgttccctcccctcccctgtgcaccctcagctggccggcccgaggccgaggcccagctagccaccccgcgcccccctcctccctccgggtcgccggcaggtggggcccacctgtcgggcctctcccctacctccggccggcgctgtccgcgctcgcgaccgccacctcccgcctctcctgcgtctcccgcgcacatcgcccgcctcccgtgcgcggcccgcactcccccgtaaccgccgccacactcccccgcttgcgcccacacttgagatggctgggatttgaatttcgaatcccgccggcctctccctctctccacctcccccacttcgccggccgttttgcgcccctaccggccacgtctcgtcgccccgcgcctatataagggaccacctcaccctcctccacctttttccactttttgccgaccgctcccgagctctccaccgttcccacatcgtcacacccatcgccgccgcctcttccaccactccggccgctgctagccgtcgctagccgccacgttcgccatcccgcgagccgccgcgtccgccattcacctagccgattctgccgccagagcccgcctttgtcctcatgccggtgagcacctccatggccgccgccttcggccggcgtccccgtcctctgtgatctctctctccctctctaatttctcccgttgtgtcccttaggcaacccaggagctcgtccgcccgtcgccgtcgccgtctcgccgctcgctgtcgtcgatcgtcgtcggtgaggccctcctctccttctctctctctcggtgccgcttagcccgccgcttagcgccgctccgtgccgccgtgttgccgccgcttgagccgagcccgtgcgcacccgtccgcttgtcgccgccgccatccgctcgatccaccgcccgcgtggcagcccgtgtgggccgccacgtcggcgccatgtgtgcaccacgtggtgcgccccctcccccggtcccgtggactcggtccaccgtggactggcgcacctgtgccacctccatgtggggcccgcctattggcgccgctctctccgatgacgtcatccgaggtatttaatgcgcaataattcaattaaggacttttctgttatagtaataaacacagtgaatcttctaaaattcatagaaaattcatccgtgctccgtttaagcccattgaagtctcagtaaatcaagaaaaatgcaaagaatctattaaaaatggttttgttctctatttcagtagtcttatagcctgtttgcattgtttgccttgtatgtcgcatagattccggctctcccgacgctctggtgtacttcgaaatagtcgctgaggtccctccaaccgcagagctaggcaagtcatgcttgtcacttgaacatattgaccccatgttgcaaattctctatgtttcctttaaattatgcattgttttataatgttactatacgggatgttacctactatgctcagccatattatttgtgtacctcatttctttgttagcttgggttgtaatatgactagatgttggattaggatttgcttagccatgcttagttcaactagcacacaagagggaatcacattattgcatagacattggcttttagcataactttggatgggtgccaccgcaatggtgttaattaattaaaatacactaaatggtaggctgtgggtgcatggttttgctagtcgtgcccatggcaattaaggaccggttcgcggaatgcccaggaagaacttatcgtacttaccacaagccaacatgggcaatggctaggcttgtagtgtagctttcctctagctaatgtagctaggctagggtgagcgagatggggttgggtcggccggggtgctcggttgatcggcttacggattcaccgtggcacgagagggggcttgcggattcaccgtggcaccagaggatgctatgggctcgaggttttaccccgggatggagaaacggtgaagggcggcgacgcgtggtgcggtgcggacgaagcaaaggcggctagctgttggtgacgccaaaagtgttcgacgcatggttcccggtgtccggtggtcctcagcttccccaatggcaacggcggcagcacgacaccccctccactccctccaaccaccagctccgaacggggagtcccgcaatatggtctttggtagcggtgagattacgcacacaaggtgttcgacgaaatgtattcgggaagaaagctgagaggaatggggatttttgttaggggcttagcttagggtgtaaggaaacggtgtggataagatcaccagcacatgcccatgcgaaatagagctctaatggctatcggataagggcaaggaggtggatgacgtggataaggtttgatctcctcctccattaaggttctgtagctccatcatcgtacctaaagcctaaagtctgtgcgttctagctctagctatggcaggaggctccgttttacctagcggacataaggaggggcgccaaaacatcatgagatgtggataaggttttctcttctctctcacactcagggattgggggaatcaaatggccggtattaggtttgcaggcctcaaagctaggggtgaagaagggcgaggtggcggccgttatccctcggcgtcgagaggcgacgcgcgatggcgacatcgatgacgccggcgctcgtggcggcatgggcggagcggcttccgcggctggggcccacgtgcgagcacggcatggcacacggtctcgctaaccatggtgcatggtcacgcggtggagtggcgcacggttacgcaaagaggggcgcgtggtgggggctgggtcgctgggtgttcggctcactaggttcgagtcgaacacctggcgcgcaatgaacagtgccatgctggaagaaaaagagatttttagggttttggttgatttaaaaatcgagaaagatagctaattcaatttgtattttcaccaatgcatttgatcaacaatattaagtattcaaatgtcaatttggtccaaaattaatattgtccaatattttaaattttactatagcttttatgatttcctatataacttgtaggctctgatatttataaaaattaatcaaaatattctaatgtgactactattaatacaattagctcattggttgtacttatttgtctagcaatgtattttacacggaaaagtttaatctattttattctagaggtaatttgagacttggtataatattgatctaagtatttaattagatactaccatccttcaatctttatatatagggatccatttattttatgtgaccaattattttatatgagtgaattttatgccatgagagatttgttgtaagttagagatattaatttaattattccagtggaacactcctatatatagagagtcattgtagtggcaactatttcatggttactcagatgtcatgacactattcaatccgtaacttatagaaactaataattgacttgtactttatttggctttgctatcttgtgtatcaatatttatatggttaataataaataatatattattgtgattattacttagatgtatatatttagtttaattttccattgtgacaattttatagtttagcgagcaataacaatcataacagccagcatgatgcaaaagttttaaaaagttcgaaattttagtgatttttattatcaggaattttcaggatgttacactctatctccccttcctccctagagttcgagtatgcgtcagatggtggctactcggaggagtagacttcgtctgtgccatcgaggatgcatgtggaatggtgtcgcccgctgctatccaagtcaagacctagtttaggtttatcctttaatttccgttgtatttatgtaagactttaatatgtttgtaagacgtggatatgtatgtcaacattgtcgtttatgtaccctggccagtcctggactggggttttaatgcacattctgcttggacttctattcgggaatttctgggcatgacacaatatctcctatgttatctactcaaggcttcgggctttatatatgatttttttacggttaaaacagcaggagaggctcctactgtgcggctttatttatgattgctacttgatttgatgtgttcatttcaattagcaaatataatgtatagcccagggttctccactgataaaaattgtgaattccatttccaaacttagaaaacttcatggggaactgaaagtagacttttcctacattttattatatccacaagttaaattataaacaccttaacattaggcaatgtgctggacaaaaaattataccttccacaaagtcggcattttgttctttggggcctcacttaaggttgctaattaattcttattgttgataatcttgataatcttgtagatgtcgttcatttggcagccattgggctactccggggggttcgaagaaggaaccttgccccatacactatggctcatgttacaaatcctcggctataaccatcaaccggagtaccactgcttttctgccgagcgaagctcttcacttagaattttcagatcagagttgtatatccaagggagatgggcaaatgaaacagccctcatttccgtggttacgtctgggatgcaccctcagctatgcttgaagttgcttaccaagctatcgtgtattttcagcaccatatgccggggataaccaccagtcactatccaggtttagaagggcggtcagggaaccttaacacaccacttcatcttgcaggcttagtccagtcattggataggtacctcaccttagcattgaatgagcttgacagggttcaaactagagtcgccacacttgatagacagattgaaccattgggtcatcagggatattttagcaatgatcttatctatggtacactacaagaaatatgaccttctgtgacgaattcctcatgacgtcagagctattcgtcattagcacaatccattttatgacgattagtatgagatggggtggcttagtgacgaaaaaaaggtgttcgtcgttaataccaactagaaatcgtcataaagtatttcgatgggagatcgtgacgaatattaatttgtcataaggggcacaaagcaaatgtcatagatttatataatgcatttatagaaaaatatattaaaagttaaagcaatttagtcaagtgaattaaatgaagaaactaaaattttcctataaaaatgatggctagaaatatttttgtaatattctacgtggtctaaattattctctgaaattttccatcaattttaggagcttaataactaattttaataccacaaagttcatttaacctattaaaataaaataaaaaccaattaaaatcccttttgtctttgggcctttttcggcccaagtattactctctccctccttcggcccgcagccactctttccctcattgggccggcttcccctcctccctcttgggccgccggcccaacccttttgctcctccctcgccgaaaagtctatttaacctctctctcctctcaattcaaataatttttcgggtactaaatgatttcaaatgaaaaaaattgtcaacaataaagttgtataacttatcaagatctacaacttttattttggtcattttgctatatgactttgtttcaataatttgaatttgaatttcaaattatgacaacttcaaacaatattttcaagtattaaatggtttcaaccgaaaaggttatcagcaacaatgttttataactcatcaatatctgcaacttttgttttggtcattttgctatatgactttatttaaataatttgaatttgaatttcaaatcataacaacttcaaacaacattttcaaatactaaatgatttcaaccgaaaaagttattaacaacaaagttgtataactcatcaatatctataacttttattttggtcatttcttcatccgacaaaatgatagtaacattgttcacaaaatttgtatatatctcttataatttataaaaccatgtaagagatatgtaaattttgtgaacaatattactattacttcgtcggatgaagaaattaccaaaataaagttatagatattgataagttatacaactttgttgttgatgacttgttcagttcaaatcatttactatttgaaaatattgattgaagttgtcataatttaaaattcaaattcaagttattgaaacaaagtcatatagtaaaatgaccaaaataaaagttatagttattgatgagttatacaactttgttgttgatgactttttcatttgaaatcatttagtatttgaaaatattgtttgaagttgtcataatttgaaattcaaattttatataggtcaatcaaactcaaatgaagaaataaccaaaataaaataggtagatctcaataagttgtacaactt

SEQ ID NO: 61665 - DNA, 37414 bp, Oryza sativa
atataagtattttacggtgttacactgtacgggttggttgaatgagactgtgagtgcattgatactgggtggatttgttccatttctgttctaatttaatttcttgattggttagtttaatctgaaatcgcccgggacgacgcgctttgtgtccccctgcggaggcttggtgctgaagcagcttcgcaggctagctgttaagagtttttgggtgttgtaaaggtgaacacatgcatagatacactgctttcgatcgatccagctagattcctgcgcatccgtcgatgttttcctttcccatttttaagttttgttttttcgtacgagtgaagggttgatgattctcaacctgttcacacggccggttgcctcttttactgtttcattgcttaatatcaaattttctatagaaatttttcgtaccttccaggttaagacagtaaaatgtatcgtattaacagattagcctaaggtttttaaccaatggtcgagtagtccttgtttaagcttataagcattagacttcgcacgtcggcaagttttcaaacaaagcatatagaaagtacgcgtgtcctctttaaatcgagtggtgaatgggttgactccacagcagcgcaaatcgggaccatagacagtagctaaaccatgcatgttctggacaactcatcctgcgacgcagggccaacacgtatgtagccttttaatcttattattacaaactatgaaaattgggttgcccctgagcatcgcctttcgaatttccttttctgaaaaaagaaaaatttggaaacaaaaacaaaactttgcaagaagaagaattgatagaaatctttttgtagatctcaatcgcttttgtcatagatgtatcattgaataggtatactatactactgacgtgaatcgatgaatcgacagggaaggaatagttccctgaaattatgtccatttaaaccaaacaaatgaagttgaggtgctcaaaacaccggtgataactaatctgtagaagacgaacatcggtatgcactagtactagcagctaaagacaacaactagaagacgatcaaattatgtttcatgccattttctcttggatctaatttcacatatggatattttaatttgaactacaaaagtaaaatggtttaccaaaatggtattaaccgcaaaatcaaacttgaagagtccataaccaaaggatcaatgaacgaacgtcgggacaaggagctttgcttcagcagaatgaatcttgatcttcctcgacgctgatataagagaatctctatattctagtttccagggacttgaatctctatattctagtttccagcatttacattttgtggcttcaggagcacagcaatgcacccacttctctgtaaccagttgtcaccccttgatatataagagaatgacccgccgttgacaacgttttccctgtatttcgacggccaaccatacttgaccaacaactcatgcatgttcaggttgatctgatgcttcatcctgctgtgccttctgataacttgggtcaaccgcagtttgttgggtacccgtgttgtctacttctgaataaagagtatcattttttatgtcatcactggttttgctgcttccttcgctgaaatttactgcattcttcacatttttaggctcctcagattccacaagatcagaaacagtttgcatgctctgaacaggagggttttcaaggttgatacccatcccttgcgaaagcgctacatactttagtactagctgcttgtaggagtttaaaaggttttctacatcagcaacagtcagatcaccagagcgggcaaaaaggaatgggtactcttgaatttttttgttcaagtcatcatccttgagaagctcggctgctcctttcttctccaaatcagaaatcgattgcacacgctcaactgggttactacttgcatcactgtcccttctcatttccagtccaggaccttggaaattatctttcaaagagagattgacatcagaatccctgctagctttcagtgtttgtgatttttgctcccgtacatcaagattgttttggttgtcctgattctctgagctagctgataatcccaacatgcgttcccttgccaagtccatcttcttttggaaatctcgttcatccattgataatgattccccatcaatgttccagatgaaagactcagcggataagatgtttgtaaagaaatactgagcttctgacaccaaccgtgattgacgtctgtatcgctgtatatataatagatttgagtgtaactgtggaggatttgcctgcattaagaacagctactgcttaaattcttttggctaccttaatttaaatgacaaataaaaacactttacagatgattttcaggcaaaaggatcataacattgtagttcagatgatagaacaaaactacaactaatgctgaattgcggtgcaagggtagtttaggctaactgcagtaattccagaagcacgtaataccttgagaggccaaactagaagagcacatatatcattaactcttaccattcagtagttgacaagctctttccggtaatgaagagaaaagtaaagtgataaccgtacatgatctgatcttaagccctttatggtcatttgctgcagttttcaaaagcaagtccacaaccactcaaatgccaactattaggtttgtaatgaaagtttaaccatcatttgtaatcaaaactgatgtagtgcctagctagaggagggatgcccaactgatggttcacagattcatggttgctctaagcacatgtactgatgggcatgagtgcatgacaaggttgctctcaaatctggcaaactatttcagtacaaaactcactattagattagacatggaacctgcatcataatagataggtagaagttggaactaaaagtaatacgaagcaacagtaaatgaggttgcacagcgcactgacaactctattaagaggcaatgtgcccaacaaatcacgtaccactgcaccaataataggcttatattttttctagaaaatatcaaagttgagtaggtaatacacaaatagtcaccatcaagtcgacacctaatctgtgccatatcaaagggggcaaattttctttctccaatacagcaccaacaacttaatataatattgtcaatatttgatggttcatttgtatcatcaaccagtactttaacaagtagtgaatcatacctttatggtaacatagatgaggactggaaggaattcatcagctcccgggggattttcatttgatacaatagacgcatttagaagtaggttgttgatgactttacagcagttcaggatgcaagcaagcttatcccttggagccttatacatgtttatcttctgcagctccttctgtgcaagctgtacaaagaagggaacatatgttagtaaagaacatttatatatttgaacactgagccagttaatgcatgccactggaagtattcccttaattaaggtccttgcaagcaaaaagaattgacattagaccacagtacgcagattagggttgacagtggcagcattactgtgatgataatgccataaactaaatagcgagtgtatataagaagtgggcagaatgttattcacatgtaagcattagtttataaatatacttcagacagacaggttcaacaggttcctcaatacccaagtagttcaatgttattgaaaggttctgcactgtaacagatcttcacaaatctaaaaatgtataaagagaggaaatcaacttccataccagccatgatgtttcactttgatattctggtttgatatccaagttttcaggccgtataaactgctgtaacaaagacatcttctcaaaaagttcttcatcactcttcacatcttccgggacagaagcaaatacccgattgaacagctttgtcataacgtatttctcaaggccctaaaatcacaatacaagacaatccaaatgttgatataacgacaaatatattggagaatatgcaagtaacgttatgacattttatggaatatatcaataagatgaagaggaactcggtaggtaaagggtagagcgagagtgaaaaaggagagtttaagtttaaaagtatcgagtttgaactgcactttaaaaacagcaacatgactagtggaataagttaataattccacgtaactgccagtcttaatcaaagtgtctaagaaaggcacctagctcggctggcagggagctgccaggagcagagcaccagcctgagttcgaatcccttctaacgcaggttttctcaccattttcttctctatcaataatggatgctaagttccttcctagtactccaacacattcttaatcaaaatgcctgagataatttgatgaagccgtgcattccaaatttccgatgggagtaaatacaagtcagatgcatttattatgtatctctgttaaacacagagattatgataacatgatggattgactgcctgaatctttggcaagcaggcatggtcaccagaaaataggataactggaaaatgaaagacagaaataattcatctcatgttaaagtagaaccaaaataggatgtttagttcatcccgttgtctaacagattttagtcaatgcattaatccgatcatgtcaaaaaggaaagacagcatggtccacgaatcaagaatcatatactcatatagcacagtgacatcaattaaaaatccaaaaataaaaagaacacaggcatatcttatctatagaaagttcatacggaaattacccataagacatttggacaaaccaaatttaacgacttactttgcaagcaggtaatcaacaagaacatagagctctgaaattcaattttgatgttcatctctctagttatgtaatattactatatcagcagtaccacggaacaaggaaattgattacctcaccggcactttctagttcttcttcagaacttccagcccagggggtgtgagccctgaaagcaccttccatattttccaggaattcttgaacagccgcactatcatgttcagggtcaggagctctgttcgagaacgttacgataaagctgtataacatgaaacataacaacataaatgatgtatttcccatacgaaaacatacataaatgtcaagtattggttagttatggatgctggatctagtattttaaaaggtaaaaaaagaaaggcaaagaaggcagtgctgaagcgtgctcctacatgtagaagaattaagtaaactcactagtttacaaagccttaattccaaattcccagcttctggcctaacatatagaaaagcgtatttgtcaagaattaactatggtgtcctcccagctgttgaatctccagatacaaccttggctactatgtgtcattgccactgtgcataaatcccaactcatgtatttctaaataagcatgttaacttctatgctctgtatccaaggtagatatttcacccaaagtgcataaaccgatcatgcaattttcctcaaacaacccccacacacatcgcattgttgcattgccggcacactgatcaattatatcgattgtgctgcgactcatctatccaaatgcagtaaccctagacatagaaaataggaatggcattaaacttcacctcggaactacacagacgacggttaacaggtaggcgaagagacaaacagcaaccctagattaagctccccccacaaaaccggcacggcgatcggtcatatcgccttgctaacacatattgaaggacacgggaacgtaatccccttgaacccacgccaaatgctccccaaatccccactataccagcaaaatcgcccatccccgcaccacacactatcgaaccaacacgcgccgcgtaacacgaaccaatcgcggcacacgctttccgtctcggatccctagaccacgaactgagatcgagcatatgcctagcaccgaaaatttgtggcggagctaaccccttgatggacttgacgaagtcggcggcggagggctggcgcatgcgctccaggaagtcgtgccaggccagcggcgcggtcgcggacccgaaggcgtcgcctccgccgccgccatccatcgtcgccggatcggggaagccggggaggtcggcgggctcggatcagccggattcggtcacgttttgtgggaggaggagagaagggggaggaagtcaagggtcgccgcggtggatgcccccggcgacgcgcggtgatttattttgtcggagccgtactcgccgagaagggagtggctcacggcgcttccgcgtaaccaaagatggccctgtttaaggacatttttagtttggaatttccaaaggttttatttattactcgtagcagtaatattttttctaactactccctccatccacaaaagttacgcatattatttttaacaccaaaaccaaggagaaattaaatcaccttggatgttacaaaatcaaggagtaaatgaaagcatgcaaccaatgagtattttgatgacttcttggattctaataaaacatttaatttatctcttcattcaatgcataaagactacacataagaacaacttatttggaaaaactcatatgtgaaacaggtgtaacttttgtggatggagggagtagatggtaccctgcgtgttgctgcaggagaattatacgataataaagtagatatgacttttaaaatttttttctttcttacctatatacagttttttcccgtgtttattttttttacatttatcggttatacataagttataaataattgagttgtatggtgtgtcttttgggaggaagagatataatttatatccttgataaatcatccaaaacctaaaaacaattaagatgatatgaagagatgtaatttataccctttataaattattcaaaggctaaaaacaattgaggtgatgtggaatcctgggaagaggaataccacgcacatgcagctgctacttgtccaagatcgcaggaagcatgatgatgcatccagcagaggaagttgtgaccaaccatggggagcatgtgatgcaggtgctggaaggctcgttcggtgcggattccgcgtccgtgccgagagatagcatttgggtgaggtttcaccctaccgtttgacggttacacagtaatcgcgtgcttactaaaaaaccacataattatcacgagatgtatcgtgattttaaaaaactaaaaatgttaccacgcatgataaccacgcgacaaccctggagcagttccgtgttgtggtctttgtggattcctgcacgtccgatgtgtagactagcctcgtgggctcatttgctcaacccagtttggctcttctgggcctcgtaacttcgtgcgtttcgccacatgtgtgtgtggcagtttctactagttggtcaatgcatttgctgtaatcagcgagcagtggtgcccttttgtaaagtttcaaattgctctccagcttcggctagcgcaccagacaatggagtgatggcgtcgctcgtaaccatctgataaagtcgagggatcctttcagtgctctgaaactgtctgtagcaatttccctgccactactgccatatgattttagaaatgggtgttaatcaaactgatacaatgatgtggcacgttcattataaatatttacaccacgctttgctgtgcaaattgcaatactacgttggtggaaagaagaggaaagaacgacgaaatgcgcagactgcgtactcgactacggccgcgagaagaaatgtactacaaagtataaaaagaacaccttcttaaagcaaacccctgacccagaaagctgttctgcctgtgcattatgctagttatggacaatgaagtacggtgcatttgatatgtggggcaaggctgccgatcgcaaagtgagcttgagcgctcttaaaaacactaacagtcaacacaggtataaaggcagaattagcaatgcctgcacaggttgcaattagcaactactcctaccaactcctaatctcctataatcagctcaaactgaaaactggtgcgtaactgacactaccattaatcctccagcctctcatggtcgcaccacaagctccaaaaggccaagggcctccaggtcatgcagattattggatacgctgcacgtatcagggagcaataagccactacgtgtccactggcagtctggcatcggtacatttctccaccatctcttgcacggtggagcccaacgaacgattccccaaaatgtctgctggtgcggtccagactccagactccagacggccactgtgatctacagtgttcaccagtcaccagtaggagtactcctctgtgccatgtaccgcatcggattgacgaacgaaactgccattgaccacatcaaagtactccgtatagtagagtgaagtggtcgccaaccgctctgtacaagacgtgactcgcgccgtgacagcctaactcgaccgaccgcacagtgtcctcttcatcactactactccctcagttatataatgagatttgctaccgtccagcagaggaaggcggtaccaaatcctagctatccgttgggataaatcaaacgattgagattgctcggtaccgtgcggtaccattagctcttatagtggtaccgtttcttaaagagaggtggaagggtagtatagacttttcacatgtaagggcgagacgccggcctccggggtgcgtggtggggtgttgatggcggcaccagactgtgggttccagacccgatgtcaatagcggcggtaggtagcgaggtgcgccgcgggaccagcatcgacggacgacgaggtctggggccagcgttgatggcggcgacggcgagctgcggggttcaagggttcgaggtggcgtgcagcctgcgagatccagccccagcttcgacggcggtggcaagcatcggggtgtgtcacagggctagcgtcggcgacgacgtgttgcgagatctgatcccggcgtcgacggtagggctacgggatctgcggccgtgtgcggcatgtgtggcctgcgactctgcgagatccagtctcggcgtcgatggccatggcgggcggctgcggtggcggtaggggcgttgccggccgcgacggcaaggtggccgtggagaggtcataccaggtgccacggtagcagcgagggtgttggcggccgaggcagcgaattggtcgtggagttgtcggattaagcaccacgccagcagcggcgagtcgtcggaccaggcggcggcaccggcggcaaggaagaactgcaaagacgcgcatatgagggaggaaacaatggacacaagcatgcagcggggtccaagaatgagaatttttcttttttgacgaagaactcaggaacgagattaattgactcaatattggaagagatttttactcattcccaatcctacccctaaacattggatggctagatttgtttcaatacctggtggtactggtaccttggggtaccaagtgctggacaatagcaaatctcttatataatacaagagattttaaatttttgtttgcactatttgactactcatcttattaaaataaatttagaattattattatttttacttactttattattcaaagtactttaaacataacttttcgttttttacatttgcataaattttttgaataagacgagtggttaaatagtataaccttatatatataagcagaaacttaaaatctcttgtattacgtgggacgaagggagtacagcttcttcgacggataaacggactcaaaaatccatcttacgaaagttccaatgggcaatggcaacagcgaaaggcaggctaacgtagaacaaaaatccgaggccgtggcgatgatttatgagcctgtgacgcacacgtgcaggtccggcgacgtaggaaacggcgaggttacggtagctcgcgagtctcgggttaggtcagcaatgattgtcgctacacaccaaatcagaaggcaaaaacgtcaagggaactcaacggaagggacacaaaagaaaaaaaaaactggccccagcgaggagcagatgcatttcacgactacgacggcctgccgcaacgtaccaacgtaatctcgcactggccgctatcaacggattgtgaaagcagccacttgtgatagtttaagtcaagaaaaccgagattcaatttagctaattacaatacttacgttaagcctgggaagtccaaacccggtgctgtgtccggagacccacctgtttacacgaatatggtagctagaagtacaccgaggaaaaagtatataaagtccaagaatattgacttaggattaacagagaaaacttaggctacttacaaatagcgaatcaatgcactccattataaacctccgagtgtccaactgtggcaagatttcgattcgataaaaggatctactagtaccaagattgaacttcgagaatccttctaccaaccaataaattccaggacagcacggtttaaaattcgggaagataacacgttcgtgcaccagagttattgaggaatcaaaacaagaactaccaagccatatgcaaaccgagatttgtactaatttaaccaggttcaagtcactaactcagatactaatttagggcccgtttagttccctaaaaatttttctcaaaaacatcacatcgaatctttggacacatgcatgaagcattaaatctaattgcacagttatggaggaaatcgcgaaacgaatcttttaagcctaattagtctgtaattagccataagtgctacagtacctacacgtactaatgacgacttaattagtctcaaaagattcgtctcgcggtttccaggctagttctgatattagttttttcattcatgtccaaaaactccttccgacatccggtcaaacgttcgatgtgacacataaaaatttccttttccccaaactaaacaaacctttataaccaggttcaagacactctccagtcggcatgaggactactctacggtatattcctgccgtctgacactcgacacaacacggaagggccacgttccttctccaaaacgttcttccgcaactctgcaggtctgcatttacaaatggtttatcgcctaacccacgcccctcatttccaggtaaccgtaaattctcgagtacacctcgtccccaccactaccaccggtcaccaccacgaaagttactgaccatccacacagcctaactcgttcgtctccatgccgcggcgccgctgccggctgagccagccagattacccaggggaggacatgggcatgggcgtgcggccgtggcagcgtgcaccggacagcggagtcccaccaactccgagccgaaacgaataaacaccacgccgaaacaatggcatacgcaccaaacgggcaaacggacacgaacaaggggagaagataaccgagcggaaagcggacaggtgacagatcccacccgctcgctcgctcgctcccaccacttccctttgcccctaagtaattgagaacgatgaagaaagatgaaggaattgaccatggcgaattgggcgatagtgataattaccggacagtaattcacaaaaatcagcggcgacctcctcctctagggtgaggtgagagagctcaaaatttaccccccacgtacaggaatcggaacccaggattagatagagaaagagagattagaatcgacaaacacgggtcacatccacttatctatctccattagattaagccttctgcatccttcttcttcttctgctgctgctgttgctgcgatggtgtggtggttggttgctgctgctagacgcttaggccatccacgccacattgcttgtatgtcagtgactgcctcctcggactgatggcgatcgcgcaatccaccgacacctgaggttcgttcacacgcagctttcacgatcaggtcgcgcgtaatcggccgcttgcggcggaggtagggggaagttgggtttgggcggggtggggtttacctggacttttggggaggagaagccgagcacgaggatcttggcgccgacgtcgccggtgatgcggaggtcgacgcggtcgctgatcgcggcgtcgcggacgaggtcctgggcgtcggcctggagcacgttgaagcggtcgacgatgacgcgggtctggagcaggcgggtgctgtgcgccggctgctcgaacccgggcacggccgccaccccgagcggcacgccgtggtacatgacgtcgaacgccgtggcgccgtagcggatgccgaccttgttggggttcacggcggtgaagaggagcgtgatgttgagggagaggtaggccgcggcggggaccgcggcggccacggtcccccccacggcggaggcggcggaggacggcggggtgacgaggaggtactggacggacacctggttgaggtcgaactgcggcttccgcggcttcaccaccagcaccacgacgagcgcgacggccagcgcgaggagggccaggaaggtgagcagcaggaagatgcagcagcagcagccgcggaacgaggccgacccgccgccgtacccgcccccgtagtgcgggcgccgctgctggtacgagggcggcccgtggtggtgctcgccgttggatcgggtcgtcatcgccgccgccgccgccgcggagttggatggatgggttggtgggtgggtgaggccgtgagcccgtgaggggaggaggggggtggtttggatttcgggagctaatggagcatttgcgaggtggtacttgtgggggtttgcgttcgtgggggtgggggtggtggtggaaggggaggaagaggggaaagtatggggaggtgaatacggaaactgccgttgcggtagtgggggtaaatttggtggggcccttctttttttttcttctgtctctcttcgttcctgtcgtgctccgtttattccaccgggaaattgggatttgttggataaaataatggaataatatggttctgcttggcacagtttcagctccacctctcctgaagctggagctcagctaaacagtttcagctccactaaaactgggagtagagttgggtgaagctctctcacaaaatgtactagagttgtggagctgggtttatgcagctccacagctccactccagactcaactcctgaagtaatatttaggagttgaagctgtaccaaacagcccctatgttccaaaacgtaaaaacttaaacctggcacggtgcaacgtgacttcttaagcatgtggccgctaaagcactcaaagctgcccaatcttaggtgcagaacagtatggagttttctgtatactagtgtcggtgacatgggaccgggagtatcatgactagagacttgggcagccgcggtcacccacgtggcctgaccccctcgggggggtcgggcccgagggagacgtgcccaccccctcctctgtctccccgaggggtcgggctgctcctgtttcggccccgagggctggggcgccccgaccccctgtggtattggcaccacgtgtgtgggttaggtgggcacagcggcgctcaccaaaccacatttattgcggaatggacaagcgcgccatgccgcatttaatgcagcacggcgcacgcatatccggtccgtgaccggtcgcaatgtgtgaccggtcacagaccggtcagatcgcgggttacgtggcagcaggcggcctgtcacacgcctcgccccgtcccgtcggaatgatgagagcctcttgacactcgtcccgagctggagccggcgtggtaactcctggagttagcacgtcagtcccgactcgattcatgccaggcttcatcgcaaccgttgcaaggaagtcactgtatgaagaggggcagatgtgcggcatgctaaactgacgcgtggtggagaagaatgaccggtctgtgactggactaacgccggtcacgtcatcggcagacaaccgtgctcccacgttgcatctgcttccggcggagtggaggtaagtatgacccatcccatcggagggtcattcagacagcggccattgaagatctcctcccattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagaagtgcatgtggtatccccttgagatataaaaggaggaccttgcccacctaaaagtgggggaggggagggagggtgaaaaaagaaccagaagagaaggaaaaagaggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcccccggccgaaccggcaaagaggggcctgcgcggtctcccggtgaggagccccacgctccgtcatctggcgcgccaggtagggggcgcgtgtgtttttctaagccctcgtcctctttcgtgtgcgccaagtttctcccgctcagcccaatggccgaacgggcagtggcgcacaacctctctccgagcgctagcggtgacgacagggagcagaacccgcgccgtcgagctcgtactccatcgtccccctttcgccgaagtcttgggcgggaggaggcgctcgagggggtcgaaagatccgcgacttcaccacccacgggtaatgaagaaggacggcgagacggggagtgtcgcctcctcgtctacggcgatggcagcacgccccagggcgcgctccaggctgcgggcgtgctcctgcgtcacccgcccgtcgtccccgatccagagactccagctcgacgttggctggatgacgtggccgacttggtcatgacggcgcagcagcgcctaggcgccggcgggcggtccttcgcccccaaggcctctggcgctgctaccaccggctccgtgtcgtcgaggcggagggcgcggcgagcggcggccgttacccgccgttcgtccgctattccctcgtcaatgcctccgacccaagaagatgtgcgtggggggccggatgcccgcctcaatattgagcgccgacgcaatggtcgtcgtgctgcccacgcaacgaagggcgcttcctcgtccggagcgccacctcggtccgggcatgggggccagcctcccatgtccccggttggcggtgccggctgtcgagcctttgtggcgagcctttggaacgtccgttggcccccaaggttccggcccaccatcaccgaaaaatacgacggaagcgtcaaccccgccgagtttctccagatctatacgacggggattgaggccgccgggggtgacgacagggtcatggcgaatttcttccccatggccctgaaaggtaaggcgcggggttggctgatgaacttgccaccagtacactcttgggaggatttgtgccagcagttcaccatgaacttccagggcacatatccgcgcccaggtgaagaagcggacttgcacgcagtacagcgagaggacgataagtctcttcgctcgtacattcagcggttctgtcaagtccgcaacaccataccgtgcatccccgcacacgcggtgatctacgcgttcagggggggcgtgcggcacaatcgcatgctcgaaaagatcgcttccaaggagccccagaccaccgcggagctttttcagcttgcggaccgtgtggctcgcaaggaggaggcctggacctggaactcctctggttccggtgtggcagctccggccgcccccgggtccgccgctcggtcagggcggcgggacaggaggaggaagaagaggtcggcctatttcgacgacgaggggcacgtcctcgccgtcgagggcgcttcgcgggccacccgaaaggggaggcctgcgagcgacagaaagaaggaggctggcgctcccagcagggagcgcccgaccggcaagtggtgctccgtgcacaacacctccctccatgacctcgcggactgccgcgcggtcaaaagtttggctgagcggacgaggaagtgggaggaggagaggaggcaggagcgccgtgagggcaaggccccggcggcccccgccggcaaccggcgaggtgaggccaagcagaaggcccccgccgaggacgtcgacgatggcgacgataacctggggttccaggagcctcaggccactgtcgccaccgtcgatgggggagcgtgcgctcatgcttctcgccggagcctcaaggccatgaagcgagagcttctggccgcggcccctacccatgaggcgacgcggcgggcgcgatggtcggaggtggccctcaccttcgaccagaccgaccacccgccgtgcgttgcccggggaggacagatcgcgatggtggtttcccccaccatttgcaatgtgaaattgaggcgtgtcctcatagacgggggtgcagccctcaacatccattcccccgcagcctttgacgcaatcaaggccccggggatggtgctccggccgtcccagccgatcatcggtgtgacgccggggcacacttggccgctaggtcatatcgacctcccggtcacctttggtggttccgccaatttccgcacggagcgggtgaactttgatgtggcggacctcagtctgccctacaacgcggtcctggggagacccgcgttggtgaagttcatggcggcagtccactacgcctatctccagatgaagatgccgggccctggtggccccatcaccgtccatggcgacctccaagtcgcgcttgcttgtatggacagcgcgcggaccagctcgacgcggcgtccaagcccgagggtggcgacgagaggctcagcgcctccgtcctggccgccccgaggcagcggatgatcacgtgcgacgtggtcccggtcaaggaggttgccctgggcgacggcccgtccaagaccacgcgaatcggtggtcttttggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccgatccggcagaaagtgcggcggcaggccccggaacgtcaagccttcatccgcgaggaggtggcgcgacttctggaggccggattcatccgtgaggtcatccatccggagtggctggcgaacccggtcgtcgtccccaaagcgaacggcaagcttcggatgtgcatcgactacaccgacctcaacaaggcatgtcctaaggacccttaccccttgccacgtatagatcagattgtcgactccaccgcggggtgcgaccttttgtgttttctagatgcatactctagttatcatcagattcgcatggctagggaggatgaggaaaaaactgcattcatcacccccataggaacttattgttatacgacaatgcctttcgagttaaagaatgcaggacctacttttcaacgtaccactcgaatttctttgggtagccagttaggacgcaacgttgaggcttatgttgatgacttggttgtgaagacgcgcaaccaagagaccttactctcggatctagcggaaactttcgaaagtctccgctccgcccgcataaagctgaaccccgacaagtgcgtgttcggtgtgcctgcgggcaagcttctcgggttcttggtcactgcccgaggcatcgaggccaaccccgagaagatacgagctatagagcggatgcgcccccccagcaaacttagggatgtgcaatgcgtcatcggctgcatggccgccctaagtcggttcatatcgaggttgggagagaaggcgctacccctatttaagctcctcaaacgttccgggccgtttacttggacggaggaggctgaacaggccctcactcagttgaaggcgtaccttagttctcccccggtcctggtcgccccgaaaccagatgaaccgttgctactttacctggcggcaaccccgcaggtggtcagcgcggcgttggtcgtggagcgcgacgaggacaaccctcgctccgcgcacccccaccctgtgtcgactcgacccgggagagagcagggaggagaggcccccgagccgaacggcggcccgaggcccccgacggccggagctggccctctgcccgcttgtccgacggtgccaggcgcccccgacccccaggatggccccggggccactgcgggaaggccgcgcttgtcgccctctgaccccgaggtcgtcggcacagaagccgagtgcgccccgcgcggcctctcggatgaagagcaccctgtatcgactcgacccgggagagagcagggaggagaggcccccgagccgaacggcggcccgaggcccccgacgaccggagctggccctctgcccgcttgtctgacggtgccaggagaccccgacccccaggatggccccggggccactgcgggaaggccgcgcgtgtcgccctccgaccccgaggtcgtcgacacagaagccgagtgcgccccgcgcggcctctcggacgaaaagcgccctggagatgcggctggcgaaggggatcggccccgccgaaaggtgcagcggcccgtctacttcgttagtgaggtcctccgggacgccaagacccgataccctcaggcccagaagatgctttacgctattctgatggcttcgaggaagttgtgccattatttccaggcgcatcgggtcacagtggttacgtcttacccccttggtcaaatcttgcataaccgagagggtactggacgggtggtgaaatgggcagtcaaactctctgagttcgatttgcactttgaaccacgccacgcgatcaagagccaggccctcgccgactttgtggcagagtggaccccagctcccgagcccgtctccatccccgaggccagctcgggcccctcgcagctgcctcacatcgcctactgggtgatgcagttcgacgggtccctgtctcttcagggtgccggtgcgggggtcacattgacctcgccgagcggagacgtcctcagatacctggtccgcctcgactttcgggcgaccaacaatatggcagagtacgagggactccttgcgggactcagggtggcaactggactggggatccgccgcctcctggtgttaggcgactcccaactggtcgttaaccaggtctgtaaggagtaccagtgctctgacccgcagatggacgcttacgtgcgccaggtgcggcgtatggagcgccatttcgacgggatagagcttcggcacgtgcccagacgggataacgcgctcgccgacgagctctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggactcgaggggagcgctcccagctcccttagatcgattgcttggatcactgagatccaggtgtacctcacagataagactctacccgaggaccgcgaagggagtgaacgcgtccagcgcatctccaagcgctacgtgctggtagaagggaccctctatcgacgcgcggctaacggagtcctcctgaagtgcattcctcgggaacaaggcgtcgagcttcttgccgatatccatgaaggtgaatgcggagcccactccgcctcacgcaccttggttggcaaggcctttcgccagggtttctattggccgacggctctcaacgatgcggttgacctggtccggcggtgcagggcgtgccagttccacgccaggcaaccccatcagccggcccaggccctgcagaccatacctctttcatggccgtttgctgtctgggggctcgatatcctgggtccgttcaggcgggccccgggcgggttcgagtatctgtatgtcgctatcgacaaattcactaagtggcctgaggcttatccggtcatcaagatcgataagcactccgcgcttaaattcatcaggggcatcactgctcggtttggggtgcctaaccgtatcattacggataacggcacccagttcactagtgaactcttcggtgactactgcgaagacatgggcatcaagctctgcttcgcctcccccgcccaccccagaagcaatggccaagtggagcgcgccaacgcggaaatcctcaagggcctcaaaaccaagaccttcaaaatcctcaaagcacggcgactcatggatcgaggagctgccagcggtgctctgggcaaaccgaaccacgccaagccgagcaaccggggaaacgcctttcttcctcgtctacggcgcggaggcggttctcccatctgagctcaccctgaggtcccctcgggccaccatgtattgcgaggctgatcaagatcagcttcgcagagacgacctcgactacttggaagagcgaaggcggcgcggggccctccgagccgcgcgctaccagcagagcctgcggcgctaccatcagcgccacgtccgggcccgatcactctgcgtcgacgacctcgttctacgccgcatccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtctcgggctcaggccaaccccgcacccccccgggcgtgcagggttggccgggggctaccacatacacataattgtcttttttctcttccgtatttcaataaaagcattttcgatttcctaaggactgtgtttgtgccattgtttccttttgaagaatcttgacttgaattagcacgctcgtgctcgatcctgccctcggtggcccgggacggctaaaatcgccaaaaggggcccagaaccgagccgtgccccggggcgtggtgaactccgggggggaatcggcaaaggcccacaatcgggtcatccataaccctcggtcaccacgctcccggcctggccagtctcgacatgtggatctccccaggcactagctccgacccgcgccgtttgaggctgggacccgggcacgagcccttgttcaagctaagacacagaaggaccgcggcacagaccatcctcgtctcatacacacaacaaataggattgacacagaaatttcctctttatttgattgcagattaagttagtttatacaagaaggggacccgaaggcctcggaagaagaaagaaaaaactatataagattggcatgggcctgggggctcattccgacacgcccgggtcgccggcctcatcgccgctgtcgcccgcaccgccgtcaccgccctcttcgtcggagtcgagggcgaacgcgagccggggggccgtaccctcgaagctgtggacgatgtggtcggcagcgtcccggacctgcgcgcgcgcgtcgtcctcggtcccgggaggaaactcgtccagcgctgcccacggggagaagtccgggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggtatacttcgcagtccgtccgccccagaggcccgcttgccacccggcgcggtctagacgggagacggcgtcccgaagcatgccgggccctacctcgcctgccaagcggagggcctcgacctccccggcggacgagtccaacgcaccctgcagatcggcgatggtgtgttcggcagctgcgaggcgggcggctaggtcgccgtcgcccgcggccgccctgtcgctgcgcgccctcgcgtccagctccttcacccgcgccttgagctcagcggcccgctgatccagtgcggccctctcggcgcgggcgtcttccagattacggcgcgcctgctcctcccgcgctgcctcgcggagggacaggctgtccgccagccgctgcaccgcggcctcggcctcctcgagagctcgctcccgctcggtgagcgcgtcctcgcggaggcggagtgtggactcctcttcggcgcaggcggcctcgcggtccgccaggtccctctccctcgcgcgggcgcgctcttccagcgccttggcgcgagcttcaagggcctcttcgcgccgccgggacgccgcctcgttctccgccgcccgccgttcccgtgcagcggcggcgtcaaggactcctcgggcggcgtcgagtttcttctctagctccgccgcccggctcccgtattggaggcggagatcgtcccgcgcctcgttgagcatggcggtggcgatgagggcagtctcccgctcctcctccacctccctggcgatctccgccagctccctccgacgggcctcgagctctgaggcgtgccggcgatgtgccttgcggcccgcctccaccatggcttccaccgagcgccgcccctcctcgacgcgcacccacgccgcgtcgagctccgttcgctctgcctgcaggacctccatctgggcacctagcccgtccagcaccgtggtgttcgcgacggctaaggcctgcaggaggggctccgctttcagtagggcagcggaaggcagaggggagagccgtctcggtatgggcgccgcgcggctcggcccgccgatcgacgtgccggacccaggggcgtcccccgaagctggcacgtcccaaacgtcgcccgaggggtcgggcccgagcggtgcacccgcgacctcgtcgtgggtggcctcggaagtcatcgtcgcctcgggcggagtcgggtcgggggcttggcaggccgcttggcgtgcgcgcgccacctccgcctcccggacggactcctcggcccggcggagtttggcctcctcccgagcggtttcctcagcctggcgaacccggacggcctcctaggcagcttcctcggcttcccgaaggcggtctgcggcttctcgccggtcagcctcccgcctccgggcctccgcggtcgccgtctcctcggcctcagactggccggacttggaatggcgggaggggcgcgacgggatctcgctgaggcagaagaaaaaccagaggacaaaaagaaacgggtgagtgaaaacttgccttgggagatgggagaatgaatacggccgcagtgggcgcggggacgaacctgcgaggaggtcggctaaacgaccaccttggggggagataaggtttccccggcatggttcggtctccctcatcttgcggagccgcttcttctttcgctccccctcgggctgcgacgtcggcacggcaccctccgggcgcctgctgctggcacgcgccgccccgccccctcggggaggagatggggaaggggtaccctcctgcttcctcttcccccgggcgtcggcaggacggctgcaccccaggcccccatcgtggggcccagaagcacgaccccctcccggggtagattgttcccccctgcggctcccgcccgcgccatcgtgacctcgaggagcccgttcctccgacgccccgaccgcctgcatgatggtcaggatgttggcgcaatctggatcgctgcagagggggaggactccttgggggatgagggatgcctccacggagctgagattcagcactcgttggaccaccatcttgaagtcctcaggggcccagtcccatctgcccccctggtgggtcctcatgtagtcctcggacccggtgtactcccaggcgccccgggcgcgccgctggagcggcgcgacccggcgatgaaggtagtcgccgtacaccatggcccccgtgagcccctgggatcgcagacctgccaggcggtcaagaacggcgtcgtagctgtctcccagatctaccggcgcccgctagttggaggcctgcgccgggggctggctcggaagtcggatgcgcgcttcatcggcgaggggggtgtagaaccagtcgctcttccagtcgtcccacttcttgcggaggacgcagggaatgtagcggttcagcaccggcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccacgttgggggtgaggtgcgccatctggagatcgtaaagctccagaacatccatgaagaaagaagagaatggcgggaccagtcctgccattgcgaaagagaggaagaagacggaccgccccgggtagtgtggcgccgggcgtccctcacccagtgcgaccacctcccggccggcggcagattccggcatgaatcggcgcggcagcccggcctgcctctcgctcacgatgcgggaaggcggcagcacgctaccgtcgagcggtgcggagccccgtgccatgacgccggcggaggaggagcttgagaacgagtgagtgcggcaagggtagggcacaggaaacaaggagttagggcgcaaacggcgaaggcaaggggaataatggcgaaaggaaggaaacgaatctcttccttggcgcctttatacccttgccaacgctatgcccggctcctcgtttcccgcgcccactatctcgccccctcgtttctcgcgcccacgcctccactaatcccactcgcccgtttgcggcgcacgaggcggatgtgcggccgtggcagtcgagatgggatatatcgtgcgcgcgttaactacgctcgccgaccgaagcgccatcatcatatctccaggcgaaatgaaccggctcgtcccgattcgcgcactactcgagtaatgtaacggtcttgaagaggccactcattgttatcggtcgtttttccctagccgatgcgcgcgatttgcgaccgctgggttcctgcccgcctgtagagagcggccccacctgtcaccaggtctaaagagtggcgtcacgcccgagcgcttccctcgaggggggcgaacgccctggcataacgccgggggctactgtcggtgacatgggaccgggagtatcatgactagagacttgggcagccgcggtcacccacgtggcctgaccccctcggggggtcgggcccgagggagacgtgcccaccccctcctctgtctccccgaggggtcgggctgctcctgtttcggccccgagggctggggcgccccgaccccctgtggtattggcaccacgtgtgtgggttaggtgggcacagcggcgctcaccaaaccacatttattgcggaatggacaagcgcgccacgccgcatttaatgcagcacggcgcacgcatatccggtccgtgaccggtcgcaatgtgtgaccggtcacagaccggtcagatcgcgagttacgtggcagcaggcggcctgtcacacgcctcgccccgtcccgtcggaatgatgagagcctcttggcactcgtcccgagctggagccggcgtggtaactcctggagttagcacgtcagtcccgactcgattcatgccaggcttcatcgcaaccgttgcaaggaagtcactgtatgaagaggggcagatgtgcggcatgctaaactgacgcgtggtggagaagaatgaccggtctgtgactggactaacgccggtcacgtcatcggcagacaaccgtgctcccacgttgcatctgcttccggtggagtggaggtaagtatgacccatcccatcggagggtcattcagacagcggccattgaagatctcctcccattaatgaagaaatgatagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagaagtgcatgtggtatccccttgagatataaaaggaggacattgcccacctaaaagggggggaggggagggagggtgaaaaaagaaccagaagagaaggaaaaagaggggttctagagcttgaactctcttgctctccatttgctctgtaactccttcacacacagattcaccagaacacaggagtagggtattacgcttctcagcggcccgaacctatatacatcgcccatgtcttgtgcatttgctctctcgcgaacgttccacagatcgagggtgaagaacctcactcagcgcccccggccgaaccggcaaaggggggcctgcgcggtctcccggtgaggagccccacgctccgtcaactagatatcttaaacgtcctagatttgccgcgagctcagccgatccacgccatcgaattttgcataagagcatcctcaatgttttagatcaactgagccataagatgagacccacattcttatattgttttatctatagtacatgctacaatgtatgtggtagcttcttgaccttaaggtgggacccattgagtaaaaagacacatatttactcaagattgaaagtgtgcatgcatgttgcaaagccatgatatatttttttaattcttatggctagccttaagcttaaggttgcacatagcactattctctccctagctcatctcccaatgtacaaaggtacaacaaaaattactactttattccttaaggttagtttccatgcacattatggttgccctaaaatccctcgttattttagtatttctgattgagtccacctgatcagagccgttgtttcccacgtgtggacaaaatctggccgttcgtatacgtccttacctggtcgtagaatcgacgagcgctcccctccccacgtcgccctccccgatcccctttcgctcccccttccgatcggcgatttggcggcggcgttggagccgtcaccggtttccccgctccccccttcttctcccttccctcacggcggcgtcggggcggatggcgcgttcgagctgacgccgatgtcttccctccccttttttctccctctcctctccctcctacctcaccttgtggcagcaccgccgagggcaggacgggcgaggcgcccgtcggagccggcacaggtgctcccttcctccttctcccttcacttgtgccggcggcggcggttgcgacgagggaggacagatgcggcgcccgtcgttgctgttgtcgccgtgtcccctcccttcttctccctccccttctgtcagcggcggcagccttctccgttcgtctctctcctatccgtctcccagcgtcgtcgtcctccggccaccgccgtcctctgccagcacctcctccggccccctccactctgcccatccgctccactcttccctcctacccaaatctacggcgccgctccgtggtcggcagctcaattcctcgccggatctgacagtttgaccggtggagaaagaagaagcgggcggcccgcgaggatggaggaagcggattggcagaagttggccgttgagatctccatcaaacctgtccccttcaagcatccgggtccgacgtcctctgcgcatggtctgtgacagcttggtataatgaagaattagaaaggattcagttctctccttcctgttctattctttcagcaatggtttaggtcaacacaaaaaatttggtcgagttaagcaacaaaggttcagggcctgttcactttgatgccattttcaaccttaccaaattttggtaacttatataagaaatcttgccagttgccaaaattttggcatagttgccaaaatttcggcaatgtcaaaatttggtaaggatttttttggcatcaaagtgaacatgccctcagttcttatccttccagttctccttttgtcttgaatgttcttgaagaagctataagtggaacagatacattgagatcactcccagttggatcatcagcaccaggaaaggttccgccactaccagttttatgatcttgtttataatgggatggctaccacatatatttttctatttataggctgacaagaagtgtgctcttttttatggtgtaacaataagtgaagaacaagctcggtcaggcattgtagtcagagtcaactcagccgcacaaagtgaatttaaggtatgatgttgattattccttcggttgctctggaattgaagcttttatgttctgcatctcttttgaattttggaatattatttataattctctcaattgccaaatatttatctacagctacttttcttcgaacaagaatttgatggaggttatggactagctctgcaggtacttttgagtttcatggttgatgtgttctgtggttttgtaatcatttgccatggattaccacatgccaatcttttatgttttttatgaatgaatagtggaaagactggaggagtctcaaaataacttaaagggaaattgaatttgtcatcaccatcacaagtctatttttcaatagaaacttaaagatgtagatgtgctaaagcaaatgcgaccattagcctgtcacctccaaagcaactaatcctgacctcctgtcatcaactgacaaccctcctccctgtaacaatcatgaaaagagctgtgcctgtgcaaagctcgaattccagctgaacttggcaaacttgagctttttgaactgtaaaaaattttatcgcgtctaagaattatgttgtatgctttatttttattctgtgcaattgttgaccaaattttgcatatagaaatcttgccaacaacaatcttcaaggtcctattcctgcaaacatgttcttgcactgctctaaacaaatttagcctgttgtgatgcaattctttgttctgaaacagagtgaaacacaaattcatctaaaaccagcataaaaaaggaatttcattaagtccatgcatgtttcctacattcataaagaaaaagcagggttgattttctttagaatggatacaacctacgttgattgtattacataagtttcaaaattgcaaacactactttcaggcatccaagctgaggtgaatcacatgagacaaaatggcagtcttgctttcaatgaaagccttgttgctggtatatttcttcattttgccggtgcaagacccacactggtcttccagaccacggaatggtagtgcatcaatagggctgcagcagggtgacacaccagcaccacggttattggattcaggagttgccaaggagcagcaattaaatgattagcttccacctttaattttgctggcaggtagtctgtcaagggcttcttttttccaattatggcaatgtagctattcttatcaattcctcccctttctgctattgcctggttgtgcaggtacctagattcaatgcaagggtcagggtgttatcccaggcttcatggacaactccgtcgccttgaggaaataagcctcctccgtccctccatatgtatttcctcctctgctctgtactgctttgctctgcctcatgcttgctgtcatgtggatgtgctgctgctgaccaatactagcttattgaagttttccctttttgttcatgccgttgcattgcctctgaatcttaccttttttgcggggcctctgaatcttacttacttttcagtgctatatacagattcagttacaagacacatagtccctggagatgaaacaaggtgtttagtgcgtattacattaccagttaggatttacatagcatcattcacacctgattagcataagttccagataatattttattatcccctttgatgtttaagatggttgcctcttcagtatcacatctggatccatagcaatttcatttctatcgctttacttctccgtgcagggaaaatagactgcaccaagcatcagttaaggtacattcagcataagagagttaagcccgctacctagccgaaaaaaccgaaggtggggctctttgttgccaacatattgtgactgctttcgattttggtgcagtagttttggttagtgactattatatcattttttcttaaaataaggtcccacattatggctaggtgttgccgcgagggctgtgaatgttctttacttctgattaaagtgaagtatttgtgtaggtgatgacaaaagctacaattattcagggctgtcattctctcctgtaggtgatctattatgcaatttactatttgctgtaatgttacagtgtcactgctctcactctgcttttgaaagcaatatgtcaataatggattacataaggaaaggtttattgcatctgtcagctaacatttcttacggtgttagggcccttttgattcttaggagtggcaaagaattttatgggattcaaattccaacatatttttcttcctatgtttccctttggcttataggactatgttcctatgcttcactttcatgggaaaaataccaagaggtataacctctttgtaaattttcctttgtttttcctatggcactatcgaagggctcctattatcttttcctgtgtttttattcctgtagaattaaagaagcacaccacttttattcctgggtttttcctattcgtgtgctttgcctatcctgtgaatcaaaggggctttaagatgctatgccgctatgccataagccacccttacttgtgttatgacctactacttcctactagcagtacatttttgtatccatatggatcttttcttcatgatggttgtctctacttaaagctatgcattattcatacatgaagattaagtgaaaaacaagccactcccaacttaacttttgtttgatggatatgctagatagaaacctaggtgtatgttcttggtctcttaggtcattgtgtcacacaatgttgtttgttgatgagctccctatatatattgttaggtcaattatgttgcccaacaagttttttgtgctaatgtgaggttactaggctcaacagtccttagatatacggattcggtttggttatggtgacagttcggttttggatgattggattgttttattttttcataagcccaacaatatgatataaaataatgttatttaatatgtgaagattagtggccatacagaaacgcgtgccaaaacaacatattttctaaaactgaattgtcctcctatgaattacattcaatttctcttccttacacgtggggttttatgtgtgctcagtgactaccccgtagcaaggtatacttgctgatccatatgtatctttgctaaacagtactatgtatggtggtttaattttaatggttgcaaatcttggtttccctgtaagtagctagctagcatgatttttttttcagtcatagtttactcttttaacgggcaacttgtttataaacaaacagctcacgggatgttggccttatgtcattctagagcacttttcagagtttaatatgacacaaaggctttccaaacgatggcgatgcctacggataatcattttcctgctgctcttacatatttatatatattatatattcttttatttacttatttattttgactgataagagctggagactgctatatttcataatgaatattcttcttttatgtttaatccacttagtttggtgctcccactcttcagtcggtgctgctttataacgaaactattatgtgcattatatcgtccgacataagtataaccatttcatgtttgcaggaccaaagctgccattcatactgctgtgcttttgttgtggattgaactagcaggagagaagaatacacatgaacttataaatggaccatttcctgtaggcagctactttatttgtcctgtatattagtgtgttgttttttaatcaatgtaaatgatcactgacggagtacatgtatatgcattaatcacctaatcgttctgtaatattttctgtttaattttttttgctgcgcgccgtagcgcgcaaaccctttctagtactctaaaaaaaagggcaataatagttaatccgtcacccttaatgtactttaatattacaaattagtggtccatctatatatgattctctcttgttttattttgataaacaagtttactgtgcaaagatattcacaaatgtgaaaatgttcaaaaaacgtcagaattaacttgtttcaagcaatattcgagcacacaggcttttttttttatctgtagtgaagcactgatatttgccccttttttttccttaaggactatagaggaaaacttcgacctaacttgattggagagtttttccaacgatggatacttggatagggagctagttgcttatccacaggagcctttgtctatgcgtgaatccagttctgtagtcaaagaacagcgcacgcgaagtgcttatttctgtagtcaaagaacagcgcacgcgaagttcataagcacgttgcacgcaatgtatgaagaaatgggctatattcatggaagaaaagatgaccattaatgtgtcgtttgcaagaagcgtacagggtgaattgtcactcgaatttaaagctcgcattggcaggtcaattactacagtaagctagaggtgcctctctcgttcttcaccgtagattcacatatgtacaacagtgattggcatgacacataattatatcaagacctaggatgtttagcttccaaaacaaaaatttttacgttgtatatacatagagtattaaatgtaggaaaaaaaacaaattacacaaattgcgtgtaaattacgagacgaatcttttaaacctaattctgtcatgattttataatatggtgctacattaaacattttctaatgacagaataattaggcttaataaattcgtctcgtagtttcctggcggaatctgtaattttattttgttattagactacctttaatacttcaaatgtgtccatatatccgatgtgacaatcaaacccaaaagttttccccaactaaacaaggccctataataaattcattcatattatataggtgtttttacctctaaattaagaagtgcacctgaccacgtggaactatatatacagtaacctgtattgactctaaggcttacattaccgtcggtaaccacgcagtgaccgtccttaccgcggaggtacggtaatagaaataccgcggtaacctccttaaatttaaataaattaaaaaataatttaaatttttgataaattttgcatgatttttcacggttaccgtgcggtagccgtgcttaccgccggggcgcggtaactcggccccagcggtttgggaaaccctgattgactccacatgattgtcaaacattgtgaatccggccgtatacaccaacaatataatactatgattgtcgaaatgaaacatatacgtttaaaaccatgcttgtaaagaaatctatctttatgatgttatgttttagaaagtttgaactatttccctgaacatgcagaatgtgacctttcaaacatgaatgccactcctaatgtgcctgggttttacaatatcatgcgattacttctcttagttttttagatctctttctgttagtaatttcttggtttttagtaaccatgatattgttgagtagggtaacccctccccaaaagataagggaaccctagttgtgttagcatgttctcgtgtatagagtttgttccataaaattgaaagcgtaaaatttatgtcaagtaataacttacatgtaagatgtacatacacaccacatgtaaccgcgaataatccttagcacatgtttaaagaaacggagtctagcggtaaatccttgactaaatattttcatgttcatattttctctgtttcataatgtaagtcattctagtattacctacatacatacatatagatgttaatgaatctagacaaagacatatgtcttgattcattaacatatatatgaatgtgtacaatgctagaatgacttatattatgaaacggagggtgtatatcttaagtcatgacaaggatccattttgatgcttgtactctggcaactcgaacctccattggaaaacaacactatccaatactgcgtaccaagcaatgaaaaacgtaacttagtcgagtgacactttgtagagaaaaaaatatcaagataatataaaaccatttttgttgcattttcattccgacaatttgttgtgaaatatccacagtggaccagctacctataagatgtttaacaattgctacatctattgattttcaccgagacgcctataaattgggtgcccgattttttttaaaaaaataaaaaatcaggcactattttactaagtagaccgaaaatgtttcactaagtagattaaaaatattttaatcttgtaaaagactgaaatacaaccaaatcacctcatgaaacattttgctacaacgtatgaaacaacggtttctaaaaaaataggcgttgttttaccctatataaaaacaatgtttcagcaaatagtgaaagaatgtttcaattttttaaaaaagtgaaatacagtcagatcgctagatgaaacaatttggttcaacgtatgcaacaaacgatttaaagccatttcaacacttaaaccctgtgtacatcaataaccatgtgtccatcaagatgaaattattaaaacattataaaaaatccactgcaacatttcatccatacatagtgaaacatcgcgagtacactagctgaaacattgtcggtggaaaaaaaatgaaatggatcccccctaataggatgtttctgttatatccgggcagatgttgcaacggagcgcgcgtggtggaagcaacacgcgcgcgcgggaggcgtccgagctataaaactaatatcgcgtaaaagcatttgaaatataaaataagagtacaatttttttacacacacatgtacttgtgaatgtaagtaattatcggttatcctttaaaattagataatctaagaaatgtcattgacaaatgtcaaaatacaagaaatgccatcgtatgaataattttgtcccaaaaatgccattgccgttagggttcctctatcccatgctgttaagtgatataggatgaacaatatatttaacgacacgagatgtgcggaactctaacgacgatgttatttttagaataaagtcgttcgtacgatggcaaactcacgcttgtcgatgatatttcttaaatttggacgcttgttaatgacatttcttaaattgtctcttaaaattaaaatgctctctacaaaattccacggaggcacagagcgagacgacaaccatgacattttagcgagttcagtccatcaaacaaaaaaaaaaagaaaagacaaacaccgtttactcctgaaaaagcccaaaaggccgaaacccacaagcccagtaggccactttccgatatttccgcgtcccccacgagttccattcccagttcccaactcccatcaaccatccttctcgactccactgaccaaacaccccagcggaccaaatcgccgcagcagggcgcgccatggagccggcggcggagaagagggaggccgagcaggaggagctgcagcagcagcacgacgagcccgccgtcccttccgccgacgacgacgaggctgaggcggaggagaacgagcgccgcaaccgcgagctcaaggccggcttccatccccttagggtaagtactcctccgccgccgctagatccagcttctatttccctcccggaaagaggaaaagttgtttctccagcgcgcctggaggttgagatcgagtagatagatgtatgtaagtaacccgtgttcctttgttttttttttacctgtgcacccgcagcgtagattcgtgctatggtacacgcgccggactcctggggcgaggtcgcagtcctacgaggacaacatcaagaagatcgtcgacttcagcactgtacgtcaccgcgaatttcttttggtggggattctctaatttcagggctgcagattggattgctgatgctgtttgggtgtcctgtatgtaggttgagtcgttctgggtttgctactgccacctcacgcggccggttagcctgccgagccccaccgacctgcatcttttcaaggagggcatccggcccctctgggaggtactcctcagtagtcagtaaaccgtgttgttctatgtggttgtgttttgtttagagttatctctgttatgcttctagttgttgacggagtttggttgagcaggatcccgcaaataggagcggtggcaagtggatcataaggtttaagaagaccgtctctggtcgtttctgggaggatttggtaaatacatctgcactttactgtatatgcattcgggttctcaggagactagtaatttagtaagtgcatgtctgtggtgacagatgcgaaataatataccgatatatacagtagtgaaatagttatccacatgttttgaaaactatatagatgacagcatgagattagccaaaacacacacacatggatagggttatttttcctacaaaaatatgctgcaattatctcatgcatatccacagatatctatgttatagtcacagaatgttttgatgggggatgggtgtggaacatgccatcattgcccaactcttttccgaggagtgaaaagatgactcttaggattgatcatgtgcaagcttatttgtaagcacctacgtatcaccgcattacaatgacgctgcttaatttatgcaattttgaagtggcctagttctacaaacctaatattgcttggtttacaaatataaagtatctgtcttttaccatgccaacttcacatggctacaatgccaatgcatgatgagcaataaggccatggcataaaaatcataggatggccatgcaatgggcccatatatcctgtagcaggccaaaccttaaatcaaatagccctaaatgacacaagaggttgtgctggtactgtttgttcatgtcaatattgtgacattgcattgtttccatgttccaagacatgatattttagcttggaagatgtgtttgccacattgggttttagccatacttttttctgtcactatttcagttgccatgcctgctcagcattggtaccacattcacgctgcctttttcttttgttccattctcattttcatttgttccttttcttttcctgctattctgttctatctattgttcctccttgatctccgttgttgtgatggtcaatttggtgtattctgaaatcattaagggcccatttgaatcactagaatgaaaaaaaaaggaggaataggaaaaacataggatttggacaggaatacaagtgtaaaacagaggattgcaaaacacaggaaaaatataggaatgaccgtttgattggatcgcaggaaa

SEQ ID NO: 61666 - DNA, 1087 bp, Oryza sativa
  unsure (1)..(1087): unsure at all n locations
aggggcttcttctcggcnngcttccgtggcgccgcacttcggaaccggagggagtccatgatgccaaacaattcggcccaccacttngtaagccgccggcccacgccggcgggcgcggatctggatggaacgccgcccggcgnccgcngcngccacggctnggagctctgcttccgcgtgcagtgcagggcacgtcgcgggcttctgctcagctcaagacgaggagactggtggagtttctgcttctttttgtcagactcacgtgtgctaatgacaatcggactagtgtgcatcgggagggacccactgggtagacgctcgatgataaaaagcttcttctatattctgccaggaatcggctccaatttcgtgaaattactgcaaaaatttctccattacaaattcggaagagattcagaagcccaatggacggcgctttgcagcaaactgtattactgtttttgaatgaacaaaagaactgcgttgtactcgtgctctattcaatggaattgatacattctagtgccggctcgttcattaaaaataataataaaaaaaagaactacgttgtaattgcatttggatagaacaaaatgttggaaggtacatatggtatggaatttggggtgcatcagttaggtccaaacatgggctttgaagacccagaagaactactgcccaccaacaatcctggtttccaacacccccaaaaaaatactgagtagatgaaggatgatcagtttccttatctcttctacgcttgtaaacgttgaaacttggctgacattgcatttttcacacttatattcgtgaaatgaactttacttgacggagaaatcagaaattcctctggatcagtcctacaaaacagggaactacttcaggccttcagggcttcatgcagcttcctcaacttctgatcttgtgtccattgacaggccggttagttcacgggcatctgtatcgatcttttcgttgaaatgatccctgaggaactccactgccatgaacctgaatgcagatgcaggtatgtaccatattattctaggaatgctccccttgaacaagccactcatttcctcattag

SEQ ID NO: 61667 - DNA, 5635 bp, Oryza sativa
cgaaacactgcaattttattatcaagcagtcagttaggatagcaaatgtattggtgcaactagacaacggaaccatctaaaatccaatatccagaaaaactgatagagctagacaagcatatgaaatttgtgctggttgtagcaatagatagtgtttgtgacaactactatactaccactactgggatgtggcaacccacctaagtggctctactgaacaaaacaatcaagatggatggcacgaactactgcaaaatgcaaccgcgaaaagaagagatgctagcaacatcaaatgggaagcacgacgaccgaaatgccaaaatacattatcgtttaagcaagaaatctacatgacaccatagatccctaccggatcgaaatggatcccgagaaccgagcatcatatccatcgccacaaacgcaaataacctcgcagccgcactaccaatcacccaccgagctaatcaaggacacccatgaaccaaaccgcgacgcagcgaatcaagaacgaaacagcacagcacgcagcgaccgattctagcagggctgcaaggaggttgagaggatggagtgtgaggatcttaccatgtcgctcgcctgctgtggctgctccgctgcggcggcggcggcgcgtggaggagcgaggagaggggagaggtgggagaaggaatagttagggtttatagcggcggctgccctcgagcccttttatccatccactcgaagaagaaacccgagtcgcgcgagcgcatcgggcggacggatgcggtgcgggagatggatcggacggctcagatcgtcttgaggggttgctctccgcggcttgatgggcctcagtctgtgggcctgggaaaggagataattcctcgttggaataagtccgttttgcgtcccttttctgttacgcttgcgtgaataatatccctcaaccggaaaactgggtataacgcctccttctctgaaaaccagagtaaatcacctccctcgcggtttcggagacggttttgtcctacgtggcagctttgattctgctgactagctgagtcagcttatgggtcccactcgtcagcaactctcctcttcccctattatcttttacatctcccgtggcgccagcgagacaagcgctgaatggaggactggcggaagtcacggcggcggtgttccggctccgtccgcgttggaccagcgacgcgcgcgcttggggaggtgaggcggcgacactaccgatctcgcttaagatgggggatgccgaagctcggggaggtcgcggtggcggcgttccaactccatcaacgttgaaccagcgacgcacggtcaacaacccctgtgccgcatcctcccgtgccaactctgtgtctgccggcgtccatctccgtcgggatgccagggacgtcggggacatgtgccgccgaccacgccccaccatagtagaaaaagtcggaccgaggactgacccgatgagcttgtcggttcactggttagaccccggttcatcggtcggaccgtggttctatgtattaagtaaattagtgttcattccgttcagtaacataatcacatcatcttatatattcttatgggtattcaatttgctgctgctccgtgctcctccaagtagctctgtttagccccttgacgctatattcttatccagcctgacattactgttctagtcaaaatgtgttctttcagaactgtgtaatcatccgtccttatgtctggtcactcactcactcgatgtttgtatcttcaggtcttttgttaatgtgaccaagaagaacgcgcgagagacaatcagtgtgctctctagtctctaccccttctgtgtcagatgttgatttgataaaactaatttagtattataaatattaatatatttgtttataaacttagtcaaatttgaaatagtttgattttgaccaaagtcaaaacgtcatataacctaaaacggagagagtacttagtagttagatccacgctggaagttattctgctctcttaccatgtacttcctccgtcccaaaatgaagctatttttaaggttggcacgggtattaagaaattaggtgagaatgattggaggaagtgtgtgattggttgaaaagagaaaataggtgaagaagaatgttgtgattggttgagaggaggaggtaggtgaagaaataggtttattttgggataagacactgtattagaaataggtatattttgagacggagggagtatgtgaattgtgggtagtacacatgacggcaccatatgtacgttgcaatacagcagaaatgatcacgagatgcgacattgcttcacattttgcatgagtatgctgacgagatttcagtatgcttcgttgttatattagaggattagtacttttaaggtgttgcaggtagtgttagcattctcatgaactcatgcttggcaagttggcataatccgatcatatagatctacatgaaattttgatatgcctgcattgttcataaactgattcctgcaagccgctgctcccgtgactcccttctagttgcggtaccgcttatttttattatcttagtttggatgtcaatccattaacccattaactttgactaaaaatctaaaatctgcttcggaaatgttgctgcgaagtggctgtcgtttagattagttcatgaagagctaccaagtaccaagtgagattcgctcgctttggcttacttagttgtaacaaaccaatttaaaagacgaattggtgaaaattggagcattcgaggcagtaatatgtgaaatttgagattgatttggaggcggtgtgtgcattgttagcattacaaaaccagttgtaaagacaaacaggagaatctaagacaggaatgtgtgaatttttttttagattttatagtctttttcaatcctcatgctggacaatcaacaagaatgtgtgaaaatattttattcaaagagttctaactcatgctggacggtaaactttagttagaaaatagtgatggactcgtatttcctgccaaaatcactatatagaaaccatatgtcaaaatctgtcaaaactaggaactacatgcttcacattgttatcaacataatgaatgagcaagcaagatgtcaatctcaaactgaatgaatgacacaagcaagcgatcaaacttcatctagcgagtaaagagcccaaggcagctccagttcagaataaatgcaggcaagaccagcagatttgactgcccattgctaaaaaggaataacataaaacaaagacaagtgaagaggcaggcagaacacaattatatcaatatccaaacggcagcttctcacataaataagataactgatagctcaaggttgagaatcaaaaaccgaaagaaataggttctttgagcagagtgcagaacataaacaaaaatgcctgttgcaaattgcaagactacaggtaaacttaaatgccatatggagtttgtttggcagcataagatgaaactactgtgataaggctactctctcactcgtcatcctcttcctcgtcatcatcatcagcaccagcggaggagttgagagcattcaatctttcgacgagactggccttcctctgctcgtaggtcagcttcttgaggttgtatctgcagcaaagagatggcaagttagttacatcatacatggacatcacaaataatctttacgaaaatcatcagccagcttaatatacctcttgtgggtagccggttccttcttggtcgatttggccatggtaggatcggcgcggatggcagcatggaccttcttgtacagtgattccatgccatcagcgtcaattcccttcttgaggtactcactaaagtgggcttggaatttctcaggttcctcctcagccatagactgcaacaagtacataagaagaaaatttatcctgatgacaatcaaaataaagcagactgagctaaacagtaacaaataatccaaactttatataatgctttagtcaacgttataaacatcaaggcagctacataattcctaatacaacccacagcacgaacaattgatctaatagtgccagctcaccctcatgtagtcagccacgtgcccaccgtagatgtacttgcggtgaatatcagaatcaagctgcttctcgtccttcttgaacccagcaaacctcttgtcactgtgaggaatgtcaagaccaccatccaaagctccctgcagaagaagagaagtatatccacatgagctactaatacagatcaacaatccaaaggttatattgacggttgtgtttctaaaagagctgatgaatttgatgttcaagtgacaaatcaactattattacagcagccaacagttgagatcaaagcacaacacaccttgagggcaccaaagacacggtttccagtggttgtcctaatgaggccaacatccaagagagcacggaaaggcctcctttcatcagctggttcaacatagtagtcctccccagtggcctgaccaaaggaatcatacatatcaagatcaagaccagcatgagcatatagagtaaaaaaattataaggattatatttgtacctcaacattgccctcgtactcctggtccaaaccacggagcgtgagcacacgacgagccagaagcaagccagtgcagtaagctacacaatgcatcaaaacagaggaattaaattgtatgcatacagcaacacaaaccagcattctgcgtattcattcaactgaggaaactacctgccgcatagttggtgagaccaacttcaagaccatagcgaggcagctcatgggagtaggcagcagccatcacgatatcaccagcaatggtagcatagacaatttgagctgtgatatctttgtttgtctaatgtactattaaggcatacagtatgataataacaaatatatagtataataaccagaatttacgaggaaatgcataaatatcatgatacaaagaacaaaaaggatacaaatctcacaacgaagcggtacttcggtgtgttgtacttgttcttatcttggttggtgagcctaatcctggccctgtagtcagtcttgccctctgcaaacaatgacaaatgagattaagtacgtcaaaaccttgacttgacttggaaacgcctcggtctcttgaacttgacttacgcctccgtctcttgaacttgacttggaaacgcttgtggtaggcattggtcttctgggtcttgacaaaccctccctggagagacattatcatattaatacaaacagcataaaaactgaaggcaagcaaacatgtgaaatagacttaaatttgagaacttcctaaacgcatatcgaaacactgcaattttattatcaagcagtcagttaggatagcaaatgtattggtgcaactagacaacggaaccatctaaaatccaatatccagaaaaactgatagagctagacaagcatatgaaatttgtgctggttgtagcaatagatagtgtttgtgacaactactatactaccactactgggatgtggcaacccacctaagtggctctactgaacaaaacaatcaagatggatggcacgaactactgcaaaatgcaaccgcgaaaagaagagatgctagcaacatcaaatgggaagcacgacgaccgaaatgccaaaatac

SEQ ID NO: 61668 - DNA, 787 bp, Oryza sativa
attagaaataatccacctaaatttaaactctagacttaacacggttgtatttcaatgataagtgacgtattcgtgataactttatcaatattataagatatactagtccaatctttcgaagatgcttgtagagataagatttgcgtgcatacgtttataggagatgcatgtgcatgctgaacgtctttctatatgtaaaaaagatgagattgctaaatgaacgatcaatcagttcatggccgttgattgcagagtggaacaccctctgcatcgatcgatctcgccatctttgtcgtccttgatagaatgacacgataaccagtcgaacgatcgtacgtagcaatcgtaacgaaccaactgcttgacgtttccctgttttgggcctatatatacagaaatatcctcgtcagcctcctgatcgccaaaagaccggccctagctagctcaccggcttttgttggtggcgacggcgtgcctgccggttgaccatcgccggccagcaagccaatccggccgtcggcgtccgacaagtcaatcctacctaaaaatgaaccgatgcgagtaagaacggcccgaccggccgacgtggcacggcaacgacggcgtcacaatccggataagatcagttcccatccacggcgtggttatatgtggtggtcggaacatgaagctagctagttgtaataaaaaaaatttagttagggcagataattaattaagacgctataaaagcgtcattatggccgcattatggattgcaacccaagcaaagtatatacagttaaga

SEQ ID NO: 61669 - DNA, 33991 bp, Oryza sativa
  unsure (1)..(33991): unsure at all n locations
tcctcctcgggctcctcccacggcgacgagaacgccgtgccgccggggccattagatccatgaacttcggcgacgcgaacgcgtccagctccgtccacagctcatggtccccctccagcggcggcgagcaaacgttggccgcggcagacgacgacgacgacggcgtcgtcgcgtggtccagcacgtcaccgccgccggagcttcccagcgtggacagcgaggtcgctcccgacgtcggcgtcgacgacatcgcctcggcgctgcacgagcagctttcgtcgacgacgacggcggcggcggcggcgtcgaatgcccccgccgcggcggccgcgacgcgctggatggacctcggcgacatgtcgcccgccgccgagtccgtgcccccccggtggatgtcgaggcggcggcgagacgaggcggaggaggggaagttgaggacggcgtcggagcccttgaggcagagcagcgcggcgtcgtaggcgcgcgccgcggcctccggcgtggcgtaggagcccagccagatccgccgcttctggtgcggcgccctgatctccgacacccacgacccccagctccgcatcctcacccccttgtacggcctcaccgccaacgccgctgccgccgccgtcgtcaccttcccatcacctccgccgccgctgcacgacgccgcgccaccgcctaagccggccgccgccgtcgcgccggcagcagcaatgcacttgttgctcgtgttcttcaccatggccgcgcgcgcgccgtgtcgaggtgctcagtgcgcagtgctcgctaactccagtagtgtcgcgtaagcaaagccgcgggttatttatagcgggcgatcagccgatcactcgagttgagtcccagcgcacgcaaagggcaggagcacgtcgtcgtgtggaaagggtttcgagttagagccaacccaaacccaagctatctatctctatcgctcgcctttccatttggacgcgctcgctttaacaaagcgggagtactaccactacccttgtagtgttctcgcttcgtaaggatttgccgaaattttcaaaggatttttcaaacggacaaggctggctagatcgcacaccagctcggacaaatctgtacctgtactagaatttctagctcgtactctcgaactctaatgtatccaatgtacgtacttgtactaagaagagctcggggtctttaactgttactgactacttggctcctcttcgacgtactcgttgtattgccgatcgattggacgaatttgccatcggcttattactacatgagaagctagctggagaatggagatagatcatggcgatggcatgggagaacgggagctgcctgcctgcctgacgaagtttcagaggttgcagcgctaattgtcgcgagagaaatgggacttccacaagcatgcacgggctgccgaacctgcctgatgctgtcggaaaactaataatggagatgcaggggaaaagcatatataaaaccatctgaaagatttggctgccgcgctcgtgaaatcagaaactagtactaacaaggaaagcatagaaaaagttactaccgtgtttgctttccatttcacgaagaatgtaccagtaataccgttttattatgagcatatccattaattaactgcagtagaacaagtaattaacattaacctccatctcagttgaccaatctagcccatacagtaatgtattgttcaacaaatctagcccatagtaatgtattgtcctgtacgtatcactgacatgattgatcatcacctgatgaaagcatgcacaaccatataaaattcagtaaaagcgacccacaaaagtgtttcatcagtcgtctcacccaagcaacgaattagcaaatccgggagagaattcacatgatcagcgggacccaagagagagtagcgcgcaacaatacctagctgatgacacggcgatgatcgatcgattgcctctagattagtagtagcagattaaaatacatatctcggtgtaaagagaccgcgagatcgagcaatactgcagaggtaagctctgcacccacggcaagtgatcaggacgataatgggccacttaatattccctattaggcatcgtctcatgttcaatcatgtggtggcatttgcaggggcagggcgcatcaatcgatccaaggttttgagttccagaaaataaaaactgatgtaaggtttttgtgggtaatatatactccctccgtttcaaaatgtttgacaccgttgactttttagtacgtgtttgaccattcgttttattcaaaaaatttaagtaattatttattattttcatatatagttttatatattttcgtgttaaatatactttcatgtacatatatagttttatatatttcacaattcttttttaaataagacgaacggtcaaacacgtgctaaaaaatcaacggtgtcaaacattttgaaacggatggagtatatatatagtgccaaaaactgatactgcgagatcgcttcagaaaacgtgggggtaaccactaccctctccctccccgtgcatcaaccgctatatggcatcgacttttctggactacatacagtactgaagatgtatacgtgcacacaccatactcatacaacgtcgagcgagcgagtcatatatatcatagtaggctatgtttagttcagcgtaaagtttggattttggttaaattagagatgatgtgactaaaaagttatgtgtgtatgacaggttgatgtgatggaaaatgactgaagtttggatccaaactttagatctaaacacagccgtagtacacaccatgaagcctgtattttgattgattgcctatcaaggccactagctactggttggtacttgtagacttctccagccacttcgtgcgtacattaatttgagcggaatttgaggtaagctcttttaacggaagaagacttgagcagtgagtactatcagcgcaggtataatagagtacgataagctgacgacacaagcatccacgtcatagaaatcataggtggaagagagagaaaaccgaagagagaaggcagcgggcgctaatgcaatcgccgagctccatcacaggaaacgatgcaagtcctgagaaccagcccttagtcctagcttttgctcaatgacttaaccattgctacatcaaagattgggtagaaggaaacaagtctcattaaaaaataaaaatcaactgcttagggatgtgtgggtaggtaacttagcaggtagttattatacgtatcatctattagtaccatctattacttacgtgtataaattttcagcccatcaacaaacgatactattaaacttgctctcaagatacattaacctcaaaacaaacaaaatactagtgtgtgtttgcagctagcagcagctatcattcttcttttatatacgtacgttgctggtgggtttcaccattctttccatctttccatttactgtaagccccgtttgacttaggtgaaaaattaagattaagcaaggatacataaaatgagaaagccattaatatatgattaattgaattttaattattataaacttgaaaagtggatttatttaatattttagaatttaatattttagagtaacttctacataaaatagatttatttattattttacacgaaatacaccggttagacgtttaaaaagcgtgctaacgaaaatcggaatagaatatgcatctcaaacagtcaatttgattctccttatgagtttctgtatgactgccatgcactgaagctgatatttgttttttctgaatgaacaggaaaactgtccgttatattgattgattaagcggagaataatcaaaagacacctcaacaccatacccaaagtgaagctgaaattgaaaagctcccccttttatttctggatcactgggtgccaatcagttttgttttccagctttaattctcccatcatcatctcaggaaaaagaattaatatcagaaaacacataccagtgggctcacattacgtgtgtttctgtacacggagagagagagaaaaaaaggacgaaatatatagcagcaacagcaaaacagatggctaaaaattccttttccaccacgtttgcacatgcatacggtgatgggctagcctttagctatagttagttcccgtcatccgtccatggcttggcacggaaggaagcagacaggccaagtgcagcatcgatcgagtataccggccttttaggctgcgttcttatcacagtttttccaactcatctccctcgttttccgcgtgcacgctttttaaacaactaaacggtgcttttttttacaaaaagtttctatacgaaagttgtttaaaaaatcatattgatccatttttgaaaaaaataaatagctaatacttaattaatcatgtgttaatgaactactctgttttctatacctataaagagtgttcccaacaaggagcagccaacacacccttaatgggttcagtttcagcttcatctcatctccttttgtctttccggctttccccaaaggaagccatctagatcaagctttagcatgtgcccatggctggctgcaatgcaagtgcaggtgcagcctactacaagctcgatcaccccagagagaccaaaccagcagtggctggattttggatgtccagtagtaggctttctttttgggagctagctaggggatgtccaacagctgagatgagtcagatttgaccagaagaagagacatcttaatttggcgatcctggaaaagcctacgcgtccaaggagctgtaaaatcccatcgctgggctgggccaagtggcctgcgcctcttttgcggtggcgccgagtggcgaccacgctacacaccgtgcggactctgactaccgcctacgtggggaaagaggcaggcgtgccgcgtgcagcgtggtgctccatctgctgcagggggaagggaaggcgcgcggccgcgactcgtctcgcggcgcggggactcgcgtgccaactttgaaatgggccttgagatggggtgggctttttgacaggcggatgtcatataggccttgtagcgtaagcgcaccgcaaaggcccaattcagccacgcacgtctttggtcgctactatgagaggcctgctggcctggtgccccgacgacctgcttacctccgtcagaagttttgacaatgaaaaatggaaacttgtggttcgcttgaggtctcttggtttgtcgatgagtttcaaaattgttcctgaatcaaaatatcggatataataatattataaaattagatcacactgggttccaaggcaatattgctcctggttttaggtgattcatcgtcagtgtgggaaccacatgtcagggtatttcagtctaaaaaataaataaaagttgatggaccccatatgccaatgacacaaactctcctccttctccctctgtttctctcccctccctgatgcgaagagaggtagccatggcgggagcggatgaggccgggagtggaggaggcctgcgacgatgaggcgggagcgggtggtcgacgacgtcccacatcagcagcaccgcgccctcaccgacgacgtggacactagcagcatgtccgggagggagcgcgagagctcgcggagcggttggcgaatgctaatggacgaggccaaagagtcaaagaggccatcgatgcccataaggcggaggcgccctgtggtcctggaggcgccgttgacacaacaacaggggcggggtgcggcgaagcaggtctgcggcacggcgaagaggtgcgcggcaacgacaaactagttggtgggtatggcggcgggcaacaatgcggcgctcgaagaagttgcccgtgaggctggagtagccatggacgccatagatcggggcctcttgcttagctagcgggcgacaccgtatcaactgctcgatctatgtgtccaggctgtcgcatccctcgctgtcattcccgtcgcctcggcatcctctcccaggccatgcccacttacatctgacagtttttcttggacatagactgccctcacagaccaacacaagtattttttgcacacttcctcactcgtgtgcaccagggaagaatttcccggtcggtcacccatcccgaaattgctccaggccaagcacgtttagccttagagttctttggagattggcttttgtaaaagaagttgcaacttgtttgtatgagtattttattaattctattaagccccgggccaggatgtcacaggatgtgtgcaggtcgagcggctcagcatcggtgacatccagcgcctcgagtggaaagcactagaggccaagatccagtgcgagatacacgtggccccgtggtgtcttcactagcgagcgctaccaccagccgccacccttcttggttctccccgcccatcatcggccaccctggacgcttggattgagtgggaagagaggggatcaaggtggaagaagaataaggtgctgacatgtggggtccacatggattccacgctgactcaaccgccacgtcaaccagaattgagagcaatactgccttgggatctaatgtgacctagttttgcaagagttatatatggtattcagattcagggacgattttgaaactcgacgacaagaaaaatggcctcaagtgaactttttccaaaacttgtagaggcatctctgatctctctgtaaaaaaaggaactggaggccgttatgatgactttctacaagacaatggcccagtgtaaactcttcaattctatagataaaatgtttatattgattttacaaatagagacttggatattatatttatgaatgtattttatatttgtcttatattttttttgacttatatttagtgccccagtttatattatgtttgcattatttccatcatctagttgaatatagagattgggtttatctcatttttttttaaaaaaaattcatcatatcgttattggtacccttaaattttagtcttgcgttcgtcgctggcaatgatattacaaacctgttaacccaccaaattatgctgaagtactgaagtgctctcaataaacaactcagaaatttcgattctatctcaactgagcatattatctaaaaaaaaaaaaatctcagctgagcatagctaaacatatggcacatggccaaaaactgtgtttctgcttcactgtgtctacacgtgtgatcgcatcttaccatgctgcctggcacgatgtgaacagggaaaagatcaaaggagtttggtatcttggcacttttaaatcggaccgggaaatttgaattatattatgaattgtactggtcatgttaagaaattaagaaacgctcccatgtagcttgatgttagttggaggacgagcacagggttgttggcatgtcgtcaagtgaggcttaaaacaatttaacttgccattaacatatgcttgtttcctcacgaagcagcatgcaacatcagcagtgtagtggctacaaatttccaactactcctgctcaactattggagctagccagactcaatggcctgtctttggttatataatataccatttattaaactgctgacgagcaagaatctcttgtgtcataaatcgaaacatacaagctaaagcactcgttaactattcctgatgatatatagtttttttactgttcgtggcgttgtactggtatgctacttggcttcacattgtttaagatcattataaatgtggtttgattcttaaaatgctttctgatggtactgcttgcttgaactccttgtgcctaatagctttgggtttggaaaactattgcgtcatttgtggcttccttagagaaaacacttgatgggactatgcatcttccaccaactttgtgagttgtgaaacacattgcctggtgttataaatgcagtcgctttggtgcaaacattctgaaggaagcatcttatggtagatgaaatgcaacgcagaaaaaaaaatctgaaaaccgaaatgcttccaatgggtaagttgcaattgatttcttttcgaatttctcagatctagcaagcatctattcatatttttcagtccagatgagagttgtacttaagtttctagaaggaatcatcagaaacattaatctgaccggcttgaccttaaacctgccattgccatacttgtactcctagtacttctatggactctgaaacctggagttcctttcttatgcaaaataaagttcttctaatatgctactcactctagtttgtaaacacttatcgtttggataagacttatattaaacttttagactttggactatgaacgattttttaatatctactcgagaaacatagagaccataagtatatttaatcttaaaaaacacttcaataaaataatgtattattgataattttatatattatcataaaaatattggtcaaattaattttttaaaaccgtctttttttaaaaaaaaagataaatatttgtaaactagagggagtattgttgtaagctggtaatcaatggcatctttccagctgcttcaagtcagctagtttaaacattaagtgctttgcttcttaattggcttccaaggttccaactacaaccaccattttcgtcgtgatggagacctaaaccaaaacctaatgaatgaagacgggctatagctccagaagagttttgagtacagacactcgggcactttttggtgacgagcttgttgcgcatgctgctgcaggaaagtccaagaactcttcccaatataatacaaatatacaatacaatatacattgcttccaactattgatgatggagggattaaaaacaggtccatgattggtgattagggccccagaccaaacctaatgtctaaactaatgaggccttgtactacattgcatgatatcaacgttgagattccgttcggaaaaccgtccagatttgtgaaatgtgtgttcataggctctgtactttgaccaggaagaagtttaagatgagtagaaccagatcaagggtactgtttatggccttatcaaaactggccatcttagctgcctttgtgtccagtaatcactaatcagtagtggaaggcatgccaatgtctgaatcctgcattcaatttttaggtatgagacacgtgtagagaacagttggtgccgtttctgatcatgcttctaggctctaacattgtttgaatcagctctgcaaattggaatctaaggaagatgcaagcaatactggacaatagattagaaccgaggaagctacacatgctaaaccccataggtcgagacttgagagatattccctcgttctaaaatatagctagttctaataacatcttaattttatatataaaaaacatctatttctaaagtaccaaggggtatttagttgtacaattcaaaaatgtggttttgggggagggggggggggatttagttatgaatgtccaaaataccctcatccccaaaaccccacttaattaccaatcaaaacagtcaatgaaggataatctagcaattttatatttcttcttaatctccgttgaaaaccctgtaatttttttcgaggcagaaatagctatgctttaaagcaactacaatgtggaaaaaaaaaccagataacaagcatttaatgcaagcttactacccagtattaaactagtaatcattgtgggaagaggtagtagttactacctggtgtttgcgctattgccggcaacaaccaaataaaatatgaagattcttactggaccaaggtaaaggagggttgggatggatgaatattttttaagtggaccctaccttgtttaccactatactccatataagctttgtaagaagtgttacatcttactgcctcctgatcatgggacccaccttactatctactctttttgtcccaaaaaaaagtcaatcttagtatggatgggacacttcctaggacaacatgtccaaattcgttattctatgttttatctatgctaaggttggttttttaggacggaggaagtacttgagtaatatacattgagcatgccctaagacttagcgaatataataaagatgttgagtaaatcagacagagcccattgttttgctaggtcgcttccccaaaccacaaccaatcatgcagcttgcttactgaaccatcggccatcacgcaacatcactagaacttgaaaagaaaacattttatctgcggctggatgtgtacttcatgcgaataactaaccttgtgatgatggcaccgtccagcatgttaacgttatcaccatttgattctttgattaacttaaacatccaggccacgacaaaaccccactttattgcagtcgtacaagagaattagctgggttgttagtgcgtatatattgcattacgggaagcaacaaagggtgatgtaataaggaggttatgcctaagcatatgcctaaagtttatactaggaatataccggggttttgggatgcattgttcagaagagacagaagaagggttcagtcttcagcagttcagcagcgtgggcgatcatgcatgtttgtgaactgggagctatctgaaaacttttcttgttattgtagtgccgtcaggttggccgaccgagctggaagtggaactgggtctcgagccaactgggcaagtggcagggttatgacttatgaactgtaacatgccttgttcttcaaatcaagtagtttggggactctatccggttttttgtttaagaaaacataaaggattgaatagttaatagtgatctcaacaatgtatggagcaactcagcaacagcaatatggagtttattaaatcgaccataaaacgacttgtttaactatagaaattcatgatgacaaggagatactgctctaactagcggtttttttacccacttttgtgcagagctagtttataatgtagaattaaattacatattccgttcataaatacaattacattttgtccataactatatcggtctagttacaccattataatctaggtccaccacgatcaaatggtgagtttattttctttttttctctaattaacatgataatttctgtgtttttataacaaatatgacaagtcttttttgccatttcttaggctcttttaaaatacaggattgtacatgaattagttcaatttttccggaaatcctctaaattccttcattccataggagatctttataattatacaatacaataggttcctttggattttcctgagtacttctcttttggaaatttccatgtatctaaaatcattagagctagaagctcattgcaccagccaatcagctctgtggaagccatttggacaccatcaaaggccaatcctgtttcactttttttttttccaaatggttcatagaaatatgagaaaatggtaactccacgctctaatattgaaaagttttgactttcagcgccggccttggcaacaaagctaagcaacctgatgggtgctaacacaagttgcctataagtaagctacatttaagttgagattgtgtgctatttatatgttagagagtacaagttactgttggccatctctctcggcacatttctacccctagcctttagcaacactgaccatagtcagccagttcagagcttcagatagcaccagccgatacattttcttcaggaaaaaaaaaatctccaatggtttgctgatcggttcactgggaaattctaatttagtcctacaccccacaagacgacggtcaaataagcggccacaggaagactatcataaaaccagttaacatcatcaaattaaatagatttgtttcaggagcttagtcagacgagtagaagcggccaagaacaccgggcatttctttactgattgccaaccagctgcaggttaacaattcacagttgcatcggcgaccgaagcaaccgcaacaggacagcgtcacgcttttcggcgagccgatcgatcactcgctcgcaataattgctagcttccgtagaagggggactcgctcccgaccagtacgtctcgccggcggccggtcgctgtcgccggccggcgagccaatcgccatacgaggattgccaagtgataccgtgagctctgcaggaaacgtaaaatttttatctcatcagttcttgctgcactcaagctaagctatcctgccgccttgtcatagtatatgttagggactaaaaatcattatcttttttttttcaacgtaggtgtgtcggtcgatggcctaggtgtgtactcggtcgtcgtcgtgagtacggacggcgacggccggagcaatttgccgtttaaccactggcctctcatgcggctctggccatgcatggaggtagccacatgtcagtagggtcgagttaatggcagagaattttttttcatctcgtttttcagatttggcttcgtggagaggtgccagtggctaattactagctagactgccggccagtacttggctctttcccatgatccatggaattcaagtattaagttagttacttggtgttttggcatattattgtactagatagatcattccaaattaagtatgggtgatggcaagtgaaaaaacatatgatatgccaacatggagggcggtatgctctaggtagatttgcatgctccaattgtcttgggcaagttgcttgggaaacaaaaaaaattagtgcagagacacatcaataattgcttacgagtgagtagtatttagtgattagtatgccataataagaaagtgttccatggccccagcaagttggaggtcaagttgtcaaattgaagttagccgaatgcaaacacaagagagtatctgtttcctccggaaaggtgaagggctcagtgttaattaagagtaaaaaaaaaaatgaagagcgcaggtgaaagattttgcacaaattgtcaaaaccttaaaatttgatcaaatattgcccaaaactcaaatatttatgattggatggaattaacacctaataataatggaggaaattcaaccttgattccttgaacataccacgtctaagaaagaaaaaaaaagaagatggttagtagaataatattttgaaatggttaaaaaaatccatcagcatttatatatagcaaccttctctcttctttcgattacatgagaaatgcacgtaaacacacactgctagtatatcctattactacatgctaaacataaggaaaccataagctcatacttcatacaataggtacatatatgaaaacagtccacagctatgtttgaaaatgggataggctgttggcaaactttgataggaaagagaaaaaagcgtaataataaaaccatatatttttagagattttcaatgatccacttatttccctcaatttattttttgaaaagtctaacttatgtttatttagttggctcatcaagttaatgtgttatccttaatattccatccatcaggtgagacgtgactaggaacaaattagtgctcacttacaaagcttcactactcaagtttggttgggagaatcttcttggttcaattgtaacctacaactcaccactgcacagatgcaaccaaaaaccatgtgagacaagccattgcttctgtccaacattaaagacaagaacgagagggtatcatggaaggaacaaaaacaacgtaaaaactaataaattaatgcatagtgatgccaaaacctggctaaaccgcacgaacagtccgatgttgacagaatggttatccctcctatagcaatctaggatgtgataagtaagactcatcctatgagtacgaattagaatatactcaaagctcttgaacatactcaaagctccaaaataagccaaacggcttatttacaaaaaaataataatttatgaataaaacttttatatacgtgttcttagcgatttaaaatcaaaggctggaaaataaaattcgatgagaaaacttcaaaatcaaatccaaatttaagattgaaaatttaaattttagctgataaatataagcataagcgaaaatatggggctgtcaatgtaagttgccagtattgggagggaggaagtagcacacagaaacattgagaaggaactgtgaccagctcagttagtaaaaggtgcatgaattcttggccagctgccttcatgagatgtccctctcatggatcaacttatctaggattattaattttatccttaaagagacaactgacattgtgaaaaacaagaactacaatagatttccaaattgttttgatacttctgttgaagctcagatcatttactaacctggtaatatatccaccaagttaaaagagtggcgatgatacagtcaaacgcattgtttcatccatctactgagaaacctacgtgttctactcaattactctggtgaaacatacaaacatcgccgatttgtacggtttaacaagaaaaacaaagcccataaaccctacgcaatattttagccccgatttctctctccccgtgtttgctatacttgtgttcacaactaatgaagttggaaactaaatacaagcatccaaaatgagaaagacattagaacataattaattgacttttaattattttaaatttgaaaaaaatgatttatctaatattttaaagtaacttatatataaaaactttatccactaaatatattgtttagcatattgaaaaacatgctaacagaaactaaagtaaaatatgtatcatcagaaaagaatgccttagagtaggtacaatagcagactataagccaactataaatatattttattaaaaaaataaaagagaagagataagagcagcggactatagatttgtagtcagctatagtacggattccaaaacacatgtgtgtataacaggtggggctagatattgattgtgtagtatatatttatagataactattgtattaattagctattaaattaactatagatgatttgaagctaatagttggctataggattaaacttgctcttgctaccagtctacctgtgccggcttaattccctttcagctagcacagtgccgttccggcgcggggccagtgccaagaacggctcaagcctccctgtataaataacccgctaggtgcccactcgtacttggcaattggcaactatctctgcttcccctgttgttccctctcgcgccaaaacatttgccggcaaaccaaaaacagaggaggagcacacacgcacgacgcgtggtaggagagtacgggtacggccatggaggtgaccatggaggacgtggccggggacttcgagttctccggctgcggctccaccaccaccacctcctccgcgtcctccctcgacgacggcacggggatgtgctacgcgtggggcgagctgtccccggtcgccgactgggccaacttctgctgctccgacgacgacggcggccacgacctgcacggcctcatcgagtccatgctctgcgacgacacgctcgtcggcgtcgacgacgacggccaagctggcctccaccacgcggatatgttccgcgacgacctttactgctacggcaatggctccaacccgagcagcaccaccaccacgaaccctggctcgccggtgttcgacgacccgacgcagggctgccccgagaagggcctccggctgctccacctgctcatggcggccgccgaggcgctctccggcccgcacaagagccgggagctggcccgggtgatattggttcggctcaaggagatggtctcacacaccgccagcgccaacgccgccgcgtccaacatggagcgcctcgccgcgcacttcaccgacgcgctccaggggctcctcgacggctcccaccccgtcggagggtccggccggcaggcggccgccgcggcgtcgcaccaccacgccggcgacgtgctgacggcgttccagatgctgcaggacatgtcgccgtacatgaagttcggccacttcaccgcgaaccaggcgatcctcgaggcggtgtccggcgaccggcgcgtgcacattgtcgactacgacatcgccgaggggatccagtgggcgtcgctgatgcaggccatgacctcccgcgccgacggcgtgccggcgccgcacctgcgcatcaccgccgtctcccgcagcggaggcggcggcgcccgggccgtccaggaggccggccgccgcctgtcagcgttcgcggcgtccatcgggcaacccttctctttcggacagtgccgcctggactccgacgagaggttccggccggcgacggtccggatggtcaagggggaggcgctcgtcgccaactgcgtcctccaccaagccgcggccaccaccaccatcagacgccccaccggctcggtggcgtcattcctgtccggcatggccgcgctcggtgccaagctggtcacggtggtcgaggaggaaggcgaagccgagaaggacgacgacggcgactcggccggcgacgccgcggcgggcggcttcgtgcggcagttcatggaggagctgcaccgctactccgcggtgtgggactctctcgaggccgggttcccgacgcagagccgggtgcgcggcctcgtggagcgcgtcatcctcgcccccaacatcgccggcgccgtgagccgcgcgtaccgcggcgtcgacggcgaggggaggtgcgggtgggggcagtggatgcgcgggagcgggttcaccgccgtgccgctcagctgcttcaaccacagccaggcgaggctgctgctcggcctgttcaacgacgggtacacggtggaggagacgggtcccaacaagatcgtgctcgggtggaaggcccggcggctgatgtcggcgtccgtgtgggcgccgccgccgctgccggtgccgtcgtcgccgccggagggggtgtgccagcccgtcgtcgggatggcgccggtggccaccggtggcttcgcgcggacggagtttgactatattgattcgttccttgtcgagccagcttacgcgctagtttgagtcgccatctagcttagctttggattggatgtgatcgcagaattcagacgtaaaaaaaatgtagctcccgtgtaagttgagttccgttggtgtgtcaaaactgtcactcgcaagacgttgagagttgctaactcttagtacgtgtgtgttggtcgttctcattcgagagattggttagcatttgatgttgcacaaaaatttctacgtaggagtgcactattgtgcttgcttatcaacggtaaaagttaatcgtaaattgttgccagcatattgactttgttaaaaggaaattgcatgcatacaacccaattatccgactcacgtacgactgaatttgataaacgtttataaatggttgcaatgcatatgaatatgctttatttgatcaatctatggttacatgtttctatttgtatatgagttgtacaactgggtcatacgtatagcagtactcttgttaaaaatacaaccaccatgtaaacaaaatggcactttctaattggttgggctacagctgataaacctgaaaaataaacaaaccaatcaaaaataatttatagataaaacttttagaccgatatcattaccagtttaaaaaccgacgttgaaaaattgactagacgaaaaattccaaaacttttgtttcacaattcaaatttttgttcttgttgataagccaacgagcagagactacgagagccatcaaagctggagtcgggaaagctacataggcactataagagagagagaagggggcaatcaattagtaaactcaacaacaataatcgaagataaaacaccttagggagatgcttgtgtcttgattggaaagcaatattattgtctgtggatggacctcgatagcatggatccggtaggaccctctgtgagtttgactagagagctagtcatgtgagagtgaggggcttgagctcctctagagcgctagaatagattaacacaaagacgtatacaggtttgggataccctagaggtgtaacatgctactcttgttgtggtggtttctcgttcgtccttgaaggatcttacaagtttatcgactactcaaatagattatcttcctttctcttatgggtttcctaagaatttgactcaatgtgttgaagtctctcctcagttacccaacatcccaccccctcctttggtcctcgctcttcccttatactttctctcagggacaccacataaccacacttcgagggaagattttattcgtatcaacgtaaggtatggttgtctcatcaatagttcattttctctcttgctccatcagccgcaggttaggccttagtggggcccactgtaagcggggcatggcaaattggtgagagtttgccatgctaacctgcctaatccactagggcctcaggtccgtcttgagcggggccttcttcatgcggggcacgacgacaacttgccacatgctcccattcaatccaccaaacatgtggtgaatagggttcgttgtgccccggtaggtgcggagtccgcctttcattacctagtgagaggcagaaacttgagtgggtcctagtgaggacactgtagtcaactatgccctccgattatccatgcccgtgtcaggaccaacacagttgaagcgttagttgaagcgacgagtggcagttgctgcagttgccgccctatcttcatgctttctgctccatggtagataaccgtcccataaagcataaatgggacccagtgccagcctaaacctgttgttcagcctctgtctaaggattgtcctcgaggtgccctaagtggtgcattcttcttatcctgggatagaccacgtgccactccacatcaatctcctgtacggataacaggccaaatgaagagatacgtggcacgttcctggtgcacgtcgattgcctgagaccgcagttattgggtcactgacaaatatactctctctggcccaaaatataactactcatgaagattgttaaataaattaaggagagagataaaaaatgctagattgcccttaattgtcaccaccgttcctaatcccagcgagaagagggatgaaagacaaggtttgggaaaaatggacatttcacttcccttcagtgacaaaagattaggaagaatagcaagtctgtcatttaaagagtgacaaatagttaaactgcattgctaaccttctgttgacaaaaaatccatcctcaaatcttgtagattttgggctaagggatgttcttcacgattaatgctccgggtgtgtctcatccaactctggtgacttcctcttctcctctggttccgacaacaccaccaaactccaaatggaggacctacaaattaaggtcatgagttggggatgagggatggaagaaaagtgggaggtcaccgcctcgcagggcttagagggatgaccatggtccatgggagatggtgcccaacattgggcagaggaatgggtgggcggctagggcatcggtgctgccaaagcgcgtggacggtaggcggcggtgggcctgtgttgcaggtggcaggggtaaagcagagcgacgagttaggaagtggtgaccagtggtagcggattcgacagtgaggaaccacttgagacgagaaaaatggctgggtaggggacctcgtcgttgatgtcttgaggaggacaacggggtaggcctgcgcatcaaataagtgtcggttcaagcatgcggtgctgaaggaaaaggaaaaaaaaaagagaaagggattaggatatggatacatgtatgaatccccaagcaatccaactatctaaaattacaagattttgagtggtgtttctgctaaagatgtactccaataaatagccaatagttaaattttcccaacaggcccatcatcacgtgattcgcacgggttgcacgtcggttctggacttctgatgcatcgttcggggagtgccgggcacgcagaggcgttggtgcgttgcaaaacaaacatgtcaaaaccacggagataaccagataatcctcgcacatctcgcttcccatctcgtttccaccgcacctttttcctctcggcggaaaatcccagcctcgaatgtgccaacgagctcaccacaggcactgcacagctcgtgcgcaacgcccagaggaggccgtgggcttcctgtcccgcgtccgcgcccaccacatccgcaattccgcacccgaatctcgcggcgtcgcctcgtcagacctcagcccacagaaaacggaaaaaggaaaaaaaaacagccaagccgccgccgcgcggagcacagcggctcagcgtcagcgagcgagcggcggcgcgcccccctcgtcacgcacgccgcactcggctgctacggtcctcacgccgcttcggcttcgcgagcggacgccggcgcgcgcgcgcgttcggcgagacgcggcggcccttctccccctcttgcacaccccccagaccatgcgcgtctccgaccacgctgctctcccgtcgcgctcctcccagcagcagcagcgcctgtccccgcatggcgagccccgacaaggtcggctgctcaccggagccgctgcccctcgaccgcctcctggccgagctcgccgccaacgccgagcggctcgggaggaggtgggaggcggcgctccgcaaacggggaagggagggagccagagcggcgggcgtggggttggaggagggtaggaaggcggattcggcggcgatgcagctgcacacgccgctgttctacgccacctgcgccctcggcgggctcctcagcaccggcctcacccacctcgccgtcactcccctcgacctcgtcaagtgcaacatgcaggtctttcgccgtgttactgtagctcaaatctctagcttccccaatgactaatggaactcatacaaatcactagctccctaaatggttaatggaattcgtgtgtacaatgtattcttgcaggttgaccctggtaagtacagggacatttcatctggatttggtgtcctgctccaagagcaaggtcttggtggattcttcaagggctggatggccacgctggttgggtacagcagccagggggcttgcaaatttgggttctacgagttctttaagaagtgctactcggccattgctggcnccgagcatgctgagaagtggaagaccttcatctaccttgcagcgtcggcatcggctgagatgattgcagatgtagctctctgccccatggaggctgtgaaggttcgagtccaaactcagccaggatttgctcggtgcctgacggatgggtttccgaagattgtccaatctgaaggtgcctttgggtatagatactgcatttcttgtatacaattgtgacttctgttcaaagtttatttggggacatcctataatacaatgtgcgaatttcaggctttataaaggactacttcctctctggggtcgccaagttccttgtaagtcaaatgtctcgttagcagttatctttcactagagtattatatttgcatgtcaggtttttaactgcataatgtagaccataggtccatagtaatggggcaaataaaaggtccatagtagcaactaacatttgacagcaagggctatagcaaaatcctctggtgagttactgtttttgctcatgttcctactgaaaggatattagattttgtgtgcaataacattatgtgccacgagcgttgaccatgaagagaagtcttgaagtcgcatgctcacaaagagccatcgttgacagattgatactattctaacataccaaattgcccattctactgaatgagtgccactcatcgttgctattttctgacagaagaataactttagctggcactattttataactcttttttgagagttagtattttagtagtctgctctcctaataatgctgcaagacatagtctgttgcactttctcgaacaaactatattatattttcttacttatgtggctactctatggaaaaattgtcaattgtaactattatcacggtaacaacttcagggcatccctcgaaatttacactacgaatttaattcattgcaccctaagtagaagtcaagatcagctgtagttgtcaaaactgaaaacaatcaaatggttgctgtagctttaagctatgtatactagatacctcatttgttttgctcagcttcttagtttgctattcttggaaaaaaaaatggatggaaaatttaacatcaatttgtcaggatgataaaaggtgggagaggagataatcttccaacacgtttatggggaattggtttgttgatatcgaaatatgcccactttagaaatataccactcaaagttaccgatgcacttcaataccacccaaagtttcaaaagcatagataattagatatctgccataccatttttttaaaaaaaataaatcaaggcaatgcacttactaacttttagtggttgttttaatgaggaaaataaaagcaggtttttaggggggaaacgacttttaattcgacttttaattccgttattccagaatctagatatatgtaaaatcttgtttggctgggcaccaaaaacattgtggagtcgttcctgagaaaatacgatttttccagtttcgaggaaacttggttttatccaggatctggtacatgaaacaaacaaggatttacctaaaacaagattaaggtaaactagaattaataaaatgtagtgtaaattgcagataggaccacatcttttaaaatgtaagatgctactaagtcccgtacagatgccagcaattcttatgccgtttccttttaggttgttattctcacttgtgtctaaactactttcaatttccagatactatggtgaaatttgcttgctttgagacaattgttgaattagtatataagcatgcagttccaaagccaaaagatgaatgcagtaagccactccagctagcagtgagctttgcagggggatatattgcaggagtcttctgtgcagctatctctcatcctgcagacaacctggtgtctttcctcaacaatgcaaaggggggcactatggctgatgtaagctgctagccctctcagtgactttcatataaaaaaaaagttcttacacctactgtcaagtaatgttctactgattttgtttaactatttctgaccaatgcattgcactttcaggctgtaagaactctaggagtgtggggccttctcactcgtggccttccactccgtattattatggttggtactcttactggagctcaatgggcaacatatgatgcatttaaagtctttgttggactgtaagtacatcatggacagttcgatttttgtattgtgatgcctaccagttatttatgaatcataagcgtttgtgaattcaatctccaggccaacatctggtggattcattcctagtcctgctgccaccgatttgcgccaggtggatcatgaaaagcggagttgaccacatcgcgtaaatgttgtgctgagctactacccttaatcggagtagatgatggcaggcagttgctctgattttcatgagagcgggaacgtaggagatgacctgttgagcgaatttggaacacaattttaagatttagcagtaggaaattcacattcaaggggtttttgttgctacctcttgaatgacaggcaagtgcaaggaaggcaataagcttgagggatgtatttggcacattgccaaactgatctgatcatctgatgtttcaattggtcattcttgcctctgttggcatttcctctggtagtttccatacgactgtttatccagcgtacatgatagcatgaataaatgaaaagaatgttaaacatgggtcgcaactatatggtcctcaccgaaatcaactgaccaaagcaagagcaatttcgcatgaaagcagcccatcaaggagatcctgatcggtacatactgaattatcgatgttgtatgtatgcttcgcgcaattgcatagcacccagctcggtgctcacgggcacacaccgtcaacgtcagacaatacaagaacaatgtgcgcaagcgcaatagacaccaagtgctttgaatagaagtatcaaaagtatcaaggtggaaaatttcttaaaatcgacaatactatagtctaagagtacatgtaaatatataatgtatttgacaacatacaaatttgggtcaaaaggcattctacagcaaactaggcaatcattgcaacatttgtagcccgacctcagttgttgtcgcttgggtcatctactgctgcggcccaggaaatccttgcattggaggacgaggaggtgctccaggagtgaagttagccattgcaccaccggtcataggtgggggtgggattgatcgtggaggtccatttgcaagtgggggcggtggtggtggaggttgagtaccaccaacaggtgggggtgggatccttgggggcatacccataggtgcatttggtggaggcggcggcggagcctgtggcgggggtggcggaacctgcggtgggggtgggcgtggtggacctccagatccatttggcaaagtcccaggagccgcaggcggcttattagcttctggttgtcttgttttgaagtatagttggagctgttgcaaacaacacgaagataagttgagaaccaagattgctatgaaggcaggctaaatagcctaaattatgaacaatgaaaaactatattgtactcacaatgtactgtttcttgtctggatcccaatagttgaagaatttatctgctgacttgtcgatctctgcgcttggtatctgcaacagcaaaaattgttagcaaaatacaatggccagttgatctgaaatcctagcagcaaaacattcaaaacacacaccttaaagccaataatttcatagggctctgctgcaaaaagtagatattgatactttttatcccaagattcgactttctgtacaaaacatcagtctgttaggttactgttgatacatgggagtaacaaacaaagcaacataccacaaactgaaaaccgaacaatcaggcaggttgattgctttacctgttcatatgatgccatgaaacggtgccttggcttgctgttttcttcaatttcaggataaccaatctaaaagagaaatatcaaaagttatcaccccagcgtacaaaattatatacatgttctaatgttataaggataaattttaaaaacaaaatatcctcaaaatttgtcggtgaactcatttatccatcaccattttgaatgtgatagtcctcaaaagtcccctcatcaaaagatgaaactccaggtaacaatattataaaactagtttgcaaatgtggatgtaagggaaactatagaaagctgacattgaacttaaatatggagaaaaaaaaggagctaacttaactggagtcacaaaaagatcatttccataagtatgtaactttgatgccctacattacatgacatgaaaagaaaaataaacaaaattatctctatatatatggagtattggaaagtgaactaatttgttctggacttcacaatattaacatgtaaaaacatgtatgaattaaattcaagtgccaaacaaatgtaaacgcaatgaacactgacctcaaaaagaaatgagtgttgcttcatgtcaggatcatactgcttagtcacctgatacccaggtcttccaatcttaactgaaaaggaaggaaagataattaaaatattttgtgttagattcttccaacagattcgaccatgtccagatagctggacttaaagatagcataactatccccaaagatacagacaacatgaaagggttcagataagaaactggtcatctttgagaattgagccatactcagttttaagccaaattatgagctcctataaactttaagtatagtaaaacaccattctggactagaaattgctatactccatgaagttttcagaactaatccaaatattcatgcttaggctccaattgattagcataaccgaatgtccacggtgagttttcatttttcaaggctttttcaaggtgtcatactgtcatctcctcgtctgaatttggtaattagctgtttgaccttccatcggtagattgatttgaagaaaagattctatcattcaatcatttatgaacaattttcattatatttagcagaattcacccacacaaatttgccgctagacactaactaccaactacatacataattttggatctttttttcaactgagagcaaaccaatatgatttagccatacttggtagaaccaaacaaagccagaatgcacaacagtttagtgctaatattcacattataaccaaaggacgttaatcctgggggaaggagacgagaagagatgttttactcaccggacttgcggggcgcgaactttctcttgttgggctggggctgcgcgggcgcgtccttggcctcgcgggcggcacgcttggcgaggttggtctggtgccgcttcccctgcgtgtgagccaggtagttcccctcgttgttgtgcagcgtcaggcacagcttgcactcgtagctggacacgaaatcgagcgggattagcgcgagggagcaaaccgaatcgaggaagaagaaagctagggttttagcgggtgggaggcagtacctgccgaggtggttgcgcatgaagtaggggtccttggcgaggtcgatggtctcgagggcgaggcggcggaggcgctcccgccggtcgatggcctcattctgggcggaggcggcgccgccgctgccgggcttggagccccactcgcgatccatggcgtccccgctcggtctcgccgcctctcgagtctcgacctgtgctgtcctgctcgtatgcggtgtgtgccctctcctccctcgatttgtacacggtgcggctcaggtcggttggtttttaccagtagcggctatttttgggcccaagcccacttcgttgcggattcagcccaaacattgctttatccttcttttataccttaccagtcgactagtaaatattaacataggagtactatacaagctatacttaccaagttaccatgtttccaaaaataaaaaaaaattggactaaaaatatagtcctaaagttagagatgatatgggctaggtttttgtttcaggaaattatcatcctaagtttctgattgttttcattttcattgaatagtagccttactgtattcttttttttatctccaaaactatctcaaaattatcctatcgacgctatccgttttttaaaagtggctggatagcatctactattcaaaccgatttcttcctacaattgagtaaagtatctttttttcccaataaataacgttcattctaggaatttactcacttcaatctgacggggtggaaaaaaactcgaaactcatgagctaactcaacttgttgtaaaactcggctcgactcaggttgagtttaaacttttactcatttgcttaatgagtcaactcgagctagctcgtgacttactcggttagctcgttgagctcgtgatgcattaaaatagaagttaattgtctatatatttacaggtgtaaaggtcgtaaattcataattatccattgtagcacaatcttatgagtcatgatgcataacatgtcaatcgtaatctttggtcataggccaacaaattatattgtatatgaattttaaatcatgtattttggtgcaacgagtttagtgagtttaatgagccaactcagactttttaacgagtcgagtcaagttcagttttttacttgttatgttaatgagtcgagccaagctagctcgttaatttaacgagtttttacgagccgagccgagttggctcgttagccaccctacttactggtacattttttttctttataggacaacaccatcggccttataaatgtgagtactattcatgaaaggctaatgactatgatgaaaaagaacaaaacgtttgtacgatggtatttcgcacaaattacatccactgaaaaactatcacttgtaaacggcaaatattttttttccgatcacacgaagacacgaacgcgtaccacgatcgaagccgaaaatgagcagaaccattctgagaaggggtctaataccatcgctgtggtctgtggctcttaggagcgtcataacatgaaatacatggtagtccatgcatgtccttattacacgataactctagtactaatcttattcgatcacaatttgcccaacatttgccatcaagtcccagagatcaccaggcactttctatgatggcccggcaaacacaaacaatacatcaactagtacacctttgttgctgctaaaaccagcctatcaaagtatcaatcaccaagcacgttgctgctactctgctcttccaacgggtaagggatcgtggcgatgtggttatgagccacggtgccgatccacagcttgcgccccacctccctcacctcgctcaccagccgcatcacctcgccgccccggtcctcgagcacctcgacgacgtccccttcgccgtcgaggagcgcgacgagggtgtgcatccgcatgctgaccatcttccccagcgtccgcatcgtcaggggcagcttgaagtagagcgttcgcagccacggccgcttggcgaacacctcctgcgccgccgtcctgcagcagtcgatcgccacccagaaccgtccgccgccgccgccgctgctcagtcgcacgttgtccgggaaccccggcaggtcggcgaacacctccacctgcccggctcttggcccttccagccagtaccgcattatcctagaacagcatatgcgtgcaatgttaatcaattctgaatcttgtttaacctttagtattttcagaacctgtgaaagcttgtgccatttcacctgcagtttgttgtttcggagaagaggaggaactgctggtcgtcagaaatctgcacgccattcgggaagaccagcccgctcagcacgacatgggcagctttggtttctgggtcatatctgagcagcctccctgtgccttcaccttctagcagaacgttcagatgatccctgcacaactgattctaatcagaaaatcttgaacgatagaaggaaatagagaatcgatacaactgaagagagtgatactgcagctgcacactttctgttgtatctcgtgctcgtgtcggtgaagaacacggagccgttgcggtggatgtcgaggtcgttcgcgaagttgaccgggctcccgccgacttctctcgcgagagaggtcgccaccccgccgttcggaccgacggacatgagcccgtagtacgcgtcggcgacgtagagctcgccggtctcgccgtgaaacctcagcccgagaggccggccgcaccgtcgctccatctcgtgctgcttcttcgtcgtcgactccaccccattggcacaaactttctccgacctttttttgcaatataagaacacgtaattgtacactgctacgagaggtgttttcgtggagggcgagagcaaaatgcaggcgaggtgttcgttaccagtcagggctcatgacggcgaacgtctcccacccggcgtcctcccccatccaccgcacgacgcggccgtcggcgaggccggcgtaggggccgcggccgtggcggtcgaactcgatggactccggcccgaacacctctccgacgaactccagcctgccgtgcctgagccggctgccgttgtcccgcggccaccgcgccatcacctcgcggtacggcgccagctcgtgcctcaccggccggtagtccaccccggcgagcgggccgaggtggaacgggtcggtgaggagcagggccagcgccagcgccgcgaagaaaaggtgcggatactgcaggatgccatcgcgccctctctgtggacgctgctgctgctgcttcttctcttccatggagatcaggagcgagggaagacggaatttgcacgcagaggaaagacggaattggtggagacggtgatcttaacttaaattcttaatgcctttgcagcgaaaatatatattcgatgcatggaggttgcatgagtcagcgtgattgtttgggagtaggtgttctgttggttcggaatagccaaggaatcttgtgctttcgaagtggggatttgcatgttttgcattgctgggatgacggtgcaagatgcacaggtcaacaagcatatcacgatgcatgtaaccgaacccggccagggctgagggccctgaccatggccattgctagcgctgtaaagcaaaaggtgcatcacgaagaaggaagaactccaagtgtccagaagttcaatcgatgccacccttctaaacgtgcaggaaaaatcacaagacacaggcaatggtgtgtcgatgttgcaagaaaactaactctaagtcttagctaaaacatttactgtggttgagcatgcgttgggttatagggaagtctatttgtccctttgttttttttgttactttaaaattcaactaaaaaactattttttataaatatatcaatgaccatgaagtttaaatttgacttacataggtacaaataaaaataatgaatttgaccattcataagcaaatttattgttttttgtttctatttgtgtaagtaaagtttgaatctgtatttttaaaaaaaatcatatattcatctgtcttttcatatatttttttccaaaaaattatgttttttaggtgacgtaaaaaaataacggcgcgttctcttgagggaaaataaaccacctcttaggtttgaaaatggtcaaatatatcttaaaaatcaatgacgtttcatattaaaaaaaaccggagattatcttaaaagtcatttatatatggtttcgataacttagtggtataaattttaccatgttccttaatcaagagttaatagtcgaggggtaaaacatgcttatgctgtgttattctcccttcttttcctacccaccttcatctttttttgcgcacacgcttttcaaactgctaaagtatgttttttacaaaagttttctatataaaaattgctttaaaaatcatattaatccattttccaagcttttttagactgataattaatatcgctctaatcgctttctttgtttgcctcccgaactcaacctactatggatctcttagcttttgcataagatgtcatgtaggatcatgtgataagatggaatagagaaagaaagagagagaaagagaggaagagacgaaaggacaatctctacacaaaactacaaacttataggaatccgagagaagagaccaataaattaagtgaaaacaaatagagaaaaattagtatagcatatcagagtaagtatattaaaagcaatatattatatatgttatctcttaattaataagtagatgacgtggataaaattagaattgatgaccaccatatactataagggtctgttcactttgatgccaaaaaaaaaccttaccaaattttgttattgtcaaaattttggcatagttaatgatttcttatatagttactaaaatttggcatcaaactaaatgtagcaatttttttttacaactttaccaaaatttagtaaggttaaaaacggcatcaaagtgaacaagccctaaaccttatactatcttctctatctaatgcattatttgaccatagaaaggtgagacttgagagcgccacagccggaagattatttgaccttttgaattcatctcgaacccacatccttaatccaacggctcacaaaagcacaattgacgtggcaccttcttcctgccgatgctctttcctcaccggcatgcaggccaacaattcgtgtcactgacacattgggccccatacctcaacgaaaacttcgggtctacgagtcaatggccaataaaagacgcaaggcccgcgaccctctcaccggtctctagtctctccacgcgcaaggaagaaggttcgcgaatccccttctcccttcggtttccccttcttaattcttctcgcctcgagcgaaaatcttatcattgtagttctttccatcgcagagggtgggctagggcgatccggggggcgcgaccatggcttacgtcgagagaggtaatccgatttcccctatccggtggatgctgtgagatctgcgtctataatctgttttgatctgtgatttgtgcctgtgaattcgttggcctacccggtttcgtcaaataatcaaatcttggtttttcgtgtggtcatatctcggtagtagatttagatatgtgggtaaaatatgcaggtgtgtgcagattctgacgctagagtaacgagtacagctgctatgttacagcaaatctaaataagtatccacataccacagctagcgatttctaatagtaatggcttaatattgaccaacctggaaagcagggataaatttgatggatggagttgatatatcaaaattaaaactaaaaatggctgctctagaatgccttgtttaacgtttcctggacccttttcactttcttgcctcttgaaacttccattcaccttccatagaatggagatgttttgagggctattgtttctcatttgtgagatatacctctcaattgttagatgccaagaaaaaaagtaaagagtattgaatagttaccgaccttttcgaggaaaaaactaactagttaccaggttttctacatgaccaatcgttcaccatcactgagagtcaaatgagattgtgcatgatatgttgagttaatgtatactgttgcgacttgagagtagataatcatttccatgtatcgatggtgcagtagcaattacatgaatgcatatggttgtgtatggtgtaatataacaaagtgcatactgcatagcaaggtagctttgctttcaatacacagttgatgtgctacctgtgtaactaggcattccaattatattgggacaggttttttcaaagatggaatgatttcatttcaattggtcctgatttatgttaacttcattcaagcacttctcaatcatttaggaactgtgcgctatttagtaccattctggatcatttaggaacatcattcatgcacttttagtacccttctagatcatttaggaacagcattcatgcaactttagtacccttctgtatcatttaggaacagcatccatgcgctttttagtactcttctggatcatttacgaacagggtatcataaatggtttttggacaaaagagaattttggctgttgggactattggaatattcacctacacaagatatattgagcacaatgcaactactattggtttgattctcttaacttggtagtgaggttttaccctgtagaaaatggggagctctttcttttatagttttaaggaatgaaaatatggaatcatgcaaccagatgttggctaaggataatactagcctgaataggcaacctatcaaagtggttttatatgttcaattagatcaaagtgcactagtgcaggccttttgcctaaaatcttgaagaattaagatagaaaaatatgcttggcaaaattttacaagttagtgttttgagatgtccaaagttgttgggaacttggttgtgtggtgggggcgtgggactggaacatgtattctcattatgggatctgtagcccttcaaactggattggttataaatccaccgtgagattattttgttcctcttgaactggagtaattaaatatcgtaatttactgtatatgtgtttggtgtaaaccatgtctttctatttcagtgcacacattcagtaaggatgtggggctatgcaagaacttaagggaaattagtagttggtttaccttttactattgtcttcaattatattcagtttatttagtgtgaattcaattttatacatcttatgtgtgttgctcacttctggacttaacttatgccctttaagaaatcattttacgcttcctttcatggaactagtaagaacaactctttgcttttcatggatgctgtgtagcatacattaactgatatgttgaatttgttcaatctcctgatgttggttcgtttatgattatgtgctgaccacattcttatttcccctagctggtaaatattttctatgaattgactggccattaaacaatgcaaactcatgttattgtttatgtatcttgcaggtgttg

SEQ ID NO: 61670 - DNA, 563 bp, Oryza sativa
ctattgagcgatttgagtagggtatccgaggaaacgttttgtgaaattttgtacgtaatcgatcgacaattcacataggaatatatgcatatcctctacaagtccacatcaaatcagtcatagtacatagtaagtctttaacacaaataggtactgcaactaccatagtaagagagttataagcaacattcacctcagatagagtttagatccttaccagaaacagtctcttcaaagcatcggtttttgtcatgatgtgatgtgaaaacatgaacatcatgaccatggaccgcaagctgacaagccgcatcgactatcaatctctcagcaccacctacacaaaaacatatgttttctttgaacaattgagatctagtacaatgctagaaatgctgccacacttagtccattggtcaatgtcctataacctgctgcaatactgctacaacattttttttctcgaaaatgttcttaaaaatctcacctgcatataataaacaagccgcaagtcctacattcaaatgaaaccgtgcaacggcttccccaaaaaataagccaattcg

SEQ ID NO: 61671 - DNA, 677 bp, Oryza sativa
gtcgcctctccatcatcacaagcgtccctaaccatgtacccctatgtgtactccgctgctaccatgaaactacagtacatgtactgtccgattttgttcctcatgtgggccccggctgtctgccctgcccagcattacaatttataaaatcttatttttgtaagcttagcattacaagtattctttgttaattacaggctctgtttgtgaccgtgatttcatattgcccacattttttttaggggaattgatattaggccacttgcagagcatcagggcacatcatggacgaaagcgaatctcgaggcggatcatggctcatcatcctcaggatcaccatcagctatcttctgttcttcccggcccatgcaaactctctgtgcaatttcacacgcaaacatgaaaaactacaagacgagaattaacacgaatccatgtgaagcagatttgttttttgagtctaaacgaacatgtagataccacatttgaagcacagcaaaatactagtagtagctctttgttcatagcaagtgatctaactttgcacctgatgaattttctcatgttcaagtacactacacgcttcttgtaattacgcgatgtttgatcgatcgaccaatctcgcaggaacacgcggagatgtggcatgtactgatcctaacactagtgtttgatct

SEQ ID NO: 61672 - DNA, 598 bp, Oryza sativa
taaggcaaagttgtggttgggttgaagcctttatagcctaagttcactattgaaaaggcctattttcttaggcatgccaaaatttggcttcaaaccaaatagacactaaacactattaaaattgccaaatattgataagcctaatttaggtctcaaaccaaaccagcccataatgtaaatccgtgtgttagggaatgaattgaacacgtagattagtaggagtacctaagggtgtgtttatttgggaaaaaagaaaatttttgggtgttacatcgaacgtttgaccggatgtcggaaggggttttcggacacgaatgaaaaaactaatttcagaactcgcctggaaaccgagagacgaatcttttgagactaattaagccgtcattagcacatgtgggttactgtaacacttatggctaatcacggactaattaggcaagattcgtctcgtgatttcctctataactgcgcaattaggttgtatttctatctatatagaatgctacatgtatgtgtctaaagatttgatgtgttgcttatggaaaaaaaaattttggggaactaaacgggccctacaagtggagtaaaaacaaacctg

SEQ ID NO: 61673 - DNA, 575 bp, Oryza sativa
gagaacacacgtctcgcatagtttcttcaacgaaaacgtcgaaattaatgggccagtattccttgctgctgctgatggcacagcttcagaacaaaaagaagaagaagaagaagaagaagaagaagaagaagaagaagaataagaagaaatggatctcatcgtctcgccgcctctgatggctccatcacggcacaagactttgctcgcccagaattaggtttccgatcacatctccagtcgagaccatccatgcatccatcatcatcaattcatcatacagcagcagcagcagcgaagtcttgcagaccatacatacgatatccatggccagagaaagcgatgtatcaagagctaagtagccctaattattcgatctcttggtagtactttttaccagcaattcagattcagccatcgttttgtatgtgataagtgtgcacgttacgagaggatcgatgtatctgaataattggaccagatataatctttgtccatttaatttggtttcagtcgtacatcgtctggtacgtgtgtgccacgtgtgcaggggagattgaaggcgacaaatggggaac

SEQ ID NO: 61674 - DNA, 63587 bp, Oryza sativa
gacggtattcacaatgctcccgggagaccaactaccatggccacgaggagcaaacgacctgtcaggccgccaatttgcgcgtacgtccggacgccagtggccccgccgctactacgagtcgtgtgaactgtgaggctgtgactgttccggtgggcccagcttgacccatgtgctactgttacgatgcacccgtttcttggcccacgttactaatacagatattgcaattggcccacgtaatacagtcacttgggctcggtccagtctagtactcgtaggaggccctggctgcagcgctaggcctaggcgacgccggctagaacggtccgctgctttgcccatctccgtgtgccgcgagaaggcggcggcctacggaaacggtgaaccttcacgtgccgcgcggcccagccattgcccgtgccggccgtgcgcgtgacggcccgagacgacagtacgccacggtgtcggtcgggcggccgcgcgcgcggccacgtacacggcgcagcgtggcgcggcagaggcgcacctcttcccgcgatgccgtggatattccccggcaccgaccctataacttggaaggcgtattcctttaaaaaaaaaaaaaattggaaggcgtggcgggcgacgctaccacaggtgtggaaaaaatctcttctacctaccggcacgcgcgaaacgagcagtttctatcagcacgtgatgcatcaaactcgttctatggcggcaagcatacacacagcgataaattccagatgtacacgcgcgtataatatactagcgcttgttaatatattttattataacgtcgtttgattttaaacatacatgaatgcaaaatctacaatagcaaatacatatttttgtaaataagatgaatgataaatatatttctaaaagtcaatgactccagacatattaaaaactgaaatgagtaccactgccatcgtacattcgtagtacaagataagagtggtatgaagtaaaaaaataattgtggtcaaaatattgtactatgcaatttgaatactgcatcaccgtagttttacaagaaatgtatcactggcacttcttggagtgggtcgacaacgacagtatagaaaatacagtgtctcgacgggcatcgtgtcgttttattcgcgggcgccgacttcatacacaaaggagaaaactaaagaggggatcccaaataatattcccaaaccctaaagccctcctccccttcccgtggcgattcgccggtccgtcccccaagtctagggtttatgttcgctttctccccacgcattcctcccacccgcggcgctccctgatctggtcaagcccaccagaatccgctctccagagttggtgggggcggagggggaagggaggggcggcggatgcagacggaggcgagagtggggatggccgccgcaacgatggacagcggcgccgccgccgcggccgctcggaggtactcgacgcagcagcagcagcagcagccgccgccgccgcagctgcaccaccaccagccgcagctcgggacggtgccccacctccttgccggcggcgtcgcgggcgccgtcagcaagacttgtaccgcgcctctcgcccgcctcactattctattccaggttcgtcttagctgctgaccgggtagtttaacttcttctgagcatgtgtagacaactatgaatccatgcgatatttgggtttgtataactaagaaaaggtgagacatttgtttctactatttagctgagctgcgaggactaatcctgcttcagataggtggaataagggggaatatttttggcattttgttttcccgagcaactattaagtattttgcacaacttaactgtgaagagaaaactcaacgcacaagatcttttgttgagaaatcttgatctggtttgatgtgtgaaacgaggcacaaactcatttctttttctttataagcaatgaaagcacatttcttacaatattttacttaaaatactgtggctgttaatccaatttatgtattctatgtgcaggtgcaaggaatgcattcagatgtggctaccatgcggaagactagcatatggcgtgaggcatcccgcattgtctacgaagaaggcttccgagcattctggaaaggaaatcttgtaactattgcacaccggttaccttactcctcaattagcttttacacatatgagaggtacaagaacgtaagtacagatttcttcagatgaacttgcatgctcattctctatcacaattattatatggctaatttcttaattaaatttggactgtgcagctgctacaaatgatacctggtcttgacaggaatggtggatttggtgcagatgttggtgttagattgataggtggtggtttgtctggaataacagcagcttcgatgacatatcccttggacttagtacggactcgtcttgctgctcaggtaagcctattgtcaccagtctgcatatcactggcttcctgtgttgattctcatccacttgaaaagccactatttgaaaaagtttccctgcaattagaccaaacaacatctatttccatgtgaaggacatagataactcaaaatcccctgttgattcccttctttatcagtttcacgttcagggtagaaggcatattgcatttatgctctctgctttgggcattattgaactgtaggcctttttccattgaagctttgcatttttaatatgtaatcttcactaataatgaagccttttcatcaaatgtttgcagacgaacactgcttactacaggggcatatctcatgctctttacgccatctgcagagacgagggtgtcaaggggctctacaagggccttggtgccactttgctggtaagaatgttcgacactgccattctctcccatctttttgagcattctacctttcgttatccaattgatatttatctaaaatacagggagtaggtcccagcatagcaataagcttctgtgtctatgagacattgcgatctcattggcaaatagagaggtaagttgcacaagatacaagtgggctctttattcatatccatgccacttctcgcatttgttctaactgtatttattacctttgatctttaaaccaggccatatgattcccctgttctgatcagtttggcttgtggaagtctttcaggaattgcatcctcaactagtaagtaatctgtaaacgaatgctgattactacttcctccgtttcacaatgtaagtcattctagcattttccacattcatattgatgttaatgaatctagatagatatatatgtctagattcattaacatcaatatgaatgtgggaaatgtaagaatgacttacattgtgaaatggagggagtacaaagtattctgtattactgaggtgtgacgagcttttctcaagaatgaaacgtacaatgtggaacggttgtgtgaatacacaaattatgtgcaaaatagaaagaccccactttgctagaatttgtttcccccacttctaaagaagttaccatgtaatccacaaactatttttatagttgaataacataggaactatttttttgcactgttccactagtttatgctctgattctgtctagacttttgttattggagcaaattggtcaataacacctcaaagatcaattatctgttgtattttttgtcactaagtgaaccttgctctgatcattatcatttattatatttcagttacatttccgttggatctagtaagacgccgcatgcagttggaaggcgcagctggaagggcccgtgtctaccaaactggactttttggaacatttgggcatatcgttcgcacagaaagtttaagaggattgtatagaggaattttgcccgagtactgcaaagtggtcccaagtgttggcattgtttttatgacgtatgagacgctgaagtccatcctcacggaactggcatcagatgattagctgtccaacatttgtcacgcttgacaattttgatgtttgggccagaataacacttgaggctgattagagcgagaaaaatgactttgtagcatatgttaggatctagatggtactaggtttttaagtttataatatcatggaatggaaggatattcatatggttacagattttcttgtagtgcatggtaaaagaagagccgctgccataggtcttcaaatttctgtccaccagttttagtgtatgttaacagtttcagttttgtaatggtacatgaggccattgtcttcagctctacaatactattgaaagatggcctccaagatgatctgtttatccatgttgtcctagtgagcttattacaattcacaagtgagttcggctacattattgtgaatggccttgtcattcaaatttcctggtagtgagcaaggaacgttgtatccctctttattggacgatagtttgttaatgcggcctcttcttggatgcaagtacaagttaaaagttaattttagatccacattgtaattgttcaacttcttgctcgcacgatggacaaaactgtctatgggaaatattggacatgtctccactgcttatggactgagaaacgcgtggccttttccggcaaatgaaccaatctcaaatgcttagttaactcaggtgaagagaggtgctgctaaacttcgttgagaagacatataatgaagtgtagtgtcatatgcggcagagccattatgtcgtcatcaatggctcaatgctagtgcataatgtgagaacagagttcaaatgctcagtgacatcaatgctagcagtacataatgtgagaacggagtagctaatccacagctgatggcttcctcagaatgcatgtcatctggttccgctgcttctttgcacctttgcacgagtattggctgcgattcgcaaaggcgttgatctgtggtaggggattgttaacaggtcactgaagactgttcagcatacttcagattcgaggggccattgtttacttgaaaggtgtctccctcccttcttaaatacttatcactgtttcaacttcgacattagtaatttctaaatgactagactacgatgaacgaaagctaaatgcttatatttaggatgaacacaattaagtacttatacatttttgcaaaaagcgacaaatgattgaagtttaatcatgaatagtgtcccgtgacaagtatttgagaacgaacagattgcttaggaaaatatttctcctcttctcgctgaattttcatttgaaagatactcttgcttgtatgcagtcatgcatagggctgtaagtgggtcagctgcgaacccacttataggtcaaaataagcgggtttgtggtttattttagcctataagtgggtttcgcgggttagccacttacacccctagtcatgcagatcaacagtaaataattagtacattatacacatagacgtatataaatacttcactgcattatcatgggccatactgtgcattacattagtgtttcttagtcaccttattagattgcaacctcagctcctgttaattcgagcaaatgcagttccttaactgatttactctgataggacctctctgaaaactcaaggtcacccaaatccgaaatcttactccattaccataacccatatgatctccatatgtatgtgtgtatgatatctgtatacccgcatccagtatggacatagactgatagacagtgctttcttgtgttacacaggaaagcctccggttagccgtatatggttcagtgattggcgaaggccatacttgttcacagctgcataggcagctctgaaaccatcgccgtatgctgatgatgtgtcattggcgatctgatgcaggaagaattctccaagcttcttctcggtgtgagagatcccacccttcttggacggtggtggtcgacaggaggacgacgaagatgaagcgtaagatgttgaagcctgtccatatcttgaagtggatggaaggatctctgactccagccacaggtaagacatgacctggcatataccttcctcaatctccgcctttaggttccggtaacctgtaggtgccattgtcagacaggatacaaagaaattaattaatgttcagataggatttcagaaaatgggagaaatggatgttcagatgattacctttgaggcgcaaccacccatgcatcaattcatgggcaagaatggagcccgttagcagcctgcaattgtatggaatgtttatgacttcacacaaatgatacacgaattgtagcatttgatttacatgaaaatggaaatacttgtgaagaatgcactgacctggggaggccaaacaatacaagaattgcagtgacttcgcatctcctagttagcttttgcggttgggttttcatatctagtaaccgatttgcaccaattctgggcctcctaagtatctgtagaaaatcagaacacaaaggaacaaagtcaatgatttcatttggccaacctgctactcagtggaactgtggatgtaagatctgaaagcaactactctgtctagtttattgcaactacatcattgaacagggaatctcattagatgatcagtatttatcagagaatctcatcgtttgatcagaacgatgttgatttcatattaccacttggtcttccttgatttgttagttattcattagagaaattgtaccatcctaaaaactgtttaggttgacatgcgttgtacttacactggtcacagtctgctcctctgacagacaaaggcctcgtgtttcaggcatatgatgcggtccctgcagaaatacaagatgcaatgatcaataacacatactccgtccagtcataggtatttgacgtttaggacaagatttgaacaaacttcaaagtttgattaaatcttatcctaaacatcaaatatttatgaccagacggagtaatgcattatgcattacagaacaaacagatgtaaagaacccactttgctttctccttccatagcttcattaagggcttgacgttcaaccaagagcatgggtatctgctggtctagtttcatgttcatcccttcgtagtagtctctgatggaatggtatagcggttgacattcaccggtgtccatgattgcagaatccaggcattccatgcacaagctgcgtccatcccctaatgacatatactttgtgttccttggctgcagggattcacaaaatgtcttaagtacgaactcatattttaaactgacaaatcagtacaattgcaatttatagaaattttgccgagaaaatagagaaactaataatatttttaatgtgtatttgtaagcatgaaatacattcatcatatgcaagaaaggcagtacaaacctccattttctcacagctacagcaacgaggtgttctatcatgctcatgcaaaggacaatacttctgtccccagaatggatgggctctgtactctatcaaaccagtcctgttcgttgggatctgcaataaaaaccaaacacgtaaaaagggtttcctgcaaatgctgttccaacggcatgctaatccaaaaatcagttctagcacttctgcaaatagttcatccacaaaaaaaaaaatcttacaaattgaaggcagacgtcacactttgggtgatgaagctccttgtagcacagcttgtggtatggatctgtacctagcaaggtgaactgggaaacagaataaagtaaactgtcacttcctgagaacacctgaacacacacaccttcagacattctaaactgaattgcagaaaggttacctccatctcacggatagggtggcgacaggaagaacagcggaagcactgagggtgccagtacattcccaagcagctcaagtaatggccatgccctatctcatgcttgcaacccccacagaccctgaaagatatatattgcttctttacataccagctgtttctgtgaattgtagacaggttagtgaaagcagatttgctaacctgtatcctctcgacctggcctgggtctgagagggtgcacaaggattgtaaggctggtaaggattcatgttcagactgtcctgtattgctctagcgagttcttcatcgttttctcccttgtcatggtttctctctacccaaaaaaagttgcatcaatggtgcttagtgaagagataggttaaaaatatatgatcataatatcacagaattcacaaatatggcaccttttgtatttttggcatcgtctgcaagagcaagggcaagtgcatggtccatttcttcattgttatgtctaggtggttcttccttctagaaacataacaaagaaaggttcagaaactcttttccccatgatagtgctacatcattaccataatctaactgataaaggaaggggaatttggatagtggcactccatgaaccaaagaaaagaacagaaaaatgtcaggttgcggaggaattgagaaacattacctttggtctaactggttcttcccagagcgtggtctcttctcctgccgtcacccgagggcgccgtcggttggcctcgccgtccttcgtccccttcaggaaagcgcagagccacttcatgaagccggatctcctctctgcgttgcagaaatgttagaaccggacaggttcagggcttcaggcactatgcaaagaaggatctcagacatggctagaactgaaatgtggagagcaacatcccacctaacacttcctgcccgctgaaagcaggcaaagaaaaattgatgtatttaaacactttggttgtcttatatgctcggttggatgctaattgtaagtggattaggtgatgggttatcaacaacataatttcgctagccctttgctttgatcagatagtcacagttgcacagttaaaaaaaaatcagtcatcatgtcatgtacagctaaactaaatttttaagtttttgtttgtatgaggctgttaattggactgtcatagaaaaagaaaggcagatgcgtgtacctgcattgaacaagatcaagaaacacagggacaaaacgccacacgaaattgcttgcgttgctaacatggcccctctctacaccgtgctaatcacagcgttatcttcttttcctttttcaattctacctccgattgacggggcacgcaggcgcagtcagggtcagtcaaatcttggtggccctcaaatttatcctggattataagaatcagtttgagtctcccatttatgctatgtttggataataggaaataaaggatgggattgggattagaaaatgaatcaatggctaggatgaaataaggtggaggaaatgaatggctaggattcaaagttaccccttcataagtgggaaattatttccctttcctattatctaaacggtgccttaatttccctcctctgaatagcacagtggtatgatttatgcatgacagttagaaatgttcatctgatgtgattgcacggcgatcgatgttaggatcaaacagctaaaggtcgattcgaagctagaccaataatatggacctgtaccatcaccatttgcgccacgctcacgccatgaatgtttagatggggctaaaattttctagtccatgtcacattgaatgtttagatgctaatttaaagtattaaacatagactaataaaaaactaatttcataaatgagagctaatctgcgagacaaattttttaagcctaattaatccataattatgaaaagtttactgtagcatcacattgtcaaatcatagcgtaattagactcaaaagattcgtctcgcgaattagtccaagattatggaatgggttttgtaattagtgtatgtttaatactctaaattaatgtccaaacatccgatgtgacagaagtccctgtttcacaaacaagcccttagaataggacagcctaatggcaacaagaacgttctttcagagagagtggacatgatgtggcgagtctaacggataacagtctcatgtgtaaagaaacgcctaaaaaatcggctattttgccatggatgttgacgcatcgatcgattggtatgctaaattttttctctgaaagggatcaactgggatccatttttgtgttccccggagtatcatctttaggaaagctaaaagttcattttgctttacttgctgaaatcaacctcgttttagtctatctgacgttaattgcactgccgacagtagtttagcctgccttgtttgaagttcaatcaagacagcacatatatttcaagcaggcaacaaataaaaagttaaaatcttagtcaggcaagagacaacgaccagctactggtgccatgaaaacaatagctctctgctgctgaaaaagtacgtgaaatctaatctacccatagtgcacaagcaaaccaaccatgtgtccaacatgaacaagaacgtcaaaaagtacgaggaggacgacgatggcaacggctgaacattaggatcagagaaattaccgtgactgcactgatcacaagaccgtgaggagtaggccatgtacccaagaaccgctgccgcaacgtccccaatacagcatatatatatgcacacacggagacagaagcgggagagagatggcagcagaacacttcaatcagagcgagagacagagacagagctctgcaaggtcaagtatggcgatcgcgatttctacgatgagcagaggatcaggaggaagaagaaggaggcagtagctgcgatggacggaggaggaggagggggaggggaggggagggggttcttagagaataaagcggcgtggtggcgaggagttggccgcgacagaaaggaaaggattgagggtgaagcgaagcgcggggcggccgcccgcccacaacgcacggcatctcatctcatctcgcctctcctcgccttcgcctcctccgcgttccgtgcaaaaagcaaacgatctctcaccgggttaactcgatcgcaattagcgtcttctttagcgaagaaagaaagaaaaatcgaaattcggtagtcgccgtgccgccagttgatggcgcattagtggcggatgcacggggggaatattttcggttctgtgttaacggcgggaggggaaaagaaagagattcgttgtgtcaacgcgaatgtatgcccctccatttgcatgcttttttttttttgtttttggtttttttggattggttttctttttgtgctcgctgagagacggtgatgctacgcggaaacgggaggagagcagagcggcggcgggggtggcgctgcgctgggcctgcgactagcaatgcgggaggagtacgtttgctctgaaaatttttttcccttcctttctcggatagggaaaagaaaagggaaaaaaagggtgcgaccctgaaagctggccgctgccgctgtcgatcgccattcgccagcacgcacgcgagtcggcgagtgtacagcccattatttccgttgttcgggggagcccgccccggtgttttgccccatggaccgtggactcatggtgagctcgcgtgacgcggcggtgggtagcctagcaaagcaacaaaggccaaagtttaggccctttattcaaaggaaaaaccatagaaattctagaggattttatcctatgagaaataattctatagagtcctttgaaagaaaggattgtttcctatcaattcctttgaaattcctatggaatgaaccttactagagcaattttggagaaaaataagcatgaggtctcacctcatgttttcctcttcatgtgtctaaggttcctacgtttttcctgtgtgctaatcaaacgacagtttgaagactttcctgtgtttcaaaatcccataggaatccaataagtatggcattcaattcctaagtttttcctattcctctgttttctgaatcctgcgattcaaagggacccttacttgcaacttggtagcctaagggaatgtagcgctctcgtgcactgatattcacatatgttatttgtggacgctggtttcgtatcgcctttgcaggaagaaaataagttaggacctcggtccttccacctaatggaaaagactttgttttctaattgatatgtgtgtccacacgaatcttggagcactcatcgcttacctcagctcaagtcctcaacttcgcccctctcctctcctctccacttcccgcctcccttccttgtcagaggcccaattgttgggactttggagtattacgtttcacgcgcaagaggtatcgagctcgttcacccaacttttacctctctctcctctccacttgaaccacttccactacttcccttcctctctttttctttcaggtgggaagtctaatctttgattagagcttgatgcgcagcaatgatgtcggcggtggtagagagctcttccattcgtcggggcatgagttgtcaaccttaatagcttccctagcaaggagcgcatgtaccaacatgggtgccggttgggcgtcgtggcatgctgcttctacaccacgtgtcttcccacacagcaataagaaggagaaggcggcaagggagcttctggtcaaaagagaactgaggaatggaggtggggagatgaggggaaaagttaagcacttgagttggaggtagaaggtcaatgctccaagattcgtgtagacacgtggcaattaggaagcgtggtcttttcatcggagcggagcaccgaggtcctgcccattttttttccacctttgtaggagtaggaattactgtactagtaatagttttatcatgcaccagaaatgcaatatatcaatgggaccataagaattattctagactgtttagaggactgatattatttttctttcatgatataaccactttactgtagattttgtagaattccaatgtacatccagattttgtaaaactccaatgtacatcccgttatttgagaattttgtcttagttatcccacgacaattcgcatttctgcaccaaacctctacaatcctcttcacctatctccatcctacttcatttatgtatcttctccttcctcatatgagtcaagctcgctccctatctcatattcggtagtttaagggtgtgttcttaccctaggttttccaactcatctccatcgttttctgcgcgcacgcttttcaaactgctaaacggtgcgttttttttgcaaaaagtttctatacaaaagttgttttaaaaaatcatactgatccatttttttaaaaaaatagctaatacttaattaatcacgcgctaatggaccgttccattttccgtgcgcatgttccggttgggaacacgctggagcgaacacagcctaatattggtatataattaaggaaatttcggctcgtacaaattggtttgtgcgttagcacgctcttgatcagaaattgcctttaattggcatgattacaaaagtgcaagcatctgacctgaatatacgatgcttgaactgccgatgatgcgactgggaaattagggtggtacaagagcgtgcagagaaatagcgagccattttggatagggagtacccaaaaaaaaaaaggaaattgatggagacgcttccatgcatggctacaattcaggtttcaaccatgttggcatttacacttcagtcaatgctcccccccccccaaccatgcttctcacttacaaaatggtaacattgatgcatctatcgtctaaaagaaaaatagtccaaaatcgatcgacacaatgaaataaacaaattcgatctacacattgctctgttatctgtgatgttgaaatcctgtttttaactagtattctcagttagtttagttcgctgcagatacatttgtatttttgttagctgtgtgcaggaattgaaatggaacctcctccatctatgactgccttcctctgtttgagtgtattctatggcactaaaagaacttcaagaaaacagcatttccctgtctttgaaaagaaaagtccacgtcatggttaccctatgatggtcttaaccaatggactaacttacatggcaagtcacatgctgtatcatggaagcatccacctaactgaattcatagtgtatagaatgcacagagagttacgtagggaatgggcaaggggagccagcaaggggtgtttaagatggggttaaaactttttagcccatgtcacatcggatgtttggacgctaatttagagtattaaacatggactaataaaaaaactaatttcataatgagagctaatccgcgagacaagttttttaagcctaattaatccataattatcaaaagtttactgtagcatcacattgtcaaaatcatggcgtaattagactcaaaagattcgtctcgcgaattagtccaaacttatggaatgggttttgtaattagtgtatgtttaatactccaaattagtgtccaaacatccgatgtgacaaggacttagaataagtccctggaaaccaaacagcctctgaactactagaatataatagctggaccactagataggccgtttgttaactgttatacataggccgtgtttaatagttcatatgccaattttttttacgtatacagacacacatttaaagtattaaatgtagactaataataaaataaattacagattccgcctgtaaactgtgagacaaatttattaagcctaattaatccatcattagcaaatatttactgtagcatcacattatcaaatcatagcgtaattaggctcaaaagattcatctcgtaatttacatgcaatctgtgcaattaatttttttttcgtccacatttaatgctctatgtatgtgtccaaacatttgatgtgacataaattttggaagtttgaaggaaactaagtgtgtgttttagttcatgctaaaattggaagtttggttgaaattggaacgatgtgacggaaaagttggaagtttatgtgtgtagaaaagttttgatgtgatagaaaagttggaagtttgaaaaaaaactttggaacttgttaaagttagtcgatatagtggaacaacaactaaccttcccgatcgcttcagtcattgatcacctaagacatgtgttgatacgaaaaacacacactggcctgggagatctgcttagcttcagtgcaggttgctgagatgcgggcgtgccagttagtttgatcctgcaactgacaagatattcaaataatagatcaatgagccgatcggctgacaagccgatggagcaatctcagccgatgccgataccagccgatagcgatagggttttgatcaatcggctatatgtccaacgtagataatgatataaaggcaatcaactgatgataatataatatatcaatataatccagtagaaaccaatcagctaacaatatgatgtaaataatgatataaaggcgatcggctgatgatgataaataacaataatatagcaatataatccagtggaaaccaatcggctaataatgatatgatagataaacatcaatccaaaggttaaagcatacatcggctgtaggtccattgtcataaaatctacaagattagattaaatagtgaaacctttgttccgatcagctaaatccaacttatatgtatatgcaatccttacaagccgatgcaacgtacagataacttatcggctagcaccccgataaaatattagcatgaacctatcggcttaataagacttatattatcaacaacaatatagtaggtcgaacctaaccgatgcagcacgagattgtatatgataatctaatactcggtgagccgatagatctatctaatgtgatggatataacaaatctatttagaacagcactgtgatcgtagagatatatcggctaagacagaagatcgaacctaactaagacaatcccaactaaaccgatgtgtctctaaacataatacaattagagatagaattgagatatcaggtaggcggatatatcaaccaaaccagagcgatccaagagatcgaagcgatgcagccttgaacaacaccaatatagccgacagattcaccagggccgacgaaacgtaggacttaccccttcgccagagatcgaaaaccgatgcagccccgcgtcaggtgccaagttccgtcggatgataagtaaaaacctcgggaaagagggtggcaatgcgccaagagtagttgtattgatctgtgtgataaattacatagaccccaggtgtacatatttatacccatgggttgatacaagtccttgtcggacaagaaagaaactttcctaaagataaaaggaaaacataaagtccttatcggacactaaacacactttcctaaagataaaaggaaactaacaaactattcctaattaatagataaactgccatgctgcatctttcttgaactcggactcttctggataaattccccttagttgatccgactccatcgagaacacggttgttggagatttgacgactcccattggatgattccataactctgaagccaatactgactctaagctgatgatgactttgggcttaccaaatttcatcgttaacaacatgccagatgacgacataggaacacacgatatttgttaacgaggttcagccgaagcatacatccccggggctctgattatgggcgctcctccccaaccaatatagctcctagccgctacgagtctatggcctcgtcgccatcctctccctgcgtgtctacgatatattgtagttgccatagttacattgtggtgcccccctctctattttagagagatgacgggttacagagttcgactctaactccaccctctaacacctattacagctccaagtccaattgtaaccaaatagaactagtatattcgacacctattctaacagaactaaacacggcaaaaattttcctacacacataaattttcaacttttttcttcaaacttccaattttagtcaaacttccaattttgacgtggaactaaacacaaccttggtacaaatcatcatgcaggggcatgaaaacttccatttttttcttgggagtgtcagtcacttttctcatcccttggatgacaatccaatggctcttatcattcccactattaattattcaaaagaaaatcctttattttcacaaataaaagattaaacaaaaaattgcactgacctaacatggaataaattatcaagttataaataaatacatgtaaaagtatccaacttggataaacataaatctacaacgacaaaatcagggctagaatgaacaaaacttgcagaatgcatagcactaaattaaatttagtgtaggcttagcaatatgtatgtcgagggatgatcctctctagcgggaggtcgtgagacccccctttcatgagttcggccgggggaagaagctcacctctagaaaccacgtgtccgtccctaaggctactagctagctcgcacacaatcaaattatacaggtttgggccgctgagaggcgtaataccctactcctgtgtttgggatttagattgagagttacaagggttcctaaactcaggagaacactcttctcctagagctcaagttctttgagggtcgtccccctctctcggtgggcaaggtcctccttttacacctcaaggggataccacatgcaccgcctctacctactcttctttcgggtggggacccaccctatcttgactggaactcgacccgtgccttcgcctggaagctaagccacagcttgtccttgagtggggcccaacgccgtccctcgcctgacacgggggacaaccctgtcattcccttattaataggtgaagacttgtggtggctgccgtccgaatgaccctccgatgggacgggtcatacgtacctccactccgccggaagcagacgcgacgtgggagcacggttgtcgatccagtcagacgtgaccggcgtcaggccggtcacagaccggtcattcttgactatggcgcgtcagcttagcacgccgcacgtctgcctcactgtattaaatgcgacagggggcagttggggcgttgcgctcattaaaggaggctcagcctgggccccctcctcgctcgctccccccgccaaatggcggctgggcgagggcctcggggcaaagcggtgcaagggcccgaggggcatgacgtggcaccccgaggcctcgaccccccggccgctcctgcggttcgcggactgcgggggcaggactaggctgtagggacacatagcaggatagaaaggtagattccccacacttcgcatacccccggacccatatatctgacaatgtagttttagccaactgaaaaactatgaccctgttcttttcttcgactaaagttgaataaaattatataaatttccatgcccctgaaatgcagcggaaacccttctttcttctacatatccacatgcattttcccttgtcagtgagaataacacctcaaatcagagctgggcaccttcaaagtgcgagaactctggttggctgctattgcaaaaaaaagagatctggatggccgataagctgcaaattagacaatggctcaacaatcacttctgtcaattctactattggaacttgaaaagtatgcaacaccgctgtaaagactgtaatgtcgtgcggcaaatgtgggaatgaactttacaaggagtaagacatgacatcgcaaacacgcatggcaaagatgatacattggtgaattggtggattaggcgaacatcacaaggagaaaagcataaaacgtagatcatgaaattaattcatatgctagtgatttgagggatatgatgtgagcggaacaaaagagtaccacgcctattgagcaagaccatcgacgaaatcagggtgtatagcatgtgtgtctataaagatgtcacaagaatatccattagataaaaactgctcgacgtgtatttttctctctttgttcctgtgttgttgggtccatccttctttcaacaacgctaatttctgaacggataaatgcatttttcgttgttttctacggtaaaaccacaggcgggtataggatttgtgcaaagaaaagatcagaggtggatcatgacataataaggaggtgctagtatacctgcatattacgtggtggccgttggcgcttccgccaaattggagaccgaggaccccacaccgcgccaccacctcaaaaagagaatttcttttcgagaagtaaaacgaaataataaaataaagaaaaggaaaggaaaatacacgtagtacaaacgagccagcggcgagggcgaggcgagtttatctagccagcggcggcccaccgcccaatctctctctctctctcctcctcggccgcgtaaaacacctcccaccgcctcctccaccccctcctcctccccccgcagagccgaaaccctaactccgccgatctctccaggtgcccaaggggagggaggggatggcggcggcaccgggggcgggagggcagggcggcggcgggatggacgccgtcctcctcgacgatatcatccgccgcctgctcgaggtgcggacggcgcgcccggggaagcaggtgcagctctccgagtcggagatccgccagctctgcactgtatcccgagaaatcttcctcagccagcccaatctcctcgagctcgaggcgcccatcaagatctgcggtacgtgctcgccccccccccccccccccccaaaccctctcccgccgtcgtgtagatctgctttggccgcgcggccgaaagctggtgtattgtgggggagactgcttctctgtgtcgcggccttgaacaaggctagcatcaatctgtctctcttggaaagtatggtcaagggcgttatctattttttttgcaacttttttctcgattgtagttctcgtgaggtagatttttattgaacaggttgtttcgtgaacattttcaaaacgagcacattcacaagggctgagtgagatttcctttaattctgactgtgttatttcaaattttattagttcgcttgatattttaattttcggtattgttcgtgtgcacagcagcttctattgtctagcgccatctgattctactagataattaaacctatctgtcctgacaactgttcgtccatagatgatttgtaacaacatctagttaggcacggcagagtgtagatagggtcatgttgaattgttttctcctgatgacactgattaatgatgaaacgtcaaccactttgtacatgccaatttgaaaatgacttcaagtttgttgacttgattttctgtggtcagtgagttaatagtaaatgtgggcagctgtaaccacttccaggtttgcagccgtattgaaattcccaaccatgaattcgtaattctgcagtagtttccttagcaatacgatctactgagcatttgctcattgagaacaccagttggtagactatttatttgctactttcatgtattgttagtatttttatcctctgctgttgaattgctggcattgcatcatattcggtgaaacattgtaatcatgaaaatgagattatctatattagcggtagcactaatcatcccgtaagctagtgcctccttttccgttcccagcaaccatcctgtttttttttctgttcctgtccctccacttcggcatcccctctcccgtgatcccgtcttttatctgaataaaaagttactatcctggtatcccctgccgccctcctgctttttaagtccgtccacttctgcatctctctctggtccgagtaaaataattacaactttgagatttattcttttttttataaaaaatactgtatgtcatctgagtaaaaaaatacttctataagttcaattaaaaaacccactccctattaaggtggatcagtggtaaaagaaattatacacattcgtcttgtctttgcgtttaggttcattagtgatgttgtgattagtaacatatttactccgatcttccggacaacaaaaaaaagacgagtaaatcttacaccgacggctaacctcaccatagtagtgtccttggctgcagatctcccaggaggggccagtttcctccctgctcctcccgctgacggagatggaggagcttggcgaggtcggtgaagtagggaagcacgagaggagcagatagcacggattgcgttgattgcgcagatctgtcgccgatggcctcgtccttgacccaacctccaccttgggctttgcttgcgttggaacctctgcctcgcttccaatctgtagcacactgccacagtcgccatcgatttgcagttgatctccgccgtggaggcaccgcttgccaaggggtggggatatggttatggtgcgctagtaaactcactatgtcccaaaatatagcaagttttagctatgaatctggacaaccacttgtccaaattcatagctaagagttgttatattttgggatggaggtagtagcggaatggaacggataagtgggagagcatggtgtggcatagtgtgtgacgagggtattggaggcacgctacatgagctaaatagggtgctaatgctctgtgcaataattctcctaaattagagtgaatttcataaactgcaattaatttatcaaaaccattgctttgctacaactttagatgggtatttcacacaatagcaaacgatttatcacaaaaccgcacctttagcccccctttgtgtgtatgacaggtgcgactaaaacttgccaggcaaataaaattgcagttttctgataaaatcgtacgctattgttgcaattctctgaagtgtctagataaagttgcagtaaattgataattttgacaaaatagttgcagttatctgaaatttactcttttatattatctactacagcacctgtttgtgttgtattcatctaaaaaaagggttgtgtttattggagtccaaaataatgttgagctcatttctacttagcgccttcttggggagtttcaatctgtagtgagcctgtaaatttgtagctggtggctctaaggtgtgtatttaacttttttttcacttgtcatttggtatccaggtgacatccatggtcagtacagtgaccttctaaggctttttgagtatggtggttttcccccagaagccaattatctattcttaggtgattatgttgatcgaggcaaacaaagtttggaaacaatatgcctcctccttgcatacaaaatcaagtacccggagaatttttttcttctcagaggcaatcatgagtgtgcatcaataaacaggatatatggattttatgatgaatgcaaacgccgatttaatgtgcgtctatggaaggtcttcactgattgttttaactgtctccctgtggctgcgctaattgatgataaaatattatgcatgcatggtggcctctctcctgatctgacacatttagatgagataaagagcttgccccgtcctactgatgtaccggatacaggtctgctatgcgacctactttggtcagatccaggaaaagacgttcaaggttggggcatgaatgataggggggtctcatacacttttggtgctgacaaagtttcagaattcctggaaaaacatgaccttgatcttatttgccgggcacatcaggtacaattttaatgcaacatcttttcctttcagtattttttttggtcaactgaggtgatcatatttatatttcatgtgatgtcaggttgttgaggatggatatgagttctttgccgacagacaacttgtcaccatattctcagctccaaactattgtggtgaatttgataatgcaggtgcaatgatgagtgttgatgaaactttgatgtgttcttttcaaattcttaaacctgctgagagaaaaggcaaatttatggcatcaaacaaaatgtgaaatggtgaagcccatttcgctcatagcgactctgaggtcagttgcattaccttgttccataagtttgccatatagtttgtgtggcttgaaaatgtaacatgtttactgtgtgctgcatttaactattcacttgaaaagttttaaaatgtatggtgtatttgctctatgtttgatgtagtaatgtgtatcataacttacaactaaattttattttataagtatgttaagttgttcttagtttttcttatagtttgttgtatgtgttggccttgatatttctctccggagtaaaattggctctaccttataggccatacctgtatcagaattttatcccagtagcatatggtacacaaaaaaaaagctacctgtccatggagagtaaaagaattgattaggtgctttgttctccattgctgatgttatgcaggtaggaatacaaaatagatccctagtcgcctccgcgcaaatctattttgtatgtattacactagttgagtagtcattatcttttgagtagtcgttagtactcccttcagtcgcaaaaacatataatgtattattcatgattatactttgttttggaaaattgctagcagaaaattacttgttctacactaagcaatataatagtattgctagtgtttttccaccaataacattttccagaataaaatccttcaattgtattgtgcacaatcttgtggagtactccctctgtcccataaaaaaccaacctagtaccggatgtgacacatcctattactacgaatctggacatatgtcgtactagaatatgtcacatccggtcctagattcattttttatgggatggagggagtaagcagaaagactatgctggtcgccttgttgacaatcgccataccaggtcaagttcatagtgcctactttgagttacaaattgtaaccttggaatttcattaggttattggtttggttcaccagcaggtgttatgcactcagtgaatatgaatagaataatttaggagcccttcagacgatacagttgttaatttatggttttttattaaaaaaacactattttttgtccttttgatataattattgattgaaataatcttatctgggcctgtaactgtgagttgtgacatcatagttggaaacataatttggcaatataatgtgtggagagaaacaactgcaaatcgggcccaccaccaattttgggagaatatttcacatatacaaccataactcatttgcaagagcctagctcatcatgtaagtaggctggtgcagtcgtacggcaaatgttctgcttgtgttaggcagataatcaaccatcacaaatgttctgctcgtgttagtcagatatgatactgcaaacatcattttatggtttcagctggttggcgcttaattatgatcatgtctactgtaggctgtcctgtggatgcatctagacatcaacgtgcaggcgttaggcttgaagcaacattgggctaattctaccggagaagccaaataatatcatatctaacagttggtctggaaggttactcttcatggcaagtgccaattttttttccattttctgttatgatgcgtgaaactatcttgtagatgtagatatattgattatggaaggatgaagttgccaattgacctgaggcggtttccttctgcagccaggaaaaatctgaatatggagtttctgtttggtagtttcactatttaaaagcacatgtatcacttgtatggaggtaacaactttacttatgcaagcccgtgttttctgttgcttgtaagcaaaattggatgagtttttatcttgttttctatagcgtgctaatattgccaatggcaacaatttgcgaactgcaattctagaatgtactggatgattgaacctttaagcatttgcgaactgcaattctagagtctagaagtcctctggaaaggctaatgaatggtttatcctgtaaactggaccagcttgacaggtgctgcgtgatctacattgtatacttattttgtcatggtgtttccttccatgtgtcccactcaatgtttaggctgcgttcttttcaggctagtcggcctcgttttccgttagcacgcttttcaaactactaaacggtgcatttttctgtaaaaagtttctatacgaaagttacttaaaaaaatcatattagtccattttttttaaaaagaatagcagatacttaattaatcatgtgctaatggatcgctccgttttccgtaatcactgttgagaagaagaaagaacgcagccttaaacagcaaacgtgggtgagccttgcatctgtcgtgggaggctgggtggtgatttctttgccagactccagattcttatgccagctataccatgatgcacgtgtcttcacctgtcaaattctgcccgtatggagtgtcactttacctaaaatgagaataaataaaagccactagtacgttgtatactactccttctgtccaaaaagaaaaaaaagacaatccctccgtccaaaaagaaaaaaaagacaacttttaggtttatgtgtccagcgtgtttccgtgttcagcgtttgatcgtccgtcttatttaaaaaaaattaaaaagacaagtcacgtataaagtattaattatgttctatcatttaacaacaataaaacactaattataaaaaaatttcatataagacgaacagttaaacgttagacacagaaacccagggtttttcttttttttggacggagagagtactctccaacaacccagggtttttcttttttttagacggagagagtactctccaacggagattttagggagatagtacaatccaactaatcctttatatttttgggatggtgggagtaataaactgagttgtagctgctcaccatccatacctgcatagtatcatcttcgtacctaggattacctccatcccaaaataacaaaggacaatgagtttatgtacgtgaatgtggacataatgagtttatttatttcgaaacggaaggagtattaaatcatcgaaagtgctacacataggccttgtaacctatgatccgatacatatgaatatcaaatctggtaccaataggtatcagaattggaagatttggtaccctatgaatatctatctatgggcttgttcggctgccctataccacggctgtacagcagcggcagctgccaccatatatcttcgggcctgttcactttgatgctattttcaaacataaaattttttttggtaaaattgctaaaattttggctacttttagtttgttgtcaaatttggtaaatacataagaagtcctgccaaaattttggcaatattgtcatcttgtcaaaattttagtattgctaagatttattttggctacaacctaaacatgctcttcattgtattatactgtggctggctgtccactagcagtaccgaacagaccctgtatttctaacgtcggtagttctgccggcttgtgattggtggatgtggcaagcaatagtttgttgacacgtgttgcttctcctctctcccaatttgtgtgaattgtatgacaagccggttcaaaaaaaaagaaaaataaataaattctagagactattgagtgtcaacataacatccagatccttcatatcctttcaatctggtttgatccaacaaccaattcaatgaaaaatctagaagcgaactaaaggggcaaaatccaccaggaaccaaaaaaaaaaaagtatctaccacctctcagacagaaaagagtccacctgaaaccagagccctatggtaacctcgagctgccgacacgagcgatctggtttgaggtggcttgttttatcgttaaatgaattttaagtctgatttatattttagcatatttaccctatttttttataaattgaatggtcaaacatcatgttaaaagtcaatggtgtcccttcatccaaaaaaaaaaaaacttaggtaagtatggtaaacaatctaatgacaacgaatctgacagccacctatccggatttgttgtcttaggaatttaaaatgcattaaaagaggtcagtttaaatgttttttctttaaaaatacaatctactacatgttaaattcaaaactaaaaccccacaagaggttcttccaaatgtatggtctttgtagaaatttaatttgaattgaatcaattctcaaataaaatgttttagaatggactgcaaagatgacgacgccaacaagcacgtcagatttgttaccctatgaatatcatcaatttgttgtaggttttgtacttaacaggcgccaatacctatatgtaccaatctagtaccaacaggcataagacttaatacctaggagtactacttatatcataccatcgtaccgttccagaacagaaaaccgtggtataacagcccccttaatagttttaatttcaacacaagcaaatctgattccaaagtccggtggcgggtgtactcgttcatttgttactgcccccatttccaatataatacaacagtgaaccgaatgtacacgtacaacaatgttgactatagttgattgtaactctacaaatgatcgttacttgctgtaagctctgccttttgtgtgtaggcaggtaaggggggaaaataatcggtcatccaaaattactggatcgttgcatatgtttcttgtttcattttcattaagttgctctctatgcctcttaacacaggtctatatctgcataagtgatggcaacagttaaatttcaccaaacagaggggaaaataaaatgcagaatcggacaaacaataatagtatacttacaggcgtgcgaggttattctgcgcttgcaccgcttttctgagttcagctgaaagtttcattatttctgccgacaacccctcggatctgctctgttctttgatgagctgatcctgtagacaatgaaatatgcagttgtaaaccaatgacatgacaataaatagatttgactagtcatggtatagacaagaaaatattctcgacagctccagcaatcaacctttagggagagattctcagttacaaactctggcgggaatgaaatgctggtctcgttctgcccatctggctggatagtggtattacttgttttcaatagagtagcttgctcaagtcttaacttctctaagtgagagcgtagctcttcattttgcttgagacaatcttttacctggaaattgtgattaattgaacacgcaagatgctggtatcatccataaatgataaatgtttgtctctccatgcatgaaatgactgataacagcacacctggttttcccattgcattgtaacagctacagcttcttggtatgaagtagacaaggctgagttctcctcaaacagcttttctatttctgatgattgagaatcaatctgtcaaacacaatccaaaacttagccagctcattgggaacttattttgttcaaagaaaaggaaggcagcatcaaacacctccattaacaacttttggcggctgccctctagcctctcaaccatcaaagccatatcatgcaattggctttcaagtttttccctatcttcctgcataattaaaaaatggccagtacagtttaagattgattcgagcccagcaagaagattacggcgaacacttagcattacaagtttctaatcacccctgaaaattttgaattaagacaagggcattcaggcttacaggtgtccacctagcctgttgtaatgcaagatctcatctcagttttacttttgagtccttgataactatggactaacacatgaagtatttaccttggcaaaatcttaactcatggaaaaacaaaaaacttgaagtttgttcgatacattaccattgaaaatgccttgcgtgcagcaaattcagaagcttcatctgcatggtaggggaaacttatttcatgcagtttaccagtaaaatatggaatatctgaaggaacggaaagcagagcagcatgacaaatgtggaagtaaaagactatgctgaatggcacgtttactagagatagagtaccctatatgaagctacaaaatatgtttcatatgcacctgatgctttcttcgtcaaggcagcaattttttcttccaactctttcttttccgcaaccaaggaagcagcatgagactgttctccagttagcttttgttgctcttgttgccttaatagggactcttcagaaagtttctgttgctcctgctgccttagcaatgattcttgctgcattaaccattttatatgttagtttgcttagatagaataatcaataataaggacaagcataacactgaagcaagacaaaatgacctaccttcagctgagcctgcaaattttctacctccttttccatagcaagaatgtgctcatttgatacaccaactggaaatccagtataagagttgctcattacttgctgctgcagggtatttaactgtgctctcaatgatgcagagtcctcttctgcctgtaaatcataagattagcacactaatgatatgactaaggatgcacaatttttcaaaataccctgtattgctcctcttctgcctccttcagtcgtttcttcatgctccttagttgtgcgagagcatcctcctacttagcataccaggtagaagtgataatggggattagacatatcagaatcgtgaataccataaacacgaagacagtcaagtaccttagcaacagctgcggcatctttctccaaagaaatgtcattcacagcctttttcaaggagggtactatattccgctcctgcaaacagcgaattaatccccaaagtaaaacgcgtgcaaaatgtaagccatatgcatcaaactgcaacacaagtaccaaattaaaatgcacaatatgaaactcacaaggtcgttcaagcggttaacgagggaatccttctcgacttccttctcagcaatctagacgaagctatgctttgttaatactacttcatccttcaggtaactgtaccacaacaatactgaactgcagagaaaataccttggataacagcatttggttttccctctccaatgctatgttcccattttcaagttctctaactcgaccaagaagctaccattcataccaaaagccttagttatagtctagaaacaacatgagaatttggatacgtacttgccacgatcaatgttcatccgaactattcgacacaaaggaaaggggggcaaacctcagctccggctcctgggttccctacagaaaacaatcgccattaagcccacaagattagcactgaactacgaactgttccaggggaagagagggatggaccaaccgtaagggtcgacaagggacgccgcggcggccgggttgtgctgctgctgcatcctctcggcggctctcttctgccggatctcctccagctgccagacaaacgcgcacacaaaccccaacacaaatttgagcctcaaatcccagatacaaacgagacgcggatctgaaacgcctcgcgtcacagagaagcaggagggagaggagaggagaggcatacggtgcggcgcccccgcgaggcgtgattggcttccatctccggcgaccggccgacgaaccggtcggctttctggaagctcgggatccggaggcgcgacgcgaaggaggatggccgatggcgggggctcctccggtatcgcctcgatcctgtgatgcccggagaagagaaggggaagaaacccaaactcgtgggcctagccaacgtgttggccttctagagttcacaagccggcccgtacgagcccgatcgggcaggttattcagtacccccatgcgttccaaaatggagtaacacaatcctgaacaggcattttatctatgtacatagttaaaattagttttttcatcctaaaaataatccaatcctaacgaagaatttgaacatacatttcatatcttgtctagatatttagtctgaattgttttttcttcaacggagggtgatatatgaacacgacaatgtactcactccgttctcaaataattcatgcggatactattcaatttaaactttaattaactgtcatttttatagataatttataaattactagaaatgtaattatatcatcaaaatgtgtggcattacaaatataaccatcaacctttctcaaattcttttcttcttattacgtcgtgtaacaaaattcttttcttgtaatatactgacgtgcaattattttgcgcgttcgcgaaaaataaccatcaacctttcatttatagtaatataatcacttaaaactttcatttatagtaatataatcacttaaaagtgatttatggtcaaagcaggatggctctagtaaattgtcagttatttgttttagttgtgtcagttattcaagaaggaagagagtattatccactccagtcaaatctattgggtgcattggtggcggagaaaaaacacacacacaaattcaattcataattaacaggacttggacaagttagacagcacaactcaaaatcaacgatgacttggacaacatatgcagtgtaaaagcccaaattttaatgaacaaaccatcgaggtagcagtctgctttacatgtccacaaacgaccatggtcgggccttcagctgccaacctgagctgcctgataatcaggcgtaccatgcaagcacaccgagctcacgttacagtaggcagtttgggcaagttacactggatttttcgctacttctccctaatcggagcacgttctcagacatgacatatcttacacgccctcgtttgggccaacgaatatatgtacaggatgaaagaatattgtacaggtgagcggtcagtgccgctggtattgcaacgggacgagcctagcgttaacggcttcaatgtatgtgcgcaggcggcgtcgatcatctcttgttagggacagagcggggttcagggcgagtgacggtgcctcagtcaggagaaagcgcagcatggatactgccttcgagtacagcaccatggcagatgctgatttccccatcatctcatcaacctgcaatttagcataacaaaacacacaaaaagagtgggataagagtgcacaccaagctttcgttctgctatgtaagacagtgtgcttgatattgacttacaccaccatgtcttcccaggttaagcgcggtctgaaatatgatttctatcgcatctggcatttctgtagcatctgcaagcataagctcacaatcagcaattcagcattcaagaagttcaaccaacgatttaaagctcctaggcaaggtaacataccaactgtctgtcctatagtgttggcaagttcttcagcatattccatttgaaccaaaaactgactctctatctccatgcatgtatcatataacagttgagagtttgcaagcaaatggggagcatttgagccaaaacccttcgcggtgacatcatgggaaggattctctcttgtggcagaagatgcataagaagtgcagatgtaaattgcttgcttccaggttgcaagaacaactagctgaatcgagaatccctctaagtgcttggcatctttaatctacaaaagtttgggtggttgatcagcaaaacaaaagcatggttagcatttgcaattgcatagataaagacttgtctcaggcagatgaatgaaacacaagaccttagtttatatggtaaataagcttcaccacaatgttttggacagagaatccaaacatatcaaaaggatgagaactttggtcaatgttaaacagaaggaagtcaaataggaggcaaggaaatttgagtccactgagaagaaagttaccttttctttcaccaattctgctatggtagacgcatactgctccaataatctaaccctggtcagacaatcagatggtggttgatccatagcatcgttgagatctgcagatccttgtgaagtaccagatactggagagcagtgactgtccaagctaccagttccaccagattgctgtctgttaattgccatgccatgtattggccttggtgcactcacagcagttaataacttcggtggtgaaagagaagaactgtcaagttttgatggcatggtgcgctgtcgggagtcattcatcgaagaggaggatccctctgggtgcacaaagacatattcctgatctacaaactctaatgaatcaatgataggggaatctacatttacaagtaaggaaataacaaatttagtaagaactttttcacaattataatgaaacatgtgatagtcacaacagactgcaataccttctggataaccacctttagggttgtgcccttcatcacccttgttttccttgattctcctaggatggtccaggcgttgactactagatgcgtaattatttcccctaatatatttagagaccagacttgaatgtttcgttggactctgacctgaagttttatcaagccttttactcgtggcaaacccataggattttattgcactcttactatcagaaacaggaccttcatcctgtccagttgactcatcatccaaaggaaaaggcatacaatcttcctgagaactttggcttgaaggtctcgtaggactgctattaatgaatggaaagccatctcttatgtccgatggtgtccggctgtcaatgcaatacagaatatcaaacatgtcacgtgatgctgtagaagtaaaactatagcaaagaatatattacctcaaggttctctccaaagcatgttcagcgagaaatggatggttcacaaactcttcaacggtaaggcgttccactgcattaatattggcacagaatcattaagtattaattctcacttgtaacgtcagcataacaataatcatgtaaagtgatagttaatctgctacttttgaacaaacttaagttgctttataagtgcgacagcccacagggtttcaggattatgacagacagtaagcagtggtataaactgatcgagtgaagaaaccatacaactgcaatggcttctaacacattgttgatcagataaactactgagaagcaaccaaatatataaacttccttgggtgcagcatagttcatgagttgtgtcctgctgcatgccatggagtgtaacatatttcctgcaacagctttatacacgcagaaccttttttttttctagcacgaataaatctctaagctgtcttcatgtaagacatactgattacaagactacatctagaaggtcacatgtgaataatataggtgagaaaacagggactaattacaatgtcacccacccaagtctactcttgcatgatagtcattcatgtttttctttggcgtaatatcagtcatgtcacagtataattctggaaaattttacccttcctggtaaggatgtaagaaaaaataatgacatgtggaagtcttatgaaacttgtttttatatataactatacataagtgtagcagaggattcgtacctgaattgattcgcagtaactttctgcataagtcaatgcagccatggctcaagtcgcaatcagatggaaatcgtatttctcgtgtattgagtatatttctcagcaactgatgggaaataacatttttcagtagtagcctgatttaataatgcactagaaatcaggtcatgtggaaaatttgaataaacctggatttgactatccccggtaaaaggaggagatccggtaacaagttgatatagaattataccaacactccacaaatctgcctgttctgtcagaaatcgggcatgaagcacgagtcaagaacaggtaaaagtacatgataaagctcacaaggaagcagaaaaaagccctgacctttgcatcatacttctgagcttgcatgacttctggagccatgtaaagcggtgaaccgcaaagtgtttcagccagagaagaaggttctaaaaacctgcttgcaagaatagaaaaggtaagtacacatttctgatactatccgcgtctaaccctcccaccaagcctcacttgatccaaccatcgatgaatgagaagcagagagaaagctgaggtgccaattttgtcatggctgtaattaaatatgcaaggaagcagagaaacacaggatcaagcacaaagcaacatgatcttattctctttccctgcacgatacttatctagttgtcctcaagaatgtttcgtacttagcttttatgcacagatttttgtgtaaaactctgtgtgaattcaaaggacattacattacggagtaggactgttcaataaaaaaaagtagaattgagtgtagagaattaattggactcaagatagcttttttttttgtaacaatgatagcttaattggagtaatacatatgcgacataggtgtattggtacatgaaatatttttttgtaacaatgaaggcatgctgtagttgtggagccaaatcctgaagggggcctaaaaagtgatgcacataatatttcattctttaaatggaatgtctctaacatctttcaagacatgaagatgagactttcaaatgatgcaccttttcttttgaaatagtgcaaattgactgtatttttttcagaacttcttgagaagttattccattttaaaatgcacaacaccgtttctttcacaatactgcaatttcatttcaggtaggagcgatttctacagacctattaggggattcttaaaccaggtatcaaactcattgctgataaactcaataaaaaaggccatgtggaaaataagataatataactccaaaataaaagcaatcaaacataagtaacttactttgcaaatccaaagtccgcaatcttcaagagggaattttcattatttgcaactagaagaatgttctatttgaacagccacaaattcaggatagaaaacaaaacaaaatgtcaggaaattccgtttctttcatcaattctttgtcattaaatatgaagatataatggaaatatccactcaataacagtaaattaaataatttaacctgtggttttagatctcgatgaaccacgttgttttcacgcagcatctgcagaccagatgctgcataaagaagagaatgtgattttggctctggggagagataaagcaataaatagtgcaagacactgagggtctgagaaagtgcttgcctagctgctggatgaaatgcttagcaactgtttcagaaacccttttatgctgctgaaggtatgagtgtaagtcaccacctcgacagtactctaatacaagatatattttcccaccatcctaaaatcatcaaataacaaagagatacgcaaataatagttagatatgagagtgaagaaataattatgtccaacaatctccctagagggaagcttccctttcgtggaacacctagaaatattaatatcggaggcataattaaacatgttaggtatgcttttgaactctaaggagggaacaactaatggtatagtttcctaaattccaccagaaaatatatccaaaacaaacaagttaccaaatttggaattttaatgttttgcttccacagccagcgaacaaacatccaaagttaaacaacttacgctatggtactagcattaagttaaaactttgcatagtatcaccacccaaatgaacgtcaagcccaatgagttctcctttgcttgaggcatctgaataccaagaaagctcagaagaattcaactaaaagagagactataagaactcccgattttattcatccgaggtttataaacagtcgccgtccgcatgaaatcctaacaaatcgaacgcaattgcgcaaaatataaacagtagaagggcgttgatccgaggatcggggtaccctgatggactcgtggagggcgatgacgttgggatgacggatgcgccggaggatgtcgacctcggagaggaggctctcgcggagcttgctgctaagccgctccacggcgatctccttcaaggccacctccgtgccccgcgtgcggtgcttcccgagccagacccgcgcgtacgcccccgacccgatctgccgcaccagcacgtagtcccctaccctccgcacgccgcttcctccccctcccccgccgccgctccccgcggcgcggtcccccatcccctctggtcccgctgcctggagcgcagttcgccgcgaaggacgtgagctccgccgccgccgggagagatgccgccgcggccgcggggagaagcaaccgaattatctcgccgcgcggaacagagagagaaaaggggaggagggccaggtctctactcgcggcgtatggttatccctttccgctggttttataaagattcctccgtcttttgcaagattctcctgatgtgcccatttattttggccgaaaaaacgatatagtatctgcatcataacgtttttaagtactaccccacagtaagtaagtcgtttacaataatgtttaaatcaacccttggaaatataaatcatgaataactctcaagttgttgagtttgaaaaatgtaaaaattatatgtatagatttgtcttgaaaaatactttcataaaagtatacatatatcacttctcaataaatttttttatataaataagaagtcaaaattgtgttttagagaccgtgtcactgtcctaaacaacttacttttacgagtatgagtatggaggttctagcatgctttattgtttctttttttctcacagaattgtcccataatattcagtaatattcaggagtatggaacaatttgacattttgtgtagcaatagtaatctggtcatggcagctgcgaaattctaggcttggattgaatctttgtgtaagttggatttctcctgaaatcagtttggcatatttttggtgtagttggtgcggaccggatgaagacagaaaaatgccatgatgcgtcgaatggggggtcaattgctaccacaagcaagacgacgcatcacgtcacagctttgccgctgttgcggctactctcatatagaaaacctaagtcccagaaggcaagttattttctatcaagtggcacacaggatgacaggaatacaaggatacaatgatcatttttaattggaaaaggagcagcagcacgccaacaaaaatggttgtgaaacaccagacaagatatctttaaaattgtgccaaactcgggaagcaacagtaagctttacattacacaggctacatgaaaagacagcattggtaatcacttcaactgccgcacatttacaattccaagatatgatgcattacagtaactgatgtctgatggacactccacaattgtgaaggagaattgcaataccagtgtaccaccatagcagaaaacaagaatcacccttgtctgttcagtccttcgtagttttggagcaaaagataattgcgttacgtagttagttccccaagccaagttccctgggctgttagttggcattctattgtcattgacaacagcgtgggaagaaatgactgtcattcctggagcctccagccaagttccttgcattgctgttcatcaggctgcagagtattcggtatggcaccaaaaacacaacgggccgtttcaaacccagaaatcgcattatgaaaaaatgccgacgcctcctccatgttcttcttcagttcatctggagatatatacatgaaatactggggagagggagaatgctgcttgatagacatgattggtgcaatatcagcaaccctgacaaatctctctgttgctgcctcccaggaaagctcatgtctcagttcctctgacagtgggattggctcttcagccaatgctttcatagtcaatctcacaaactctttctcagtattgtacatgtggcagttaggaaaccttttgaagaattcattcgaaggatggtttgcacatatcacaattttccccatcgccaaagcttctgcagttgtcgtgcataccacatctgtggtgcttgggtttatgaaaaccttgtagctgaaaaggagataacaaaattcagttagatcataagtaaatcaataacataaatcacttctaataaaaacatagcccaaaatacaatctagcagctaaattgcttgtgaataacatttaaaccattacttttctgctaagtactcactcatgaaatatggaatctccatggtcacgaccaggatagactcgaacatcaagatttagtttctcggctgatgctttaacctcatcagaatcttctccactgccatacagctccatcttaagaccagataattccttctggtgcttctgaagcagctggagtagttctgtataacctttactccagaccatctttccaatataatatgcacccttgaagaatgcttgttctctttgagatatctgctgatgcttcagtttaccaatttcaataaattttggatttactccatggacattgcaaactattgaccttgggacttcctgagttgctgctgataatcttataacctacaaaagaaataacaatgaaagataaaaataaagcacatgattacatatcaaattatagacggaaaatgccataacttgataagaataaattctcaagctctcattatttaaataaatatggatacattacaaaggtttttatgccattcggcatcatactgtgcataatatgtggaacatccttaactttattcaaaaaatggcaatatttatctggtcactatgcgaacatggtgattccatgcatgatggaggcatatcacagctgttcatttcatagactaatgtcatacaacagctggtaatgaacttctagaagttaggcaatgtcacatacgtccaaagagcaaagaatcatatccatgttaagaacatattttgccatcaaggatgaagggtattactgagacaggagacttataaggttatatgaagcaaattgagatgttcatagttgaactactgaaaaactttaaaaatatgcaaaccagcaaaatagaatagaaaagaacttcaaaaacatgcaaacccagaaaaatataatagaaattgaaggtgctaaccttatggcagtagatgtcagtgacccaggaattgatatgttttaagagaaatgcatggatatatccatttctctctctcttgacatactccaaatagttggtatgaacaacacctataacttttctgaatttgtttttccaccttcgtccatgatggtaccatgtaagatgctctggctcttcaagaactgcaatgtctgctttatcatcagatacagtctgggtgatgtccccagcaggtagaatgcttcttttctccgttgagaactgtatggggagaaaatatgtcaatcaacctcattatgacatcacaagaacatcaaccacatgaccacccgctcaacttatactggcctttcaagttttataacactcagtgtctcattttctgctcactccactaccatagatatttctagtaattcttgtgttgaaggtactagatgcatgcatttttttaaaaaaaagaaccaacttctacggtttattggatttgcttctcaaatctcaacaagaatcagaacatacaatcctgctccattttagttttgacactaacatgagctaagagcaacgtgtgtagtgtgtacaactgtatggccaagcaatttaaactcaactgtgtgatgaatttttgcgaaccatgggaaaatcagaagcatcatatcaaacaagcaataaaccgtaccacgccattcactttgacattacatttagatcatgataatatcagatagaactatacagtactttggaaattttggtttactttacctttccaggatagaattttatctcaaacttcggcagcagcccaattcgctcctcgagccaccgtcgcacatagccttcttgctccccgggcacactgaatttcatcttgttaggataaaccagcagctggtcccccttcgaaagccatggaaccaccagcgtaacctcccagtccccggccttcgcgaggtaggccgctcggaagagggggttgacggcagttccagtcatccatggcaggctcgccgtggtgaatatggcgatatgctgcttcctcgccatcggcaccgagaccaccccgaccgcacaaagctgctgaaatgaccaacaagcaccaccccaccagcccttaaatcacatcgccaaagcgtaccattacaagtggccaaagaacaatgccggcatcccgcaaagccgtgccatcatttttcccccttatcccgcccatacgcatggagaatcgaatcatctcttggggatatttttttctttaaagaaaaacagagaatccagggagcatctaattcggcgcccaccaacatgcagccgtgattcacgaacactcggggggctaaaacagagagatccagcatgaccgcagcatcgatctaattccaaccctacccaccggcgattcaaactcaacccgcccagctcgagatcctaatcgcggttccaggacagcgcgcgggtgggaggaacccggcgaggggaaggggaggggaggagctggttacctgtgcgatcggcgcggccgcggatgtggatgggaggaggcggagaggagggagaagggggagcctggtgccgtggagtggatggcgtttcaggtttggccgttgggtgtggaggttgccgtcaccgctcgcacctcgcagtcatccccaacggaacggcaccggggcccgcaggaatctgccatgagggcccagattccccgtgcggttgggcttgggcctagaatgagacgtgaatctttcgtctctccatctattcggtgtctgtctcttgggccctccgacacatatcttttttttttatcttttccaacacataacttctatcgtttcgtttgtgcttgtatttgttcgtactacttaggttgagtttgaggaggaggagattgggaagatacataaaacgaggtgagctattagcgcatgattaattgagtattaactattttaaatttgaaaaatagatttatatgaatttttaaagcaacttttctatagaaattttttgtaaaaaaatgcaccgtttagtagtttgggaagcatacgcacggaaatcgaaacaaactcactcattttcttcagctgccgaacgcaacaaattaagaaattatctataagtaaaaaatttatgtgtatgtacttagtgattctaaagcaaatagtataaaataaactacgtaaaaaacacaaaatctacttcggaaggtataagcgaaacaataaagctacaagagttccttcaaatttgagcaaacttcaaagcagtgagttgttgctctatggcaaaatcatacgtttatattatggaataaggagtagaattttcttgcctctatgttcggtggatctcgcattctgaaatccagcaaccagtagcagtctagcagtagttttggataactcaaaaagtaaagtacttcttgttagaattaaattagctaggtctaatttaatcataataaattttatgggtctataattaatattaaaatattaatatcaccttaacaaccaacgagaccagtataccacctcgaattaaatacacactccgttccaaaatataaatatttttagaatagtgtaaagtcaaatattttttactttgactattaatagaaaaaataaaaaaagaatcaatcatgtaaaattgatgttactagatttatcattaaacaaactatcataatatgtaactcttttatttaaaaaatcttacttttatagatattattggtcaaaatagtatctcacaaattatgtcaagatccaaaaatacttatattctaggtcaaaggtagataagatcttcctccttgtctctttggttccatttctagttctccttgggtagactctgttgttttgtttatgtgtagctcaggctttccacggttttgttggtagactcttgttgttctgtttttgtgcaactcaggctttcctcggtttctgggtatttgcgcacatgggtactcgggacgagcaagcctccggaactttgtcagttggagtacctgcataagtaggcgggcgatcaagtttctgggagcgcttattcggcgcgactgctttgctacgtctccattgcttcctctgcatcaccatgtctggggagaatggcatcaccatgtctggggagaacggcaggaacatcgacaccaacgtcaaccccaacaccaacaccgtctctagatatggagtgttctctgagtatgttgttatattcacttttgtgttaaatatgttactagacgatgctattcatgttattagcgtgttcatgttttgtactatcagtagattatccttttattgacatgccatatttagcatgttacatttttgaattaaaatataccgaattatgactagatttctttgacttcagcagaacaacccaagagggtgtgtttggataatgggttataaagagtggaattgaaaatggaaatgaacgaaagattgtgatgaaatcctatttgatatcttcgtatccgagacacaacaaattctactatgtatttttccaaaatctttcgtcttcgtttttctttggaggtgagataaatggatggctaagattaaaagttttcattcatagggtggcattggatgacattttcataacccattttctaaacatgccatagtagcaaagccctttttaagctcaagtgtctgcagattctgaatttactactactagagaattttgccaggtggagtactaaaactcttgttttctgtttcatgctcagatggggaagctaggaatcctaggagctttgaggagttgttgagggagaatcaattgagcgctggccatggaagtctagctgtaaaactgaaacacgctgcggttggaagctgataaaagaaagtttctggtgaagacatgtgcttgaaagaacagcgtccttctgttaattgtggtgagggaattaattatccagcagtgttagtggcatgtacactgcacaccaccaccatcatctgcttccttgccaacatcgagatcttggatcataagcattcatcgctgtccttttcctttcaacaaataagaaacttctgcatcagggccaccaagatgaaaacgtgacaaagtcatggtctcatggaccccatgtcatgatagggctgttttaacaacctgggtacggtaaagtcgccatggaaggatccgttgttcgatgaaagctcgtagccttaattaactggattgtttcgagattgacaaaaacaggtaatagtactctaatgctgagtctgactctgaaagcaaggtactgcaagagccagaagagcttgaggtttggtaaatggactgaaagtcacataggagaagagagaaaaaacaatccagttatgcaaagtcgttctcaaaaagttatgcaaagtccatgatgaagaaactctctccctcttgtaatgaaacaagaacacagaaatgcacacgcactttatgataccatgtttagacaaaaagaactgcctttttttgtttttttttccattcatgtgacacctatctacaagcaaagactgaaacttggactcattcaaccatatagcctgatgacacatactacttgggacaacatgttacacttccagtttcagagacagttcaggaacaaatcaaacaacaaacatatcaagcacataatggcccccttcttccgacgcacttagcatcgtcaccaccatgtaaacgaaagacgcgcagattaatccttcgcctcgcctcgccttgtcacatgacaatctcgggcttgaggatgctggacttgatctccttgtgcgggagcaccacgccgccgttgctgtagacctcgtcgcagacgtgcacgtcctcgccgaggatggtcatgttctcgacgcgcgcccacatgccgacggtggagtgccacccgatgatgctgctggagatgcacgcgtgcttcttgacgcgggcgccgcgcatcaccgtgcaccgggacagcctcaccccggcctccaccacgcacccggggccaacggcgacgtccggcccgatcaggcaaccctcgccgatgacggcggtctcgtggacgagcacgttgcccaggacgtgcgcgcccgacgcgagcttggcgggcgccttcttcctaagcgagtcgaggtacagcctcagcccggtgatgtagtccctcggctgcccgatgtccatccagaacccaggcaggaccatggcgaacaggccattgtccgcggcgatgcgcgggaacacctccttctcgatggacgtgggcttcagctcgatgcggtccagcaccgacgggttgagcaggtagatgccggcgttgatcttgttgccgacgaacaccttgggcttctccacgaagcgctccaccttgtcggtctcatcctccatgaccaccacgccgtacttggaaggctcgtcaacctgcatcaagcagcaacatttctcagtgcactgatggtctgacactttttccacgaatgccagattcttcggtgtctcgtgataccttggtgaccatgatcgtggcctcgccgccatgggacttgtggaactggatgagctcggcgaatgggtactcgctgatcacgtcgctgttgaggacgaagaaagggtcgccggagccgtcagcgagcttgtcgcgtgccagggccagcggcccggcggttccgagtggctctgtctcctgcgagcaggtgatcttgataccaagcttgctctcgaagtccttgagaaagttaagcatgacctatgattttggcaaagtaaaacagtgtgcatcagtaagatctcagcaaccgacagaagcacgatgttcaacagcgccccatgtgccatgatatgtcagtttacctcgggctggtaattgatggccagaacaacttctgtaactccaacttctttcagagcttcgatctggtgagcagtgcattgtaaaatcagtccaaagatgcatcgagaaatgatgtatcagtgcaagtagcaacaagtcctttttcttctgaaaagaacgactaaataccagtctgaatcagatctttgattgggacatggaaaaggtcgaatattagttcacttcgataggaaaatggagtactaattgtttactactccctccgtcctaaaataagtgcagttttgcactgttcatgttcaacttttgaccattcatcttatttaaaaaaattttaagattaatatttttattgttattagatgataaaacatgaataatactttatgtgtgactattttttttcaatttttttataaatttttcaaataagacgaacggtcaaacgtcggacacggttccctacgactgcacttattttgggacggatgtaatatcaatttgtcacaactatttatgactagaatgaacaaattcagtgatgcaaatagatgctactgttgtgaggaatcaactcatatggatcgatccatcataagagacatgactagagtgtgaggccaataacatcaactgtctacatcttatccccaactcgggtaatggaacaaactgacatttttcatcttgcattaccatttccccaaataagttctccataactactctattgtcatgcctgacgaactgaaaagactgtattgtgagataaaaagattggagtatttgtgctgacctgatgcaggatcatgggcttgttcccgaaatcgacgagcggctttggcacgctgagagtcagcggccgcaggcgagtgccgaagcctcccacgagaatgagcgccttcatggtcgcagccctgctaactcagctcctcctcaccctgcgaaaaatgcagcaagcagcataagaacgatgagacgatctgatctgatctaatccagaacccgcttaatgcccgcgtgatcacggaggccacagtgcgggagtcgggacatgcccctgaactccaagacccatccgccctgtctagtacgcagatgccatgtgtgatgtgtcccaggacagcacccatgtcatggcatctgcgccgctgcagccgctgcagaagcggcagaattctgaaagtacaggtagcaagaacgcgatacgcgtgcgtatacagtagaaatcggactgaaagacggcattgggataaggatcggcgacctgatcggctgatctctccaaaccccgtgcggaaaaagaggggagatggagagggaatgatgatctctcttgatcgggtaggtaacgaggaagacggcaaattgcaggcgtcaggagagatatggcggcccgcctcctaatctatccatccacctaaccttgccgatgaacgcgtcgttgtccgcttgtattgaaccactctgcttcccaccgaaaaaccaacctgctagccaataatagatctcgagccagcacgaagagacgactctatctatctctcctgtatgacttttgtggggttcttctccatggctggatccatgatgaggagagacgagatagagatgacggagtggtcgcggccatcgagcacccacgccgcgccgcgccggcacgcccccaccctccgaccgggacacgcgagagaaggacgagaaaaagggaaaaaaaaaacgaaggaggggagcgaaattaaggagaaaggaatgagcggtggggctaccacccattgcagatctgggtgctggccttctctgccgctctgctagctcttgtctgtgggcgctgcctgcgcgcgccgcggcaagaaagatctcgcctttctcgatctctaccaacggaattgccattcgcatcccatattcccattgctaactctaacggcacgagcacggaacaggtgtcatggtgactcgacatcgataagctacgaacagagatgcatagcaagtaaaaaacagagcagagactcgggcgtggtgtacgcaccttgaggcagccgaagaacttgcgccgagcagaggagagcgggcgtgccggggtggcgggaattgagaaagaagaagtcagagaaagagagagagagagagaggggggaagatgattgatgacgaggaagaagacagcgtcggccgcgtcgcagagcggctgccagcgacgcgggcgctctttgtactagtagcactgctttgccttcacccgcctccgatggcctctctcccctccagcagatgcatgaagttgacgtgtttaacacaagtttcgatcctaatcaatccctgcgaggttgcgacctgccatctcatctctttccttcttccttttatctcttctttattatgtcatctttttgttttttaccactggatttgctgtcccggcttaatcacagcccatttgtttatccataacaataattaaacaacaggtggcccaccagctcctgtacagtgtgtgtatgacatgcgggccaccaggtatcaggtgtcaccccttcatccaacacatgttttgccatgataactttatcgtgagcactgtgcttttgtgttagtaaagaaccggataatcggtaaaggcgacggttagcgttagtacttggtttttaggcgcgtttttgggcggatggcacggtggaagaaggctcctccgacgatggcgagacgaccgggcgggagacgacttgacgtggcttctccgcttttctcctcgccgccgcgcgtggtttcgacgtgttttggtgggcggggcttggctccatggccagtgggccagccgccacatttctcggtggcacgccaaccccgtcaagccgagagatcatctggcacatggccttttgccccttttttttctcatttttttctgaatcaaatttagacgttttatacattgttggtaggtactacaagcctataagggcacgaacaggtcgttcacctctactcgtatggagtagccaggccaacatcaggaccaaagatctcagaacttgacaccgtttcctaggtcaacgaacgggtaccgtcccattgtaaaaaagcacgatcttttcttcatgtgctagtgctactacatgtttgacctggctagcttcagcggttgatgcattcttcaacttgtacaattggaagcaatattgcacagagctcaataatttcttacgctacacaaaccactaatgcagcaaatgcttatgatgttcatgtacctgcttgttgtacatttgtgcatctgcccacttctgttgaaaatgaactgtccatctgcctttgagtgggagtacggaatgaattgccacagaatcacacaagcgcgccctcctttaagtggtacacaaataaatcatgctgcagctggatcatgtcaaaaagagaacaatgcagtaaatagagttacctgtaaattaacgcttttagagtatgttcagattgatggcatttctaactatacctttttttttataaagttgttaaagatgtgtttgcatttagtttttagccaaattttgataacgcataagaaatcctgtcaaaaatttgatattaataaattttgataagatttattttagctacaatctgaacaaccatttagttatcgacgttccaagtaccagctatatactgtatgcaacagcagtactccaaaatggaagaacgcatcgttcattcgtattagctgtcttaattctgacaagacctgaataactaatctagtactattgcataataccaggagtacttgatttaagctctgatttcggcctggatcatgatttaagcgctgattaaagaatcaagatttccctgcttgcagtacggaaaattgaaagaacttaataaataatacagaattagtttgttaatcccatgatcctatatcacatctgtgcaagttcatagtcagagtgtcacatgatctgattagataatatcataataccaacctgattcagcccgaggtgcagcagacagtgctgcttgagcaataatcaagaacgtcaccgacacatctgagttttgcatcttcttgtgcacctaatggactgcacagcaatcaggaccagcatttagtgcgctgatcacaagttagtagtactcctatctcgtttgttattgccgtgtactagtgtctgatttctatcagagtatcagttcatgtgatgatggttaagtgtaaaaatttcatgtttcaatacagaacattcatggtgcgcattctagatttatacgtaggcctcatcgacagtgctatcaagtctcaatcatcctgttcgattttcattctgggggaagttcagcttgtccattagctaggtgaaaacactgaggccttcttaatttgtcggttgggctgtcggttgatactcctggcaacataagagtaatgtaatgtatgatgacctgtcaatctgttcatatgtatatttcggttgttgttgaataccgtttgtatattgtagtcatgtacattgtttatctgatccgtgcaacttgcaacttgtgagttgtcattttgtcagagtttctatctttcgtgatggccgatgggagagtaagaagcaaattcagctggatgataatggcactatagtcttcagtcgataaattgctcctccaaattttccgagctcctttgcctcaattttcttttctgagctcttcatggttcagcacttattcgatctaaacattcagatctccttttctttttagcacaattcagacgtgtgaactaaatttttgttaggtaatatacacacagcatatacgcatgacatatctaactttttttaaatgaaccactcaatatagtgcaatgtttcatattgatacaacagaagaaaattctaggaccatagccctaggaggctataatcaagaaaaaaacacagccacacaacatgcctacaacaaaaataactccatgagggtaaaacgggagtacaacgactcaactacacgtggctcaatccatgtctttggattggagagggagagggcgagcgaaaagatggatccgtccgcccccacacaaaatcttacatacacctaagaattactggaggcaccaaagaactcccgggtagagattggcagtgtggcaccctccaatcctccatcataagtaccatgcataatcatatactccctctatctcaaaaactatgacaacctatttaccttggtcccaaaaggaaattactatgcatacaatctaattgttcgactcacatacgattgcatttaatcaatggttgtaaacagttacagtgcatatgaaacatgctctcctttgattgatctatagttgcatatctctaattatacatgagttgtacaactgggtcgtacgtacagtagtactcgtcccaaaattgattcaaaatttatcataaaatacttatcactctaaagtgttgcttgtcccgtctatcatctttcatttaaactttttcctattctactctcaaccatcactccacttccaaccatacatcattctaataagggactattatctttttttttcttaaaccttaatatatatgctaaactatctaaaataataaatatttgaggacggaagaagtatattggattcgacatgccataatactacaaatttggattgtcaatccagtactacgattctggacaaaggtactacgaatatggacagccccacaatcgaatttgttcaaatttataatctacaatatatataatttattactaggttattatattttaggataagtgtgtggtaggtcttagttccaatttacttggccaaatttcttgaggggaccagacaatcgaacaatgaaaaaaagggcccagttgttttcagatccataattttgggggcgccttaaacaaatgggccctttttgaccaatcatgatcgagaatagtcattttcccctactcgatcgcttttccccagaacaggcagaactttaccaagaaatttggaaggaagatctatatggtttgccggttgcacatggagcgcaatccccacaaagaagccagtaaacaaccttcacgcagtatattttcccttttggaaagaccaaaccaagaagctgaaagaacagaggtgaaagacaaacacattacacgcacaaactcgcgttgtaagcagcgcaaaagtcgaaagacaattcacgaaatccgaagagcgtgctccgtctgccgtccattcacgaccgagcggacgggcggtgatggcgaggggacagtgtgccgttgccggctgccactgctgccggcagccaacgcggcgagtgtaccgtgactactgccccgccgagaaacggcgcatccacggttgtggcgggccgggagtaggttccggagtcgcaggtggcgagcctcttgtacgcggtggccgccgccgccggatcgtcgttcaggaacgggttgccgatggcgcggtggccgtccctcttgtgcacgatcgccctgtacacgaacggcaggagcccttccattactccgttgatcggtttcagatttcagatcaggtgtgcatcgtgcacgtctcgtacgtgggcgaagcagcgtttatagcgcttcgcggttgcggtttaggaagtcggcgccgtgaaacacagcttgcgtgaagaagcagcgggttggtacagcagtggcaacccattgtcacagttgggagatttttatggttccagatcgatgcaagtactgtgccagtgatgacagctttacaaagggcttactgaaaatactatagtactcgattttatcctttttttccccagctgcaagggctagatcctttgaatgctcaggtcaaagaaatctaactcttccagctgatgctcttgcattcagtccggaccaattcagtccaaacggagacgagggacgcaccactcgatagtgctcgccatgtcgctgcggagcagcgtgtgcaagatataggtggtgtttgaatctcctaataataaagatgaagtgtttcacgtaaaacgaggtgatagtaacgtgtgattaattaagttttaactattataaacttaaaaaattgattaatctgatattttataacaactttcatataagttttcgcgtgaaacacgccgtttaacagtttgaaaaacgtgccactttaatccaaaacttgaaaagcagttcgaacggtgcatactaccccatcaccaatgctacaagacacaaggtacatgactgtcgtaggcggactagtttttgctgagcatcaaggattcaagagattgatctgcagaaaaattaccatgttggtgttggagaagatcatagcatatgatacgtctaaatctgacagcccaacttccccccaaaataggaataagttcactttgtgacgagaatctaatccgttatcaaaaactacaaaatacggatatctcgatcccccaactcttgaaaccggtacaatttgacttcctcgacggttttgaagggcggtttcactgacatgacgcctacgtggcgatgttgacttagtcttcggtccacgtggagttagacgtggtgcttatgtgttctagaattaaaaaaatatgtgcggtacctatttgtcattcacaccaaaacaatgtgggacccactgacatgtggggcccacatgtcattcatgtttccttcttcctcttcctcctccctttctctcccttctctctctctcccatatctcttcgtcttcgtctgcaggcggcggcgggcgctcaagggtccaagcggccgcggcggtgagcgggaggagaggcagcaacccggcggcggctcggcggcatcagcgacgtagacgaaagagggagccacgaaggactcgaggaaggagaagagcaagaccaattcgtcctccaaaggctcgctgccgccgccgtccccgacgcgacgacgaggcccactatggtggccacggtcgccgcattccttgagtccagcaacttcccccgcgtgctcacgacgctccagtctgaggccaagctcgagtttatggcgctattggctcgtgctgtgccttgccattttgggcacgccgtgaaatgagaggatttcacatgttcgtaggttgattcatggcgggcatcgccggtgagcctggaagagttgatttccatattcttggactcgaggtacttagaatcaacgacgcgatgctcaatctcgttaagtagctttcactggtaatccatatcttgtgccataattggtttttcattggaatttggttgtggaatgcagcaattctccctgtgggtcgcacgcctctgctgccgccgagctgccaccggatcgccgcctcccttcctgctcgccactgcggccgcttggaccctcgagcgcttgccgccgcctgcagacaagacgaagagaaatgggagaaagagaaagagagagaagggagaaaaagggaggaaggaaacaggaatgacatgcgggctccacatatcagtgggtctcacattattttggtgtgaatgacaaatggacccgcacatattttttttaattctataacacataagcgccacgtcaactccacgtggaccgcagactgagtcaacatcgctacgtagacgccatgtcagcgaaaccgccctccaaaaccgccgagggagtcaaattgtaccggttttaagagttgggggtcgagatattcggttttgtggtttagggtcacggattatatttcgatcactttcgagggtcacatagtgaacttattcccccaaaatataatctgacagcccatggacggcctaacaatatgtgaacagtaaacttctatcttgggccttcgaggcctcatgagatggaccaactatttcggccccgttgaacgactcatgacggggacaaatgccctgtcatactcatgctccagcaatcctgtaacgagaatactaccccagttggattcgcaggaccgcccaattatgtcgcgagatcccaacgcgaatgactcgctactcaccgagtcgccatcccagtgcgaaggcttatcaccattttttttggccttcgttgaggtcgaaccgattctgctgtctacccaaagccattatccctttcccccaataaaggggctactttttgctacgtttttatttgctcttctcatcgctgtcaaaacgacgagtggaacagagttgagatcagaatgttgaatgccgagctgggttgcaagtgacctctgacgtgctttgcatggtgcgaaagctctcggtttggcatctctggttctgcggcctgagtagtttgccgctgcaccgcagataacgctagctttgctcgtttttgtgctcttttttttttcctgaacttctgaaggcgtgtgcaatgacagcagggcaggtggacagggtaccagacttgcagtgtaagagtaaggttaggagcgtgtatatgcttattattgtggctgatctgggagagttacgcaagcactcgtgtttcacggggaacgaattgtagagtccacgccgcgaagcaaagtggggcgagaaacgtaggatgcgtccttgggtttctaatgcttctgaaactaactgctccggctttgacagactgacgggtgaattctctgcagtttatgcgattttttttatcggaattttggttagttcaatactatgaaggatcaagtatggatggttaatgctgcactttcgtgcactttcttgaaccgcgcattacttccgacatgttcctgtttccaaattagggatgctttggagttctcctcgtatagccgaccatggtgggttgggcaaaaccatgttattttactttgactatattcataaactatttgcatttgatttccaacacggaaagcattaggggaggtaaaagccaaaaggccccgggacgatccagcaggcaggagccaggttacactgcgcgacctgtgtgtaacacacgacgacgacacagctaccttccactagagggacgaaaagtacagcatcggcatcgtcagaaagagatagaggaagaaaaaaaaaaggaagaacgaatagaaccgaaaagtcccagccgaggacggcccccttacgtggcgcgagatgataaatgccgtcccaatcaaacaatgcacaatccggagagagaatcttcgatgcgatcgtagccatatcggccaaacagaggaccacgcgacagatggcattcggcttcctgaaaacgtgatttcatttcacccatcttttcttttctttttcatttttctctcctgtgttcgcctgctcgtcaagtcgtcgtagcacggctgcgtgcctcgtgtccactattagtttggttgctaatcttaggctcgcgtgtttgttgactcacaccactgcacggttcacccaccagcaaggacttttcagcgaccacgaaagcccgcatcatgatcatcaaataggggaacacgacaccaacgacactatgataatgatacgttttttgagtttagcgtgcgaaaagcacacgtatattgtatgtgtgttgaagcctatgtgttctacccgttccaaactgaatttaaaatcggagcttttcggaaacggcaagaagagaggaacatctgtggggtgttattaattgactaatcgagacggcacaagcgattcggttgcccaacacgtctaatacgtttgcacaatcatcaggatgaacggaaataatttaactataaacgcatgaacacagcagtgtgtcgcaatctagtaatctagtcagagcaaagtaggaacttctttatatttccacgagcaaaggggacactcaattatactacaatttctctgacgcttgaggaagtttctcttcaaacatcggaaacacatgagctttttttgctgaaataaggagcgggctgatctgtctgacgagatcacaaacgcccaaagaaaggaagtgaacgaaataatgctataataatctgcaattatatgctttgaggatgccacattctgtttgatcacataattcggaacgttctgtttgatcacggcttcgtccaggtgaattcgagttagagatggccaggaaaccgagaggagtagtatgtctgatggatccacttgtcacaatttccggcgcctgagatttacgacgacgacgctgacattgtccgaggtttgccgcgccaaagccagcttggtcagcaggacggccgcctcggcgcacgccttgtcctcctcggcggcgctctcctcgtcgctctccgagccagcggcggcggaaggagcaccgtcgttgggcgcctcgtcgccgctgctgctgctctgcctcgggcttaggttggacgtcgggctcgaccggttcctctcgcgccgcccgctgctccgcaggcaggcgcgcacgacgttgcaggcaacctcgttgctcaccacgtcccacaggccgtcgctggccaggatgaggaactcgtcctcgccgtccttcctctccatcaccctcacctccgggtcgcatatcacgtacggcttcaaatagctgtcccctgcaatggcgcatccatgtaaacagtcagcacatggcgcttgtttcttttgtgtcatagcgagagattttcaaaagtactagagtagagagctcaccgatggctcgtgacatggcgagcatgccaaagacgcgggcgccgtcccagaagatgacgcgccctcccgccgcgtggatccgttcgagctcgtcgggccggtccggctgaatcgatcagagcagatacgtttagagcaacgcgattaaagtaagaaaaacttagattttttttggttgaccatgtgtacgcacacatccccataccttatggtcgcatgagaggggtatggcggcgccaccgcggcagaggacggcgcgcgagtcgccgcagttggcgacgacgacgtggcgagggcccagaacggcgacgacggccgttgagccgacgtggtcgcacttgggcagctgcatctcgcaccggcaggtgggggccggggcgacgctcccccgtgacgaggccacggcctccgcgtccatccgcgcgaagctcctctccatgacgcccctccaccgcgcctcctcgtccaaccccgccgacccagcggcggcgccggcctcgtcgaccacgatctcgtgcatccgctgcccgcacgacgtcgccacctgcatgcacatgcaaaccattccaataagtactactctccgagtcaaaaccgccgcacatgcgcgcgccgcgcgtttcggcgcatagatctattgacaccatcaaaaaggtgttcgattaaacaactcgagcaaagagagcaaggcacgcacatgagagcagccgtggccgtcgaacaccccgaagaagtggtggccggggaggaaccccgggcaggcggagacggagtcctccatgtccctccggcgtccgcacaccgacgtaaagccgtacctagcgcgctccacctccctgtcctcctcgtccgtcgaggcctctcccccgccgccatcaagcctccgcctcttcccggaggtctcctcctccgccccacgctccgcgaccaccctgagccgccggatctccatccgccgccgcctcgccgctcggctcccggtgtcgcactccgggcccttcccctccgacgacgatccagccacaacctcgcagcaaatctccgccatgaactaacaaaatctccgaaagatcccttgcaacagagggagagaaggtgggagctcctctgctcagctcagctcagctcgtcaagcaagaaatgttttctctcctcgaagcggtgagagcgattgagaagaggtgatggcaagtagcggccggcgatataaaagtgggtgggggaaggggtgggggtgggagaggcgacgtgccacgcggcgggcgcgggccacacgtacagttgtgtgatcgcgccgggggccgttggatgcggctccacgtgacgcgcgcccgtggccggtacgtgccgcccggacgcgtgtcgaggctgggacgcgtccaccgggcggtcgcgagctgggaggcttcaccgcgcgccacgagttgggcgaggcgctagtagccgcggcggtgtttgctgttcggcgcgcgggatgggcggggcgacacgtaaacgaggcgaggcgcgagcgagccgcggttcggttcactcggctcggctgtgtgcggggtgcggagggggtgggggaccgtgtcgacgtggcctgagcgcggatccgtggagagataagagtaaccgcaatggaaaatggtaaagtaaggtgctctctataaaacatatacatcttagcaatagattcgattaataggaaaccacattaatagtatatctacattggtatctgtcggtgacatgggaccgggagtatcatgacttagagacttgaggcagacgcgatcacccacgtggcctaaccccctcgggggggtcgggcccgagggtgatacggccgcccttctctttgtctccccgaggggtcgggctgcacccggggccgaggcgccccgacccctcgtgggttttttgctccgcgtgtatgggttaggtgagcacagtggggctcacctaaccacatttattgcggtttggctgagcgtgtcacgccgcatgtaacgcagtgcagtgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctggtcagatatatgccaggcttcaccctaaccattacaggcaagatgttgtgtgaagaagggccaacgtgcagattgctgagctgacgcgtggtggacaagaatgaccgatttgtgaccagtctgacaccggtcatgtcgtcagcagacagccatgattccgcgtcgcgcctgctcccggcgaaagtggaggtaggtgcgggccgtcccatcagaaggtgactcgaacggcaaccatgcaaatctccgtccatttatgaaaaggtagggtaagtccccacagagagggaaaaatggtgcatgtggtatccccttaagatataaaaggaggaccttgcccacttagaagggatgattttttgggggggacttttccagattgggaacctagaacgagggagaggctggctcatactttgtagctccttcatacacagatctcccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggcctgcgcggtctcccggtgaggagccccacgctccgtcatctggcgcgccaggtaggggactctgcgagtgatcttctgagctctcgcactccttcgtgtgcgccaagcttttcctgttcagcccaatggccgagccagcaaaggcgcgcgacctctccccgagtatgagcggtgacgacggggagccaaacccacgccgtcgagctcgtactccaccgccccctccacgccaaagtcctaggcgggaaaaggcgctcgagagggctgaaggatccgcgacttcgacatccacaggaggtgaagaagggcggcgagatggggagcgtcgtctcctcgtctaccgcgacggcagcacgccccagggcgcgctccaagctgcaggcgcgctcctacgtcacccgcccgtcgcccatgacccggagtctccagcccaacgttggctggacgatgtggccaaattggtcatgactgcaaggcagcgcctagatgctggtgggcggtcctccgccaccaaggcctctggtgctgctaccaccggctccgcgtcgtcaagacgaagggcacgacgagcggcagccgctgttcgccattcggccgccactcctacgtcgactccttcgacccgggaagatctgcgtggggggccggacgcccgcaccagcatcgagcgccggcgtaatgaccgacgtgctgcccacacaacggagggcgcttcctcgtccagagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgatggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaacaccataccatgcatccctgcacacgcggtaatctacgcgttcagggagggcgtgcggcacaaccgcatgctcgaaaagatcgcctccaaggagccccagactaccgcggagctttttcagctcgcggactgagtggctcgcaaggaggaggcctggacttggaacccctccgattccggtgtggcagcttcggccgtccccgggtccgccgctcggtcagggcggcgggacaggaggaggaagaagaggtcggcccattccgacgacgagggtcatgtcctcgccgtcgaaggcgtttcgctggccacccgaaaggggaggcctgcgagcgacaaaaagaaggaagccgacgctccctgacctcggctacttggaagagcgaaggtggcgcgcggcccttcgagccgcgcgctaccagcagagcctgcgacgctaccatcagcgccacgtccgggcccgatcactctgcgtcgacgacctcgtcctacgccgtgtccaaacgcgtgctggactgagcaaactctcaccaatgtgggagggtccatatcgagtgatcggcgtcccccggccgggctccgttcggctggccacgggtgacggcacagagctgcctaacccgtggaacatcgaacaccttcgtcgcttctacccctaaagggggatcgggtgtcaggtttcggactcgggccaaccccgcacccccctcgggcgtgcagggttggccggggccttttcttttttttctcttccgtatttcaataaaagcattttcgatttcctaaaggctgtatctgtgctgttgtttccttttgaagaatcttgacttgaaataggtcactcgtgttcaatcctgccctcgggggctcgggtcggctaaaatcgccaaacggggcccagaaccgagccgtgccccagggcgtggtgaactccgggggggaatcggcaaaaacccacaatcgggtcacccataaccctcggtcaccacgttcccggcctggccagtctcgacatgtggatctccccaggcactagccccgacccgagccatttgaggactaggaccagggcacgagcccttgttcaaaccaagacacaaaaggaccgcggcacaggcatcctcgtctcatacacacaacaaatagaattgacacaaaaaatttcctctttatttgattgcagattaaatcagcctataacaagaagggggcccgaaggcctcggaagaagaaggaaaagctattaagattggcggaggcctgggggctcactccgacgcgcccgggtagccggcctcgccgtcgctgtcgtccgcaccgttgtcaccgcactcctcgtcggagttgaaggcaaacgcgagccgaggggccgctcattattgtcggtcggttttcccttgctgatacgcgcgatttgcgaccgccgggattctgcccgaagaaagagagagcagggaggagaggcccccgagccgaacggcggcccaaggcccccgacggccggagctggccctccgcctgcttgtccgatggtgccaggcgcccccgacccccaggacggccccgaggccactgtgggaaggccgcccctgtcgtcctccgaccccgaggtcatcggcacagaagacgagtgcgccccgcgaggccgcttgggtgaagagcgccccagggatgcggcccctagcgaagaggatcggccccaccgaaaggtgcagcggcccgtctactttgttagtgaggccctccgggatgccaagacccgataccctcaggcccagaaaatgctttacgctattctgataacttcgaggaagttgcgccattatttccaggcgcatcgggtcacggtggttacgtcttatcccctcggccaaatcttatataaccgagagggtactggacgggtggtgaaatgggcaatcgaactctctgaattcgatttgcgctttgaaccaagccacgcgatcaagagccaggccctcgccgactttgtggcggagtggaccccagctcccgagctcgtctccgcccccgaggccagctcgagcccatagcagctgcctcacaccgccctctgggtgatgtagttcgacggcacctgcaggaaccggccccacctgtcaccaggccttagaagtggcgtcacgcccgaccgcttccctcgaggagggcgatcgccctggcataacgccgggggctactgtcggtgacatgggaccgggagtatcatgacttagagacttgaggcagacgcgatcacccacgtggcctaaccccctcgggggggtcgggcccgagggtgatacggccgcccttctctttgtctccccgaggggtcgggctgcacccgcctcggccccgagggccgaggcgccccgacccctcgtgggttttttgctccgcgtgtatgggttagg

SEQ ID NO: 61675 - DNA, 1143 bp, Oryza sativa
tgcgccatttgcttcggcatctcccagactgacactgtcccctccagcgccagaggctgcagcagaggctgcgccactgctgtgagcgtcctggtcaggcacagagctgctgtcctgtagcgtcgattccagtgccgcctccccatgcacgatgttgccatgcacgttcccatgcatggtattctccatttcctgctcatgtgggggaccattttctccagaaacaacatcatcagcatcagacacaattaaattattactaggtaatggaatattagccactggtgtaactacatgtgtgccccctggactagtcgtattataatttgtcatggaggaaggcaatagaagaatttcagacctaagtcttgctcctgcatttgagtgaagagtagaaaagggaaatatattttcatcaaagataacatctcttaagatgtagacatggcctgatgacacatcaagacatttaaatcctttgtggtgagtactaaaacctaggaacacgcactgtttggaacggaattggagtttatgtgtgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgctgagtgtgtattgatctgacgatcaggttgtctcatgccctctagagggcctcctgcccaccttatatagaatggggggcaggattacaagatagaaacattatccaatacggtatcggtttcctaactctactttacaatcttatcaaaccaggactttaggccgttccgtaatatacaaggaaacgtaatacccaagtcataatctgttacatattccatacatataagttatcccctataactagtcggataaccatgccgtgtgggtatggggtacccataatctccacagtagcccctgagaccttcacagtcgaaaagataatcttctctcgaaccagattactccaaggccgagtacttcaatcatctttgccatggtctcccgagtacttttaccaaatctgaagactgtggagggctgaaaaataaagtcaggtgcatcgactagatgca

SEQ ID NO: 61676 - DNA, 562 bp, Oryza sativa
aaaattttttaaatctgaattgaatgttttcaagcttgacttgaaaattttcaaatataaatttaaactttcaaatatagagttgaaagttttcgaatcaaagttgaaaagattcaaatctaagttaaaagtgtttaagagaattaagcactcccgtgacgattttttttccggaaaaaaaaagagagaaacacgaacgggagtttggcttttcttcgtacgtgatgccgaaaacaagtgggcccaccgcttctctacgcgcgcgcgacttaggtaaagggcacgtacgcgctaattagccatccccgaaataatatgctatggaaatctgcattctgcgagcactcgaactcgagtactcgacggctcgatgccatcaaattgatatgggctactgggccgtaagcgattcgcacgcgttatcagatactgggctgtatgaggcccaatccacccgcacatcaactcagctggaatcgtgacgacacgactagcgagagcgagttagcgagcagagatccacggcccgcaacggcggcggcggcggcggcggccgaagccc

SEQ ID NO: 61677 - DNA, 2018 bp, Oryza sativa
atttttttgaagtttgatagaattcagagataaatataatgatatttttaacacaaaatgaatattctattaaaatatatttaatgatatatttaattaaattattttggtatcatatatgttgctattttttttataaatttgatcaaacaaaaaaacataaaggagttttaagagtcaaatatgaaaccgagggagtacaagatattgacatccttagttttgccaatccaataaaggtaagagaatatgttatccacgtgcctctcttaaatcaaattgatccaacatgcctctgcctcatgtaaaatatttttagaacttagtatccctattgtttcacctttttagaacgaaatactgatatatcatttccatagcctaaaaagaaaacttgttcggcaaatatatcatttccatagcctaaaaagaaaacttttttgccgggtcggcggaaggacgtcaaccaaatttctttaagataaaaagagggtaatataatatacatgatattacactgtcgagtcgaggggaaacctcgaaaaagaacgtaaaccaaatttctttaagataaaaagagggtaatacaatatacataaaaaaagagggtaatacaatatacatgatattacagagtcgaggggaaacctcgaaaaagaacaggaaaactatttaaggaggccaaaaacatgctgctactcctcgaaagaaaaaattccggccactcttcagatcagaggacctcctgatgtctgccaccaagtgttctaccaccctttctgttataaaaatctttacgtttcttcctttccaaagcttccagcagatcaacatgaacagagaatcgaaatccttacagcttccagcagatcaacatgaacatagaatcgaaatccttacgtttctttctttccaaagcttccagcagatcaacatacacagagaatcgaaggcggctctgtgcctttgaccgaaaacagagacgcacctgctgccaccattttggaagctgtaggccgagctgacggcaaataccttgtctttaaacacaattattaattcttctctagtgttcctatcccacaagaattattttcttactgtccttacaagttatttccttgcggattctcgatagattttggcactttgccatagacttatacacaccattactggtaccatgtatgaatgcgatcagaattcatgtctatgtgatccctacaccaaaacgcatcagtagtggaatggttttgcagggtgaaacacagcgaagaaaaacgacaatatccaataacatgtcattccaatcttaattaagattcgtacacgccgaatactagcgagaaaagaaaaaggtgtacaaacattcataagaaaaccgtacaactaggctgacaactgacaaagcatgctaaataagctaccgattgagaaaaataaaaattagctacctgacaggccaagccatgcgctggggctacttatttgttcctgatctcttttgttcaggcattgtgatactgattactactagcgcaccggattattggccaacgctgccggtggtgtcggtgcaggaaacactgaatccctgatccctacactctactgggtcaacagctaacagagcttaaaaacacaggattatctagtcggtcatcatcttcaggtcgggatcgtaacggccttgattcccagatagcgaccagctaacaggagcatacgaagaatgcatgggatgacctgaattattgaatgtgctgccattaggtcccatgggactccctgggtcatcggagtggtcgcttgatgatccatcagacggaggactggcagccgtggctgcgccaaagccagctgcgtggttcggcgtcggggcagatgttggctcacgtttcagatgttcttccttgccttttttaccttcagcaatgaaactccccactacaacctggaaaacagaatgtaacagaaggccaaagaaaatgctagtttagggcacaaaccagctgaaa

SEQ ID NO: 61678 - DNA, 731 bp, Oryza sativa
cattgatctatgactcaattcaacacgagttacacacaccagccaggtaattaaatacccacaccatgagtcatggacgactaatataaagttattattttctccctttgaaaaaatgcgagactaatgacagcgtcctcaatacatatcgaccatgggatgaagtagaacggaaatgacaaggcaatttcgtgggcccaccaccaggcagatggatcgaaagctgacgtgaacacggcccatatgtcaagctaaaaaattactcgcaaaacggaggtctcctttcaccaatcgggcccgaccacgagacccgtacccctccggcgatcatacggtcgagggaggaagctccctccgacgtgtcaacatatgggccgtccgtttgctggccgcgggcttcttcgtgtgggcacactaggttcctccttttctttttcttcgtctctgccaacgacagatcatcgcctgccatgaccaaaatcaaatcacatgtgcttttggtgatcacacgattcacgacgacggtgaattggtgattagcactaatgtttagggagacttatccaaaacgaatcacgttggtatgggtctaatcatggtctgcaaaccccttcttgcatggatgggattcagtaatcatggtctaaaggttactgattagcatctctctcgaaagacatgagtactcgatttaaaactttttaaagcaccgtgtgcgaagtacggcatga

SEQ ID NO: 61679 - DNA, 944 bp, Oryza sativa
atttaccataacgaaaacaggcatataacataccgaggaaatgactatggtaaaaacaagttatcccaagttaacccagacagcttttgtagcctaaaaaagcttacaaaaacagcataacacctttctgtcgggcaccttttaatttgcattgtaataattccaaagaattatatgaccgcgtaaaaaggattttatcagcattgggcaacactattgtgcgcataaattgccaaagcaaaaaatgcctaagtccctaaagagcacaatgggccacgctgttaaaagtactgggctgaggtactgttcaggcctaaacccattcgtacctccgatacccttaacaagaaatcccgagatccaagcgacacttcatcttccccgccggaactctcgccattttccccactccctgctacagtacagagctgcgccggcaaactacggttcaccattccactcgaatccaccttcgaaaagttcatcaaaatccttcccgtgatccaccgcctcaatccttcacctctccctagccatccctcgaatcagatcagcgcattcgaaaaaaaaatcaatggcggaagagaaagaaagctttgaatgccaatgggcgccatccgacgtgacggaggagaacctgaaggagatggtggcgcacggcgttctccctgccaagaaatcatcgggtggcggccagcgtgcggtgaggcttttccgacccccgatacacacgagactgtggtcttctcccatttcttctatggcggattcgctcttccgacctcaaaatttttccgcgggatattaagcttctatggaatcagcttgcatcacctaaacccaaattccatagttcacatcgacaatttcatccatgtttgtgaagccttcttgggaattaagccccacttcgctctgtttcgccgaatcttctttctcaagcc

SEQ ID NO: 61680 - DNA, 37336 bp, Oryza sativa
tggggagagaaaaggcggcggcgctgctagggtttcgccccccgtgtcgccagcgcgtgggcaacgcggggggggggggggggtttcttttttagtagtaacacatcaaactctagaagggtgggcagtggattcaaatcatgctgtttagtttttcttttctgatttccattaaacattcatatttgaagtcagttcattacagaaattcagaacggcaagcatttcacagacaatttgaaaagaaacactacttttgattagcaaccactaccttttcttgatcttgactaccggcaaaagaagcatatgttgtgctttatgtgattacccagtgaataagcaaaaatttcaaagagagctagcttaacaaatactccctccgtattttaatgtatgacgtcgttgacttttcaaccaacatttgaccatttgttttattcaaaaattttgtacgaatatgaaaatatttatgtcctgcttaaagaacatttgatgacgaatcaagtcacaataaaataaatcataattacataattttttttgaataagacgaatggtcaaacgttggacaaaaagtcaacggtgtcatacattaaaatatggaggtagtacaatattgtgttaactacagatggacagatggtttacatattgtctgtttctgctctgtacaatatattttcttaaaccataatacaataattcatattcaatcctatctcatcaggaaatctgtaaggcaacttgatacaatgttaataccggtatatatagatcttggatgtgcacactgacaacacaaactagtcctaatgaaaaattcagacatctcaataactgactactgagaaagctaaaacaaatgcctgtgccaaagaatttaacattttttagcaagcaatgtttcttaaaatagtgaactaaaagtggctgctatatcactgttcacacctatgaatcaggaagattcagtggtatgtagatctgtatcacatagctatcgctgttaatatgattaaacatagataagaattaaagcagagaaagccatacttacactcattctccagcagataactccactggtatgctattccttcgctagcctcctttgaagaatcagaagtaaacactagcaacctgtggttctttgcaaccatatctgtgacacttggccagtcctttccattagttggcatttctgagatagggtaccaatatttcgtcaagtcagcagcagtaaacaatttgctcaatcccatcgttgaatggacgtaatcctcaatgaatattgttattatctctgtcggattctcagatagaaatgcttccacctctttcaatgtgtcaattgctggttgctaacataatatttcatttaaacattagttttagagtgtaaacagactgttagcaaagataacgatgaatagattccaaaaagcaaaacaataaccaactcatgtttactaaacttatccaatacaattgattacctcaaaggaaatcttattgaaaatgttgtccccaaatacaggagacgattggaataacaaagcaaccagtgcaggacttcttatctaaattgcacgcgcctttctttaatctttagcacaaatctattttaagaaacattcgatcttaaagcaactttggttagtaatgataaaggatagttttgtactgagacgaatttatccttgtccaacatttttagttgttagtccagcatagttccactgcctttagattttacatggcaagggcctttcaacttttagataagaagtgtgcaattacagatttacccacgctttggtagggtttgaagaagtaccaatgatgatcaggcagtaggccttgtaggggctaattaatgcgtgatgtcttctttctgacagagtatcggcattcaagactagattaagatagtgtttaggtatcagagctatctgacaagaaaacaggtagaagatgcacctcaattctacaacaagcatatactcaccagttttcaattgtgcagtttatagggctgggcaaaatttgagctgggcattcagaaaaatcttagcaaatccaactaactattgtttctccatatttccctctaaactaactacttttgctttaggatgcacaaagattttaaaataggtgtactgaactactgaagcaaggcccgcccgaattatatttgaatttggcttttcctaaatagatatgaaatggcacatatctagttctagtatgggcaatgaatagaacttacaaaagcagtgaagttgtagcattggccttgcaaggagtggcagagccagatatcatcattgaagtcatacatatccagcatcaatcccctcactccattctgcaaacacccaacatccaaagcaagaaatatactcatcctataacagttcacatatacaggagtaagtgaagaatctggtcagagatccagaagctaccctcaattggttagtgacagtgtcctcctggttgtagaacgtgaccctctcgactccggtgtgcgacggctcgcctatgatggagaaggagttgtgggtgaccagccatgagtagcggttgaagggcagtcccttcacctaaacaagcatggatgtaacaacagaacatgtgagatgagaaaaacttgttgcacaacaggagagaagctgcagaggaggagaagcgatgagaattagtacaatggaggtaggctggatcgccaggtctctgatgcaggacggccgggtcttgccggtggcggcgcaattgccgcagtagaggccggcgccgcagtcgcgcgccgacgagcacgaatccccaacctgcatacataaccaacgcatcaagaagtgctggaacagcagcagcggggcaggcagatcgaattgggcaaagaagtagtagctcgagcaacaaattgcgacaagaatcggatgaaagaagcggttaatcgggaggagtacctggcaggagcagggaagaagcagcagcagtgcgatgtggagcgcgaggagaaaggggaggcccgccattagagctcaccaaccactccctccctctccccggccgcccaagccacggcgctcggtgggtgggtgggtccggctcagccctcgtcggcgtctgcagcctcgcccgcctccgccgccgcggcgctcaattactgatgccggcgtcgcgtccagaggggtgaaggagggggtatttgttgcgggaggttctagggactcctactaaccatgttcatatgattatggaatattaagcatgtttgtgatgattgctaacttaatggccatttaataagttaagactctgtaaaggcttaaaaaagaaaaggaaaagggaaagggtaaagactgtgggaaggaaatgggatagctttcggggtaaaaaaacagtcagcgcactagtgtatttgggtcgtgtttttattcatgtcagtgaaggttttttttaaagtcacttgtaatcgtgtacgtgcaatgcacgtcatgaccaatatgaattaagtccagtgtaatacaattgtaagaatatattctatcaaaaaccaaatttacggtggtatattgtccaaagataggatggacattttaataagtcaatgtaagtgaacatgtggaatccacataggtaataaaacatacatctatagtgtaatatttaataaattataaatggaatcagttaagaaacaaataaataacaaatgtactctctgcattttaaatatatgatattgttggcttttggatatgacatttgaatatttgtctaattcaaaattttagcatgaatacgtaaagatataaatataagtcatgcttagaaggacttttaagcatgacttaactttacattgtttttttaataaaacaaatggtcaaatgtcatgtccaaaaatcaacaacattatatatttaaaaaggtggtggtaatttcatgcgtcaaggtgtgacatcattttttgatttttttttatctgccccattgagtactacaccattcagaaaaacttggtgtaaatacaaattgttgatgttgtgtacataatttctaactgtttcctatgtgaaaagcgcgcgcgggggggagggggggataaaactgaaggaaatgcaatttcttagaatttataaccgtctcctatgtggaaagggcgtaataaaactgaagggaataccttgctctggttttaaactgcttggattttttttatagctaatttatttgacatttgtaaacaggatcccattctctcactttatcccaaattttgcacagaacaaaatttagagctctgctagattgctacaaggtgcagaccacttcaacattggtaacacttgattaattacaacagctggagtattgcaatgatacaaaacaccaaatgagaaaagagcattaattttacataagccaatttgttgtacaaatcatcttcatcatgtattgcctttccaccaactgaatcatgcattcttcacttcgtggattactgcattggtatcctacatcatttgtgtcattgatctgagcaatggtcaatgaaatcaccatggaaagttgtttccatttcatttctttataatgagtttcctatgaaaacatggtcacagacttattgtgctgaaaacaacttttctcccttcctcacgttattgccttttgctcttgcaatctgtatttcttttagtctcaaacaatggaactcacaaatggatcatcttttatttcaaaaaattcatagaactatagcttgttatgacaggccgtcctagtaaactaatagtagttcaacttgtaactgcgcatatatctcacactgaagttaggatccaaattatagctagcagagcagaagaatgttgggctagctgtttatgggcaatcagctagcagagcagaagaatgttgggctagctgtttatgggcaatcaacacaatatgccgtatacatgttaactctcatatgttcccttctgacacgaaatgcatgaagttgaactgatcagttgaatgccattgattctgacaaccgtatcattagaagaaatatctacctagtagctacacaagaatgtatgcgcatatatataatgtaacaggaattctagtgataggaagtatatagcaaaacatgaatgtcagttcatcaaattgcataggtgagattcagtaatgcctcccaagccagatgacaggtacttttgctaagttacggttgatgggctgaggtatatagaaagacaaatatattctgcttacccagatcgccatagcccatggccttgcttagagcttgataatgtcatggcacttggaattagcaagatcatcaagtggagctcgttcctgtagagacattggtagttgagacttgagaataacctataaagagtatggatggacacataaatgtataaatatatattctgtaaatgataatagtatggttcagcattttcgtaaaaaaaatagtatggttctgcaacttgaaacaatgcatataatggtattcgagcaatgacaaacccctgaattcgtcagtccgcttacaattccagcaacatgacaatctgcaaggctagaaaaaaggggatccattattatttaaaacaacccatgacaacaaagtgctttacctttgccatacaaagtgcataattttgtggcttaatcaagttgaggcactaaataaaacagaagcccgccccagtcctcaacgcacaaaaacaatgtgaatgttagatcggagcaaacaaaactcaaagtaaagcaagcatgaagcaatggctgaaccaacatggaaggaagaatatatatgtggtctgagagtaccaaataacataatcaatgggtcacttgcagtttggccgacctggcttcaacaaaaaaaggaaaatcatggtacaggccaatgctcaaggaagaagattagggattagggacttgatgagggaccaaggcggagctccggcagagatccggcagagatccggcgaggatgcggcggagcggcggcagcggggaggaggaggcgcgagcgaagaggccggccgcgtcgatggggaggaagaaggacccggcggcggcggctccggagtggccgcggaggagcggtggcggcggcggctccggcgtggccgcggaggagcggggaggatctcctgccaggacgcggggaggaggaggagcgagcgaggaggagtcgaggagcgacgtcttcgcggcagcgggtggatgaggacggaggagcgatgtcttcggcgaatcggcgtgcaagccaaatcgtgcggtggaataagctgcgcctggatggacggtccagattagtccggatgatttggcctgtagcattggagcgggacaactcctcttttttatattatagtatatagatgatatatgtcgcctgtattgagcatcagggagagattagaacgagacattgggtaaatcatttccaatattagaatttatgattttaaacacaaattttgctccaactgtatctctaaacatctcctaaaaattaggcgttctcatcactgcgtctctcgctctcaaatcgatctgcgctttttccatttatctcagtgcttcttcccattgcgatcatgaaatgctacagccaggaacttccttgcgaagtcatccattgatgccgttgtactcatctccactgcaatcaatcataatagagttgcatatttcttaaaccccacaaccggttggcagctcccttcttctgaagagagccacgagtagcacactggggccgtaggactcgttgtcgctcaccagaccgttgttgtttccaccattgctatcgcatttgtcgaccatttcggacccaccggtgaggtaatcgacagacaacttgccaccaacgccgaggccgttgtcgatgtgcctaaaatccagttatatcgacttgcagtcgccatctaccaagttcatacaaaggcaaattatcctcaattttaaccaatctcttgaaggtatcaacatttttatatcttaaatcttgtttagggttctcatagaaaataatttgggtacaaaatatagagataatgttgatgatgctcttataaccacttctatttttttcgagactagcaaaatgcccatgcgttgcattgggtttttagataatggaatgaaacatcccggcctttactccgaagagctacaaccaattattataaaaagtaacacacttataaagtcttaattcaagataaaactatcaaaccaaccaaaattaaaagaaagacctaacatgacaaggaaaacattattccagcctattagaaaatctccatccatggttggcaaaaagttgtataaccgttgactcaagagtacgacatgcaacatttaggaaaactccatcttcctcacacttttatagttgagcccacagccgaagccaatatgttgccctgaaaattacctgcatataggaaacagatggtgatttgtcaaaaaccctatcatttctacataaccacagggcccaacataaagcagaggcaccaacaagtatcaactttctcttgtccttgtccacaccctgaagccaaccattaaacatatgaggcatgcttctaggaagatgtaatccaaaagaaaattgaacagctctccaaataaactttgcataatgacaatccataaacaagtgttggatcgtctcatttttcatgcaaaaacaacatgttaaacccccattccaattccgtcgtgcaagattatcctttcttaagacgactcccttgagcaaataccacataaagatcttgatcttaagcggcatcttaagcttccaaatgaacttatttctatcaatgtaaccattgctaattgaggctaagtacattgactttaccgaaaaatggccattttgatgataattccatctaaaacaatcagtagaatcatccaactggatatgagcaatggaagcacacaaattataccaaagtgttagattctgcccaactaaagctctcctaaaagaaacatttagcggaacagaacccataacactagcaatagaggcactcttccttctgacaatagcatataaagatggatacttatctttgaaggctatattacctagccatttatcatcccagaatcttatctgttaaccatcattcacaatccaagagcccatacttaagaagatgttttttaccttcataagccctgaccaaaaataagaatcaccttgtttcctatccacttgggttatagatttattatgaagatacttcctcttcaataaatcttgccaaacaccatcctcattaattaacttatataaccacttactcaatagacatttattttggatctctaaattatgaacacccaatccaccctggtctttgggttgacaaattatatcccatctagttagtctatattttttcttatggtcatccccttgccaaaagaaacatgatctataataatcaatcttatgaagaacccctttcggaatctcaaagaaagaaatcatgaacatagctaaacttgaaaggacagaattaatcaaaaccaatctacctccaacagacatatgtttacctttccaactactaagtttcctctctattctttgttcaataaccttccaatcattattactcaacttcctaaaatgcattggaattccaagatatttaacaggaaaagagtctagcttacaaccaaatatagaagaatattgatcaaggcactcttttgcctgcccaaaatagaatagctcacttttgtgaaaatttattttcaggccagatattttttcaaacacagataaaatcaatttcaagttctttgctggttgtaggtcatgttccaaaaaaattgatagaatcaagaagaaaataataattagtgtgtggaagcataaaaccaccaggttaattgaggtctttatagtcgaatcgaatctttccagtgcaaataagacgctaacatgatataattatttgctgctctaaatccactgacatggatactgaagtttgaaaccacaaaaaatatttactttttttgtcatgtattattatgagtcaattgcagtactttgttattttttggcactcgatattgataaacaatttttttcatactgtaaagagtagccataatccaagaaatatttttttgctagctatcagatcaacctcactgcactccaattgcataatcgctcactcaaataatcagaaggaaagaaaaaaatgtggtatatcgcagaataactttcactctaaataataaaagaaattataccatgaaggaaaaaaaagtgatgtgattaggtgtcctatgacgaatgagcaattgatgagggaaaaaatccagatgttaacacgattcattttgttggtgattatttgttttctttttaaaaaagaaagacacatgtgattattttttatattttaaaaaataatttattttatcggtaaataattcattttgttggtgactacatgtttacatttataaaattgcttttttttatccgattcctggttggcgtgagtccaaactttattcctgttccgttgctacagtgttgcgcagtactgtgctgggctgctgctgctcctccgctctgtgggctgcggctgctctctgggccggcctgctgttgctttggatgggctgactcgtcactaatccaatacggactgctttagatgggctgctcaacaaacaaggctttctcttttttttttctcctttatttgcgggcgtaagagatcgtggccacgctttcggattgtggattagcgacaaaatattgtgtggcccactctttaatgacggacgaaaagattaacaggaagcttttcttatttttttaatcttatactagcaaaaatgcccgtgcgttgcaacgggtaaaaaaaaaatccaattacaatatacacttttcatgcataaccatatcaatatatttgtatggatcgttgtaactaacataattagaaaattagaacatcttcatataatgacttaacctcgatgatggcaatcttaccaatacttgctttatctaaaataattggattattcatgtaacaacatgcatataatctagaatactctttcaatcttattcttgcaaccaataataggttaatcaaatcctacactctgggtcaagtctacacaaaatagtcaccgtgcacttttctctaaataacaattaaaaatatgtttattttttaatattatttccatataatatgttattaagaatagtatctatacttaacaaaaatagtccgataatcataattgcataccagagattagatgagatgaggaatcaaatgatgtgtaggagatagaaaaaaaatcgatggatcttatccgacccaagcatatatcaattttatctcgcattgagtcggacggtttttcggtttttcagagcggttctttatataaacagtggttttttttcttgtgttgagtcggatggttttctctgacttttttttagaaaagcggttttttttctcgcgttgagtcgaacggttttctcgaatcgtttttagaaacaacagttttggttttttctcacgttgagtctgattgttttttggatctgtttttttataaacggtgtttttttctggtagtttttttcagagcggcttgtttttttataaacggtgattttttcttgtgcggttttctcaaaccatttttagaaatggcgtatttctttctaaccgtttttaatatcttcttttttttttttgctttttcagacaaaggaaaccgtattttttcgagcgttatttggaaactgtttttttcttgcgcattttttatttttagcggacgatggaaacttctctcgttaagaagttagattagattctggttttgcggtcttcttttattctcgtgagtgatccggttttttccccctactcttttttttatcacgaacgaccagagcgatctgggagatttttttttctccgcgtcaattaatgagggtccgacattccttttttcttttctttttgcatttttctctccgcgttggacagatttggtttttctttgcacattttttttcgcccgatttttttatcggacaattttgattttttttcgcccggttttttctggatcagacggatttggtttttcttttctttgtttcgcactttttttcgtccggtttttttatcggataaatttgatttttttgtctagatttttttttgatcggacaattttggtttttttcgcccagttttttttagatcgggcatatttggtttttctcttctttttttcgcacgttttttcgtccggtttttttattggataaatttgggttttttcgaccggttttttttcggacgatggaagccattcttattttttaaagtagtagagattataataactaattaaaagattcatattttttctttcgtcaccaaattttcgttcgtttgcccgattttccactcgtccgtgcgatccctccctcctcgagtccgagtctgtcttaaaaaaaatcccgagctagatccccaaatcaatcagtcaaataaccaaaaagaacaagaaaataccaatatcgacctcataaatttgatccccacaataaacctaacacccatgtattatctccctcccaatccaatccatctgagcgacaataaaaaacaatagaaaatgaatcacaaatccacaaaatcacgaaatcacaaatccaacaacactaagttacgtcgggttgcaggcgacgtgtggcggcggaagtgcttggcgcggtcgtcgggcttctgaacgagcttgacgcaggccagcggcaggaactacatcagttgaaggccaacggtttttgagggcagcattggcggtgactcaccataggtcccgaggggaggcggtgcggctctggagcccttccgctggatctggaggagggagggagcctccgggcggccaccgctcctcccgccgcgcgtcgccgaagcaaccgcacggtgctgccgcggaggggagggcgctgtcatcgccgccgatgccacctcccgccgctgggctgcaccgtcttcacccgccgccgccacccgtcgcccgccgcctcccctcttgcgccgccgcctgccgccttggctccgccgctccgagagagaagaccgagagcaaaacgagagagatgatctatgtgttggaattaatgaatgggccttagcccactcgaattgttggaattaatgaatgggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgctttggaaacgttccgaaaaatccggtgcgtgcaaacggcgtggagtccggataagttacgcgcgacttatctggttcggttacgcgcagtagagatcgtgcgggcgccctgatcaagcgacccttctctatataaaccgacctgccgtcttcacgcagcacacgcaaaatcaatctagggtttgcctcctactatgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctattcgttcgcgacggctcgccttcctcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatagtaaattcggtgctactgatgctagcaatgatctgtatatcatggagcagtttcatgactacaaaatggctgacaaccgttctgtagtcgaacaggctcatgagatacaagccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcggaaaagatcgtgcagctgaagaatgtgcagcatgtcccttctatcgacaggaatcttgttagtggctcccgtctgactagagacggatttaagttggtttttgagtctaataaagtagtcgtgtctaaacatggatattttattggtaaaggttatgagtgcgtaggtctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgccgaggagagaaacttggcaccactagaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagatgacgcctccctattctcccgagtctaatgggattgctgaaaggaagaatcgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatagagtctcgtgatgctatcttctttgagagctttttcccaatgaaggatacacatagtggttcgaaccaaccatctgaaataattcctagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagattactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcgacttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctaaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcagaaaattaagaaactctggagttataacgttggattacatccaaacagcgagaaacctggcagatcccttcacgaagggactatcacgaaatgtgatagacaatgcattgaaggagatgggtttgagacccatatgagttatactatggtggtaacccagtctatgtgatcggagatcccgtgaattagatcctgagaagaacaaaccattagtaaactagaggagagtatcaatatatataccctctccaagtgaagatgcatgtactctcgtgagctgcaaggcagattggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggaattctaggtggatgttcaaccttaattggtctccatcgaaccgctggtatataaacagtacattggaaaaggcaaatctcagtgggattttgagatttggtgggggattgttggaattaatgaatgggccttagcccactcgaattgttggaattaatgaatgggccttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacgcgcgcgctcgctcgcctcgcctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgtttttgctttggaaacgttccgaaaaatccggtgcgtgcaaacggcatggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgtgccgtcgctcgtagactactccatcccgctcgccggcgtgcaccagcgatcgggagagcaggtctccggaacctctgtctttgacgtcctgcaccgggagaaggcggcaataaggtttttggaaagcgcttcgcgcgactgctccctgttcgttcgcgacggctcgccttcctcttcgctcgcgtgtttcgtgccttcgtagacacctgcgaaaagtttcgaccaagcagccggtcttttcgtcaccttggtacgtgttcaatatgttgtgcatatttgatctgttcatgttatatgttatactgtgtagtttacatgtgtagatctaatgatgcgttcatgctagttctcatatgtaatgtcatgatttatttatggaatagattaaatcattatatgtctataatctcaacactatgggctaccgccgcctcgccaccaggagcaacaaggcacctccatccaccatgtcgatggttggatcttcaggccgctgccgccgtccccaaagtcctcatcgccgatgactgctacctctccatgccatctcccatcagctcggctacatcgtcggccacggaatctccacggcctccacatcgacttggaccaggatcctcttcccgtcgcactctgtcggcaccaccgcctgccatccgctgaacgcccccttgaccggtatagcctcccctccgtttccattctgtctgtctctccctctttctctctgataaacggataggaacgatgagtggatagataagaacgatgcaagagctcatgagtccatagacatggtctatggaccattgacgcatgggaggagacgtgctcgtgctgcactgccataaccattgttttttttttttgagaattccataaccattgtttgctaccagtaattgctactactccaactgcttagtaggcaccgcttttatttttttctattagggatctaggccttatctcctcagtggcctaaaattatagggggctataatttttttttgatttcaatgcttgtgttatgagcgcgtttatactatgggtgtgtttagattctaacaaaaattatcaaaaaagtcatatcaaatgcttggacacatgtatgtatggaacattaaatgtggataaaaaaaccaattgcatagtttgcatgtaaattgcgagacaaatcttttgagcctaattacgtcataatttgacaatgtgatgctacattaaacatttgctaatgacggattaattagggtttataaattcgtctcgtagtttaaaggcggaacctgtaatttattttgttattagtctacgtttaatacttcaaatgtgtatccgtatacgtcaaagtttttacacccaacaaactaaacacggccaatgtatttctaatatatatatatatatatatatatatatatatatatattggcaatttaaagtacattgagtataaaaattccacttgtattttattagacttacctacatacaaataaatatttttcttcatgatacaaattttcatccgtcgcctttttttagcagattagttgtctaaactaaataacaatttttatcactgtacacacttcgtaatcacctggtgcaatgtacggacacttttgctagttagtatatagatacagatatagatatagattaagaaggtagacaaataaataaatgaggacttgttatagttggttgagatgaaaaattattgaaaaaacaaagttagttatagttaactaatatgataaaatagttggagaaatgataccaaatttgaaaaataagtagttatatatttggatggagggagtttataagacaaatataattaaaaataatttgtaacttggagccgcatttaaccatgacattaagaaattttaactaggattttcaaaccgacccatacatgtagggatgactaggcgctggtaaccaattatctagggccatgagaggatttttagacaacctaattaattatctagggtgccaatggagaaaaaaaaacaagatacatatggaggaagttttatcagaaaaatgaaaagcaatcaagttgggccgggccttctcataagcccaaatcgttggaccattaaagcttgcccacctccctctctatctctctctctctcctccctccccagcagtgcagcagtaccacgcgcggcgcgcaatgccgttccttagccctctcgctggcgatgacgccgacgactactactacgcctacgactccagattccgccgaggcagcggcggcgggaagatcgccaagaaggaaaaggacaaggacaaggacaagggcttcctctccttcctcccctgcttcctcccctgctgtaatcgctccttcccgattcttgatttgcggattcttgattccggtggattcttggctcatcgctgcttggttcttggcaatcagcgcccggatcggtggaaccgacggtgcaccgccgcctcctctcctccgactccagcgacagcgacaacatcgccaccgcggacatcaccgccgacctcgcccgcctccgcgcccgctactcccgcctcgccaccggcccgcccgtccgcccccgcgacgtcccctgcctcctcgcgcgcaccgacgacccgccgctcgccgtggccgcgctctcctggctcggcggcgacctccgcccctcctgcatcctcctcaccctcctaccggcgctcttccccaccctccccgcgcacgcccgccacgcgctctccgccgccgcgcgccgcctccacgcccgcgaggccgcgctggacggcgaggtcgccgagtaccagtccacctacgcgatgaagctggcgtgcgagaagaccaaggacggggtggcggagacggcgggggaggagatgtgcaagatggcgcgcgcggcgcggcgggccgacaagctgcggtggcgcgccgtggaggccgcggtgaaggaggtgctgacgccggcgcaggccaaggagttcctcaaggccgtcgaggacgtggcggccagggcggcgcgccacggcgcgaggtggcacgcgcgcaccggcgccgtctccgtccccgtcgaggtgttcgaccgcatgcgcgccaacgccagagcagccacggatgatgcttggtgatcatcaacggttttcattcgattctccactagttttgttttgtttggacaagagattcatcgctagttttacttcagttcgaatccttctgaaagcttgggctgaaatcggccaaaattgttcatgtttttacttcacttctttgcacctatatactgtattcctgtctctacttacagagagggaactatacctgaaccattgttttcgaatgaagtttggatggattacacctttacagattacagtgatctctgctgacaatagtttgttctcgcatcacttgaagtttgtcagggcagacatacaaattgtgtgaaactcctctgtgcatatcaatttggtttttgaattgaaagtttggatgatcaaagttcattttggggtgtgatggtatcaaaatattttggtacaagtttgttagactatgtgagctgtaaatgtcacattctattagttaatggtttgctgtctagagttacttatttgttccgtgaatgtcacattgctgtgtgctggattgcgttgcctgtgttatacacagaacaatcggcttcaaataatatgatctgcttcatcttgtcgaaacaagatttcggcgatataaagtgggaagcgcacgagacctaaaggtggatggatgcgaggataaaagatttagacatgttcaggccctctcaatgagaggtaataccccactcctgtttggggatttgaatccaccgggtgtgtattaatctgacgatctggttttgaatcatgccccctagagggcctcttgcctaccttatatagcaggggggattacaagatagaaatcttagcctacgatatcggttttttaaatctactttataatattatcaaatcaggactttaggccgtttcataatatacaagaaaacgcaatacccaagtcatgatccgttacatattttataaatataagttatctcctataaccagttggataaccatgccatgtgggtatggggtacctataatctctacagtaacccctaagaccttcacagtcgaaaagataatctttctctcgaaccagattactccaaagctgagtgctttaatcatctttgccatagtctgccgagtactttcaccaaatcagaagactgtggagggctaaaaaataattaaatgtaaacataggtgcatcgactagatgcacctaataggtgtagcccccgattatgtggttagttgaacaaaccaagcatatagtcaaggaataaataatccaaccaactgagtggtttttgataattatagtcatttgatatcaatatatagcatatgcggtgtgaaccccccgaataacatgatccgagtgatataccgaccgctttgtaaaatatgatgtgtgcaatctaaagttgactacatcattaaaaattcacatagcaaaacagttataaagaagcctatatgctgtgaataaagaattttccaaagtattggcacacgccatacgcacactgttttaacagatgttcttaagtcactaaaagacacatggtttcaccacacctagaaatatatggcatgttcttctcaacaagaggctggagcgatcgttgccaaaatttccgactagatcccaccaagagactagccaccaattaaattgttctgcaatcgggcatcagttgccgagttgtttccctgctcagctagatttgaagcaatcagcaagttgtcattatttgtcgtttcgcctgtttcgttgagtaatcatctaagccgggcccacacatatatctacacatgcaagcaggaaccaatttcgtcggcgtcgtacatctttgcttgaacagcgacacggtcttctcaaaaatcttctccgactcgggaccatggccaacacaaagcatctcggccgactaccaatgggatgtgcatgtttaactgctgctgcatgctgtcatacagacagacacaagcagccgattgctgctcgagctcatgcgtctacaggcacatgcaagcaggagaactccggccgccaagcacaagtctgcaactctgcataggcctctcaacttacacgggaagattgccacgcctacatgttgatattttctgttgtgtatatcatcgccggccgagtccgatctcgccatgacaaccctcgatcaaaccgtatgctagcccaacttatacttggacacaatacaccaaaagcgtcagcttgcaacgggttttatcattctgatctaatctattacctattatattaattatttttattttccgttcactaatcacaagttaacgtgtgctctattttttcatatattaatggccgagttcgacattcgacgactgacaaaagccaaggcctaggcccaatttcaactcggctaacgggctcagcgtggcgtcagggttgactgaccacaaaagctcaacggtgaggagattgtctttatacgcctgtctaagatacgagctggcgccgactcccatgcagtttaaacatctagcggagctgctcttcaaagcatctcaccaccggcttgcttccgtcgcagccgactggtgttcttgcctacacggttggttggtcataccaccgttgatgggcatcttcatcatcaccgaccagttgtctcatctgctgccgactggtgtcttcatctatatggttgattggtcacaccaccgttgataggcatcttcatcatcatcgccggctcgcctccgtcgccgctgactggtgtcctcgcctatacggttggttggtcacaccaccgttgatgggcgtcttcgttttcactatcggcttgcctctgtcgccgccgattggtgttttcacctatacggttggcggactccgccatcgttgatgggcctcgttatctacaccaccggcttgcttccgccgtcgccgactggtgtcttcattgttattgatggacgactgttcccacattggtcacccctacatggtgcgccaactgtcgaaataagatttcggcaatataaaagtggtagcgcacgagacgtaaaagtggacggatgtagagacaaaagatttagacaggttcaggccctctcaatgagaggtaataccctatttctgtttgggatttgaatccgccggatgtgtattgatctgacgatctggttgtgaatcatgccccctagagggcctcctgcccaccttatataggatggaggacatgattacaagatagaaaccttaaccaatatggtatcagtttcttaaatctactttacaatattatcaaaccaggactttaggccgttccataatatacaaggaaatgtaatacccaagtcatgatccgttgcatatttcatagatataaattatcccctataaccagtcggataaccatgccatgtgggtatgggataccaataatctccacacatctaatatgccattctaccaatttatgcaaatgttgggttagattcgcatggaagcacgggatttcaacttcgactgatgtgtaggtcccacctctacacaatacattttggatttttgattgtctatttaatgtaccaatcaagaccatttgtacccgtggaccagttcggtgaaccatgtcaatggtgaactagatgaatgatcttgtcacaatttctattcgggtactatggtgatatttaagtcaaggaatatgtagagattgtggtttgtggggaagatctctacaaaatgtttaaactattcgaaatgttgtgccctttgcccctttcatatataggcatgcgtagtaatgtttgtcatgcttatatttgttttccaaatcagggaatagtagatcctgatggtttaactaatacctcatgctcagttgggtaagcatgggtgtgcggcctgcgatgttacctagtgcttttatataggttagaatcatggttattattttatgttttaatctcctaattgtttaaaatgtggctttgtgcaaacgaacttcaaatgccttccttgtacctttataaattgcaatgtgtactcaattaattgatttgaagatggcttgaatagagatacgtgcatccattgttcatctgtagtaagtactatttaccatttctgttgaacatgcctatgataaccaactttgtctttgtgtacctcatatttcatggaatagtattatactaagacccttatttggtacacactaagccactctaaactcaatctatcaccaaactagtgaagaaaatgatcacaattaactcaatggtgctcttggactctctcttcagttacacacctcaacagggttccaaacgatattagggagttgaaggcaatagatatttatagccccaaactagctgactagccgtttgtgactgttggacaaaagcagccagatatcaagcatggtaaacagcccgccaccggtccgaactgtacggtcccttgcacttttccaatagtcactaggcaagtagccgctgggctatcaagcaacggaaaatccaatatcattcggattatctgggaggtcattgttcgcacaatgtcagacagtccactacagttcaaacaaaattgactcgcaacggtcgagtgggttggcagactgtccgtcgccctagcaaattttctactgattgccagagaattgggtagtggacaacccatgatctgccggttagtccggccagtcccttgtcaacacatgaccgtagttggatgatgcattggtaggaaaatttggcaccgtagccgattatccgcctaagtagttttagcggtcaagacaagtctagcatggattattcggcatcactcagacaatccggctagtacagcttctgggtgtagtaaaacttgcacacgatcaaccacgaggttttactaacttgtttttagcacttgatttgaaagactagcaacctagtgtgcaccacacctagattctagcaccacaccttgattctagcacttttgaaacttcaagctactaacttccaacccctctttatagtacggtctttaacctaattgtactgtatttgccccaactcctcgaatgcattactgatgatcgggttgcgatagatgatcttcttcgttaacatcctttttgcgggtttaggaaacacatccaacacaataggcactatatatgatttattttcagggttaccatccgccgttaccatccaacacatagccaacacaatcctttttgagggtgtagatgctttcatttttcatatatgaattttaaagacaaaggcactataggccacacattgtgtaagtttggtgtttggtaaatattaaaatatcattatttgtcaaccataatagtacatccatgatagtaggaagcaaaatcgatggaccacatgcatgtaaacaatagaggcaaacatatggtgagctctgtcttttttgttgctacagattgatgatcttcaaaaatatctctaactctatctggcccaatatccgaggggatcgcctccctatttggtatagatgagctcacaatattcaactattagttatgtagaagttatatagagaagatgcgacatcgattggtgactcccactttccttagccatgctctggtttgaagagcaaaccaaaattagtcctaatagggactatgtcttaaccctaataatttagtccctttctacgatatttttatggcagcgagatcaaatgtcatgcaaatcaattgatagcagtaaggagcaacccaatgattgctatatcatgtatggacaatctcgttttagcaagacaacacatatattgcaaatcattttcatgactaaacttaatgtgtaaccttccacatggagatctgcatctatcaatatagaggttcttcataaatgttggacaaggagctgataaataattgccatacatctcatttagatgaatcgagaggaggccgagtggtagcagtggggtttgtaaggattaggtcatggcaacaagaagagatgcctcatcctcttgaatccttgcacattgggaacgaggagattaacgagatagtatgtgggtggatggcatatattcaataagagattagatgtcgggctttggttaatttaagcaattttggactgcaatagctcccttctctaacttgaaacagccctgctattgagaacaatggaggagaagatatggcgagttattcccttttcattgacatagattgatgatcttttaaaatatctctaactctatctggtcttatatctgaggggatcgcctccttatttggtatagacgagccaacgatacttaattatttgctagttatgtacagcgaggcgcctgtggtgacctcgtcaatctcaaggatttgccggcccagtcttcaaagatgctcataggggtagggtttgcgtgcgtgcgttcatagggggtgagtgcgtgttcgttgtgagtgtctgcgttgtactgtgtaattctcaaaaaaaagttatatagataagatctgatgtcaattggtgtgtcccaccttcttaggcatgtgtgggtttgaagactgaaccaaaaccgatcctaatggggcctacttcttaaccctagccattttgtccctttggttggtcccacttttaattttgagtcacgtgctgacttgatgactgaaccaaaacggatcctaatagggcctatttgttaaccctagtcattttaattttgtgctagcaagatcaaatgccatgcaacatgattgatactagtaaggaacatggcaatgattcctatatgatattattgctatatgatagtattgacaatctttattgcagcaagacaggatatgcattacaaatcactttcatggctgaaccaaaatgtgtggccttctatgtagagatctgcatcgatcaatgtagtggtccgttgaaaacgttggacaagagttgataaacaatctccatacatcacgtgtatatgcatcacgaggagagtggcattacatcatgtcagggctgtgagctactatatcctcaaaaacgcgttatgtatactatggttagcagtaacataaaatataactgatcctatttcccatgttaggagtgtatggtctagtagcacataacaagttttccaacatatataaaataggtattacagccattgcgctgtaacacatattagatgttaccacatacatgctagtaacatcatgttataaccaaaacaccttggcatacgaccgacaacacatatctttaccaatagcaacacaagtaaatagcacaattttaggtattagtagttttttttaactgtagtaacacataaggatttgattaccaataatgatttaattaccatagtgattttgaaatcaatccttttcatccagaaatgtacagtaatatttcaaaacatctcttataagcatcacatgtgtctcaaataatacaagtcaacatgataaaccaaattgcataggaaacaaagttaatgttatttgcatcaatacatagaccagtcttgaatgtgtacaatttgtaaacaagattagggagtatacgtatttctatactctttataaaattacttaccttcatccactggtgagataaactactgaataatcattttttctccagatcaactgatcctctacttgcatatgcatacaattgcattatgtacagtactacagtacaaatcttgaatttgtaaaatttacagtacctgcagttgatgaagacaaagatatctcaatgttagcccatagaaatttacatgaattgtatacatcaaagaaggacttctctacacattgaattaaaccaaagaagtatctaagacatacactgcaattgttttggctaaaaaccaaaatctctaaaaggctccattattttatttcttattagcattgctgtgctaagggagaaaagctgaaaagagaattcaaaaattttcagaaaaaaataatacttttctaggaataagacctagcagactttcgcacaattgaggaagagtataaaggcagatttttaggagatattttaatcaaatcgcattgagttagtaaaaaatgctggatgaataaaaactttccaatgaataatgtacaattcaacactgcacctttggcatccattgcctatgtggatcatatctgcatttgcatcaatttttatttacctgaaaccatgaaggcatgaacttgacttatgaagaagacatgcatataggttacaaacaaagaacgctagtttgtattgtttctggtgcccgcccctttgcagttagaagaaaattacaagagttttagaaatactagtactacgcccacacattgcaatgggatctagagtaatacggggtgggaggggtgggccattcggttatttggcggcgcacaacgtggtaggaggataactgtgtctttgaactttgaagtagtagatctagataattggaactgaagcaagtattagtactacaatattaccatgctagatctcagttcagtaaactaaacaacatggttgtcgctccaaaataatgcatgtaagcagcagcattcacctagcttactgaactgtgctattattattaccaaattagagatcagttcagtaaagaaaacaacatgtcagttactccattataaggtaagcaacctgtagtcaaggcaggcaagcaacattcatcgattcacccccagctttgctggatcaatctatctaaaacactattttgcaggcttgtattaggatagtaactctagacatggctgcttaacatattgcaggtttctcctacggtcaacgaagatcagcaacatcacagttaacgatcgagataatgattattcagtaatagaagtagacatgctcataactatgacttgaataggtacatgattgtagtgccaagccgcagcatgtggccggcggccggcagcaggagggctgcacggccctgaggcggcccacggatggcgggcgtggtggcactggctgcggcaggcatgtaggcaggtcacatgcagcaagaggtagctggcaattcagcgagtagcagctatcaagaagagaaaatgttatgttctctcacaattgaaatctgaaagaaatggcatgatttcctgaggatctttttttgcagcgagcagcaggcaatgtccagactctagagcagtgtttcttgatttcctttggtctggggagtaatggttttgcgctgttgcaggcatgggagattgggagggaggaaccacgcgcggtataagctagcaagctattgtgtagtggaccggagcgtatacttggtgactgaataaaattaacgaatcaccaataattctccaatccatatgctaagttaccaaaagccagaataatatttgatccccttaatttctcttgtgaaaattaggattgctcctggagtcctgtacggccggttccttcacccaaacccaaatgcactcgtggcagttggtcctgttgggatacgcgtaggctacgatagcataaattaaaattttctatcgcgtaaaccaggaaccatgtaagtattagatcataaatcgttaccactcgacgcgctgcgcaacggaagaagacgctgagaagtcgaaggaactctcgcgaagtagcgcgcgtcgatgtagaggaagtagtcgatcgcactggctcgaccttctcctcctcgtgcgttctcctcgccgtactcccatgccgatgtgctagcacccgcgcgcggctagggttttgctcggggagggaagtgatggctagggtttctcacgtgatgcaatgcctccgccggtcacacccctcacaaatatataggatccatcactcgggtctccaaggcccgtaggactcttattcggatccctatccgaattaagctcatattggatctccatccaatccccttattccggcccattaagcgtgcgaccctgtaggttcatatatactcggctgtaacccgaaaacgccttttcggttcacgcgtcaacagcggcccctagcagaacgtattgacccaccgggcatacataaatatcatatcgactgaacctctagtgtctacttgtataaacccctttgcctcacgatatcgattaagctcaaggctagatatgtgccatcctctaatagctcaatcattcactagaacctgttgatagattatatatcttgtgattgactcctcaatcacctttggcatggccatgcacttccataatctacaacatcgaggggcccagagatatctctccataggaggggcaaatcccatcttgattattcgtatcccactacatgtttcatagcatacccgaaaactacttttataactacccaattacggagtagcgtttagcagtccctaagtaagctaactacacatgttgggaaccatgataatctcaggtctaaggattcaacaccaacactaaatgagataactgatgacacaacacatatggctcttacagtgtctcatgttgggtctatccaacaacatgttcactaacatgtgtccacattattaatttggtatctctataccatgatccatgagacatgatcatcaattaatacatgtgctgatcatctaaatatatttattccacatgtgtgatacaatcatctctatgattacctctagggcatatcactaacaggtccaagcacagcaggtgatagtaagcactcatttttttttggttccttctctgtcgatctgttgcacaaaggtcaaatttcatcccttttttggttttctgaacttatagtgaatcactgctgatgttatgaaaatttgtttcttctttgtttggaacatgctgtatattaagattttatctcacttatatgaagtgcttgaatttgtttgaagtttataaatctcaattgtgatgatggacatatcgacttgcaattttctgacatatctgaactctgaagtatgtattactgaaaatactgaatgtgtccaaagtatataaatctgaatggttacatgggcatataggctggcaatattttctgacatgtgatggacatatatatcccaagtatatcaaattgtgatttgtgagtaacaaatgtacactatatataaattttgcggtttggatgagcatatttgtgtgaagtccatgattcgccttggtaattagggtcaaagtatgccaatgtgcggtcatatataattaattttacttgtatacatgtattcacactggtggagaaatgatctttactgggtcgacccaataccacaatagtcccagttccaaaaagaaccgggactacaaatgatctttagtcccggttgaaaaccccagagccattctatgttaccaaccgggactaaagatccaaccgggactaaagatcatttgtagtcccggttcatccccctgtcagatgaatgtcagggggccgaggatctttagtcccggttggtgtcaccaaccaggactaaagattcctctctttagtctcggttggtaacatcaaccgtgactaaagatggatctttagtcccggttatttcaacagggactaaagatgcctatctttagtcccggattcctactcctggttgaaaacccgggactaaaggggttaccaaccgggagtaaaaatgacttctccacagtgtcagtactgatgattgacacttgtgacttcatcagcaggagagtatatatagttgctagttttctgagcaatgactcgggtttaatttgttttctgtatcaattgtcagcattctgtaccaatgaatcgttcctgagtatatatgctactacgtacagtagtctacagaactattaggtggtgatttgccctcttttgtgcatactgtacatgtaaaattttatggtcatgccttgttgtattaaaaggctaatatttgtcatgcaagcaattttttcattttatttatcacagtagtgtgttggctttgtttgaagaatttactcatgggaaactactgttaaaatttaattatagacactaatcttgagatcactcttagcttttaaaatactgattttgtttgcaggaatcagaagtacataagcaaagtaacccacagtagttatgtgagagaatccatgttatgaagttgacaggaaattgtgatgtgtgttttggagatatgtgcaatttttcctggacctcgatataaacaaaaaaaaaacattttctttctcaaggatgatgtatttgtgctaaatattttgatttggggcaatgtagtttggtgacatgtcattgagaagaatgatcatgtggatcagtttagtttatcacttggaaaaagtgagcataaatttatggttctgtttggaggcatgttcttgataagagcgaacatatctcatctcatctcatcaaatgaatggggaatgtttattctttctcacattaagccatgtatgctagactagatgaactgttggatttaaaaagaacggttggatatatacagagaataggaagaccggaagaatcaggagatttcttgggagcaggcctaggattgtgagtaaaaaaaaatgggtaactttgatcagattaaaaagaaatgacccagaaggtgaccattaaacagtcccgctgttcatgaaagagagaaaaaggaaaaaatgtagacttccttaggagaaggcctaggactgtgagtaaaacaatatcatgggtaactttttgatcagattaaaaagaaatgatccaaaaggtgaccattaaataatcccgctgttcatgaaagagaaaatgaaaaaggagtagatgtagacttccttgggagaaggcctggggccgtgagtaaaaaaaatatcatgggtaactttgatcagattaaaaagaaatgacctagaaggtgaccattaaacagttccgttgttcatgaaagaaagaaaaataaaaagggagttgatgtaaaaagtgtaacattctctcctccgatgattattccaaaaaaaaagtgtaacattggcataaatactcctggtaaattagaataatacaaacaattctaataaataccaacgttctcaaatggttcaaaacttattgttttaaaaataggatgttcaaaacttaacccatatcaaaatcaagcatgtttataaaatttgatatgaaatgagttagatttaaaactaaataatcctactaccacaataaattttatattttttctttaacatgctaatagaagatttacaataaatttcacatgctagacataattatggttaattatttgttatcatgataatatttccattatagctaaaaagattgtaactaaacttgctatcaaatttgttcgtcaaaaactcttttagaatatctatacactttacatatcataacatttaatagggagcgagatcattatcgcgcgaacgcttgaatctactggctggtatatattgaatgttttttgtgtttcttttgtactatcttttctatccattattagatgattccatatttgctagcactgcacagttagctagatcagtccaaaagttttgtaatgtttcttgaaaattatattttatggccatatctacttgtatatatgtccactggaaatagttaccagattttatttcaggcaaaaatatatactagtttatggtttgattgaatatttttttagctggatacaatatttgcagttactctccctccgtcccaaaatataagcatttttagctatgaatctggacgattcatagctaaaaatgcttatattttattcatagctaaaaatgcttatattttgggacggatggagtaaattaatatttgttaagacgattgttttttttttcgctcatattgggcatatgtttgaggcaaggtaccttgcataagcaccattgcttggtcatgtaaatttgtgtcgttttagctttgtaaaaaaaaatagtggtcccttttttaggtgaactgaaaaagaacgtaattctattaaaataactctattttagaatgtagatcgatttagatttaatattattaaacgcgttgcatttcattctaaagcacatatttaaatgcattgttggttcattttaattttctagtacaaatttaagtatataggagattcaattcaacataatgaagggttgaaatatccagagtgaacaaagataaatactcattgaattgaatcgttcaatgcaacatgtccaagtggagatgattgggtagagaccagtgttttaaaagacggaaaataggtgtcaaactgataggatatcactgaacggttaatcggaatacggacgattagtcggaataattcgaaatttgtccttcacagaaaaatatgtatatttgcttcatatttcagttttgcttccatttaaacatacattatattgttactactaaaccaattatacttttagcactcaaccaattactagtatgttaatgttgctggtaatactcagccaattgcaacaaaatagtttctactgtggatcatgccatgattgtaggtttgtaactatcactagcaaacgaagtggaaaccagcaccatatgtgtggggcttggcccattaatcaaattaagcagcaattagtcgctaatggatccattaattggactaatcggcttttttaacgttcaaacaacaaatcctgttcctagttcatctagccgacttggtctagtcagccgacttctttcacactggtatagacatggcaatgagaagagaggccttatcctcttgaacccaagaagaatgaagaggtagtacataggtggattgtcaggctctggctaatttaatttgcacttttatattgtaatggtttccatttctagctttgaaacaatcttggtatatataaagatagcacgtagggtgtaagatgtctctaactttattattaaaatagagcttgtaaagtaataagtcgttttcactttcgcgctcatctcgtgagaacaacttgaactgtttattccatgaagaggaaaacaaccagaagagctttttcttatttcttgcgggtgctactaattactatgtggctagcggggtgtcactctgttatggtacgagagaaatttaacaacaatatataactttgattttgtgcttttatcctgtctcagtcccctgctgttttgtattttattgtaaataacttttattcctcttaatagaaaaaatgtgctcattgcgtattccaaaaaaaaaacaacaatatataacaagaagaagaacacaagcatgtagctaatgcataattctttatcaaaataaagatgattacatccggtggctgcagccaatacatggaggtgaagaaacgctgagcagatgacgatacagcaacaggacataataagatgcagggatacaaaatactaaatctccatggatggatggaagcgaaagcaaacttcaaactgcggatacaacgatcaatgcatggacgacgatggaacgacgacgactaatacaaaataaaagggaagctaggtcgatctcgatctgtgacgactgtgagatcagtttattcttcatggagatgcatttcatggagaggtggtagatctcgaattcagaagcccgcgggcggcggggtggtgggggtggtcggggtcggggcagcgacagcgagcagcgcctcgcgcagcatctcgtgggcgcgctccgccacgccgtcccgcagcaccgccagcttagtcaccagggccagcacatcctccggcgccatgcgacccacctccgcctccagatccatcatccacgccgccgcgccgctctcgcg

SEQ ID NO: 61681 - DNA, 531 bp, Oryza sativa
ccttataaagttcaccttttaaggcatactccaagatcaagtacacacgggtctgcagaatccatgtagcagaagatatgatgataaaactagaggagataaacaattacatcatatcagaactgtggtttttttttttctggacctgatcatagaaatacccatacagccgtagaatgttgggatgacgaagatgactctgaatctcaacttcccgacgtagctgatgctccacctggtactgctttagttggctcttgaaaagtactttcaaagccacaatatggttactctgtttcacagaaagaaaatagattaagttcactgaaagtggaataattagaatcaaaacaaacaggaacaagcattctgaagcatacagtacagttttaggttacaaacatttacaattgcaggagatatttaaaaaaagctttaaagatcaacatattaagcatgacccagaattccagttagaaccatatgaaagtgcactacttttttaagaaaaaatatactacctccgttttt

SEQ ID NO: 61682 - DNA, 2244 bp, Oryza sativa
catgaatgcaagatgagctaatattgtcgggttaaatatatttgggccttttctagaaaaagaaaaggtatatgtggacctcaacgcgcaggcacattgaatagtgggccaaagataattggaccgaaaggcccatgggcttcccttaggcaaaaggtaattggagctgacgattgccttgattgtcctttagccatatttatgtggttttacttttatataagttaaccacctccaaaaaattttctagatagaaaacatcaattttaaccgtcaacagatatctacatcacaagtatcacaaaatactattacatcataggggtagaatgtacgtgtgtgtttacatagataagtgtgtggatgttatgagcgtatgagtttctacgtgtttcttaaaaaaaaaagatgaacaaaaaagcttgcatcatgggtgcatgttggtgagccaacagccaagtagcacaactgcaaaagattccccttttagatggacaaatgacaaacatcaacaggttgaatgaagttcagcggatatgatttcattttcgtctcaaccttcaaccaaagttatattgttcatacatccatgagccgtctgttgcagcgccgaaaaggcataaaaatctgatcataatatcgctgaaatgaaagaaaatgactccagtggtcaatctccacacaaccatcgccaaatatggtatgttccttgaagaaaacaaatactatgcatgtttaagcacgttaagaaagtcatctatgtaaggtaatgtatatattatactcctatataatttgactgtgcatgaatgaacagccgtcgccgattttcctcgccggaaacgaaccaaaactggagcagaagcccacagaatgtcactcaaaactgcccagaatacaggagatgaagtcaccaaaagcaggttttatcatagtctcatctgatgagactgacataactgcgtaaacaaaacgctgatcgaattagtcaaacaaacaaaatcagtgctttaccagtgtagtgtcaattctaaaactgcaaagtcaaaacctttcaattatatttcgaccagagaaaggaggacacatgaagctgcaagtgagatcgatgcaattttttttgaaaaaaatctcaagattgacttaagaagatggccatctcaagattgggctaaaataacatatagcccaattcggtcgtctgcattataggagtattatctgtgccaatgtcaatgcacctcttgtcaaaaacactaattttcttatcccaaaaagattgtcaaaagcattacgtatacatggagtgataatgacaccatggtaataaactagtttacttgtggagtgttgatttgcatgtatactatatactccctccatctcaaaatgtttgacgccgttgacttttttaaaaaatatttgatcgtttgtcttatttagaaaatttaagtaattattaattcttttcctatcatttgatttattgttaaatatacttatatatataatacatatagttttacatatttcataaaagtttttaataaaacgaatggtcaaacatattttaaatagtcaacgccgttaaacatttagagaaagagggagtaatataattgcacacaagagagatactcttgcatgcatgcgtacaaggagatcaggagatcccattggaagatcgatactcctcgttatttctaatttgactggttccaatgcatcatcatcgattcatcgatccaatattgtggcgtcatttagctagcaaggggatcgatgtatttaattagtagtcaatgagcaagatataattagtactctactattattttgtctcctaaactttggggttaagtgcattttgcatctttgaactcttcaacgatatattccaggaagatttttcttataaaatatgctttgtttataagcaaatcgatcatcagcatattcgagtcgctagaagctagcatttgcagaattgcaggactgcatatatttacactgctgccccgtatgtttctgcaggataaaggtcattttggtcttccaaactattttgccagagcacttaacccctgaacatttttccagtttatttaatttacacctcgaattattgaaaacggttcaccttactttataatgctatttcttttttttttctctctgtataagtcaccatttgcacaatattttgttaggactgatagagacgcattttaacttacctttaaa

SEQ ID NO: 61683 - DNA, 55008 bp, Oryza sativa
  unsure (1)..(55008): unsure at all n locations
gccccccccccccccgggtagccaagtgtggtgaaacggggggcaaacctaatcagagtaggggctttcctctcccccctcccccacccttttagagtttgatgtgttactactaaaagaacccccccccccccccgcgacgtcggcgtgacgaggcgtcggcgacggcgcggcgtcggcagcagaggcggcggcgacggcgacgactcgcacggcatccggcggcggccaccacgacggcgagatgcgcgcgggcggcggtgctcgcgccgccgggggcgagcgacggctgcagcaccgccggccctggtggtagcggtccgagcgacggcggcgacggcggagcgaggcttgcggaaggcggcgaccggcagcgcggctggtgatgggcaacggcggcggtgccaatggcaaccgcggctgcggcctgaggcaccagcggcaacgccgtcggtgtggaggcagaggcctcggagctcgtcacagcggcggcgtcagtggctgctgtggcacggtgggaggaggcgcggtggtgcgtttggcagcagtggctgcggttgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttctgatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgtcctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggtgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatctccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacaacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacagcggtggcggtgaccatggtcgccggaggcatggtggcctcggacggctagctgagggcgtggcagatggctacatcgggccggctcggcgcgagaggcgcgagcggcggagaggaggagctgtcggtgggtgtggcgcggtcttcggcgcacgaagactggccggcggaggacgccgatgcaggggtcccgcatgtcggcagagctagagaggtggtggagcatcggtgcgtcagccaaggattcgcaggtggtgagcggcgggtgaaaacctagtccggccttggccaggccgacaatgatggttcattccccctcctgagggcgttgtcgtgctgcctcacccctcaagggtggttgccgggcgaaagcctagtctcggctcctttgagccccgacggacggtggcggcggtttttttccgtcgcttctcttcttgaagacgtcgttttggcatcccttagagggcgatcttttctgtgttcctttgtcggtatagcggcagtcggtcacgcttagcggcggccggtctggtgctagccttctcccgggttgtgtgttggcgctgtcggtatgtgggtggtggtatatttttttccttttcctggttacgaccctccagggttgtaatcttgtaattttttcctgctctatcaatagaacttcgcaccgtcttgtgcgagttgttcaaaaaaaaaaaatgtgttactactagagcacatgggcctttctgatatagctatggctgtggttgttgttgttatcaatagcattaaatttgagtacatgtcacaaaaatccaggtttgggggcatttataacacaaagtcttaggttttacagtttgtttcaaggaaccaaagttttgaatcaaaatgttttagaaaacactctttttttcccgagtatgtaggagggctgcatatcatttgattacagaagaaagaattctgcacaaaatccacagaccccaaaacatttttatatgatactaattactaagatataatgaaaatattgcaccttttagtacataattacattggtagacccgcaatcaacattctcatcacatattttctccttcctcgttttcatactccctcctttccaaaatgtaagatgttttatttttgtcctaagtcaaaacttctttgattataagttcataagtttattttagaacttgtgagcatattatctatagcaacttccttttgtgttctaattctgtaagactgctctgaatacctggtctacatcaggatatagactgtgcatgtttaacattatttcttctcattatttatagttcaaaacatagtccgggagtaaatttatatagcagtgtggtgattgctgcacatgcgctgtctgaaccaagtgctacttgcattcacagctgttaactatcccgtgtctagagtttatctgtatttgccaatttcaccaagaacaatggcaagagagcttaccttacatctgaggtcatttttgttttctcattatcatggcagctggagatccagggatcactggttcttgtccaaatagaaaggaatcacaaccactaaactcaagatctgcatctctgtttatgcaaaattacttccccacaattcctgtagagaatgaagcgtgtaaagagaattctgttggactaccacagatggtccaaacttgctatactgcagctggaaatagaatccctaacttcatagctgtgaattactacatggtattactttatcagcactgctcatacaagaaaatgcatatctgttattgccattgtatccaatggaaattttcttactatggcagcgaagcgatggtgggggtgtttttgatgttcaagacaggatcaatggcgtgacactatgtggctgcaacaccattgctgcttgccaggtaattgtgaagccaaaagtgttatttgaaacaaaaatagtaatgcatgaatcttagaacaaactattcttacttttgagcataaaaattctagcacctctttcattcaatattggtgtgtttcaagttgcaattctcatgaagaactatttttacaggctggggcaccagcgggcgcatgcaaggacaccggagcccctaaccggacttcctcttctgtaaatggaaacgtatattcaggaactatagaattcaagtcacctgcttcagcagccagcatttcgaatgctaacatccctagtaaatttgttggtttgctactgctaggtcttgtgttgatcattaagccgttttgatctttcaggcattctttttttcttttgatgagtttgccacgtttctttttcgtttttaatgtctcctatgtgatgggattacaattacagtaagtaatcttgttagccatctaggctagaatagattcagagagttacggtctggtctgtttggctgtctgacctgagaaatttcctctcatgcctgctcgatatgttctaggctagcaccttacgttgtacccatcacgaagtaatacaaagaaattgaatggattaatggtcctatgggttggcaccaatgttctacacggtgtgaacttacacgaaatatgttagaatgtttgaaaaaacagccagtgatcagtgtgctgcaaacttgcaatggaacttaaatagcagaactacttgtttttttcagaatttaaaagacttaagttaaattaaacgctctcaccgtaccggctaagagcaaggctaataaaacagccgacttattagctataaggttctttgtagccttctctctattcacccatataatagttagctatttacaattaatatatgatccacttgtccctcttacagagagtttcttcgttcttgtatccaagccggctataagtttacaacctttttctcctctctctcctctcttctctcctctacctcagcatttagtcggtttatagcctactattatagttgctctaagtaatcggtgatcgtgaagtgcaactcatgaagcggttttataagtgcttttgcacacgtggaccataagagagtagagggcagtgatgatattactaatggaatcagttaaatgatttttctaaaaaaattatagtagtttctcgtctcaaaataaatctaaccctcaccttcaaagctatggtagcattagtgtcgagaaaaaaaaatatcacttggtggattgaaggctaaaacattttccaagaaccaataacaacatgagttgtggtacttttacgttgtaccaaattatttgtttgatttataaagacacggtcagcgattaattgattttgggggagggtagaaaagatggtttgatttgagtttatatacgaaattcaacccttcattcaggaaaataaatatcataattagtgaatatatattttgccgctcttccttgtccacgcagtactccaataggaagagaagatttttgtttctccagtcaggaaaagtgaaatagatagttccaaaatagaaatcttggattttgacggtagcatcgggggtccttttcgtaggaatacgtctcgcggttgaaaaatatgtaggtcaattatatatattcgtcagaatataatacgaaaaatagaggcgagtagaaaagcaaagcaagcagttagaaatccacacgcaagaagagaggaaaacgtgatctcacctgaataactcgagtgaaacagggacgtcggaagcagcagcgccaattggttgtgcgtcgtcttgtgtgtctctttcacagcgacacccgcccttgttgcgttgcgtcggcgtatatgtacgcacgcacgcgcacacgcacacgcaaattaagcagagcgttccgttgattttgctcgtggtgtgtgtttgtgtttggtatggtttgtttctcgatcggtacatcgccaacttccgctcgagtttattttatttttctgaaaaaactgctcccgtataatttatttcgtgcgtgcgtgtttaattgtcaacccatacacaacttgatctatgtatgtattgtacggtcaagtaaaaggaaattgtggtatactagtatacaatttaaaagttattattgctagcattttttatttttgggtagagcgttgtagtaataatcaatttcattgagtagatagaaaaggaagcatatggatgcagtggagatttttctcgtctctggaatccaggacggagccgagcgagcggtccaggacaaagagcgcccatgtccatgcccatcacacatctccagccgatgggcccatgtgatgcgcgtcccgcagcccagccggacccagtggcaccatccagccagcgtacatcgacgacatgtcaaatgcgtatatagccgagcccttcccctaggccctcctagctatagctatttcaccgcttcgctccatccatccgttccgtttagtttgctccaagcgcaagcgcaagcggcggagaggaagccatagccacctcccaccacgccttggcctttccattacctacgccttcccttcccttcccttcccttcgcgcgctacttggaattggattagccatagccatggacgccacgctgctccgctccgccgatgccgccgtcgccgtccgctccaccaccactgcgccttcggctcggcctcgccttcaccgncccagtacccttccccttccgtccttctgcgcctgggggccccttcgcgcctacgccgtttccgcttgccccgcgcccggccgggtataatccacttcattcattcgaccccccttttccctttccccccttccctcaccaaatcaacagcttccttaacaacatctacttactgctggtgctttttttttttttttggggggggggggctatatattcatcttttttcctctttttttgctggactacacaacaccgctcccatcccaaatagtactctatttaattagtgctttgttgctgctgttgttattgttgtgtgctcatctcaaattagtgcttcttctcaaatctcaaccatatgtgtacctttcttccttttctcttggaatttcatgaagctgtctgtattcctctaactgaaatatctattccttttcttttgtgtgagtgggaggaatatctattcattgtttcccaaaaattcgtcataaatgattttcccattaattctccaaactgatttattttacttcgaatatattcatacatactgtataggagtatgctaggagtatacatggatgaactataaagtttcaaattaatcattattaatttctgatgagatgcaccatcttcctccttcagcacaacaacggagtctacacagttggtgacttcatgaccaaaaggcctaatctccatgtcgttacacctgcaacctcggttgatgaaggtactaccttcttctctacttctataatatgaagtatgtcctaactatgcttgctgctaaaccaaatcgccaacttattattctgttcgtttttacagctctcgagacgctggtgcaacacaagatctctggtttccctgttgttgatgacaccggaaagttggttagtgcccatcaaaacttcactctattcaatctttttctacttactctctgcaatttttattctcaaaacagttatgcttacaagtcaacaacgttgggcttttctcaaggggaaatgatttattgctaaatagttatctcagtaacatgattctaggatattttctttctcaaacacggtttcaaactttatacctttttacatgctaaattcgaactagtatggtgattctacctaaaggatttagagatcttggaatgctcacatctagaatgtagtgctgattcataaaacggtgtccttgtccccatgacatgcgggccttttgatctcctctattatgttgtgtcttaagaaacattacattgacattatggttgaattgtatctgatttctcattctgccactcaatcttacttccacctgcaggtgggtgttgtctcagattatgatctgttagcacttgactcaatatcaggtattccttcttggaccttcaaatcacttgcttacaacaaattcatattactagtacaatattgcatcctctaaactgcataagcctagtatttgtcattaacacaccattgcactaccatctaaccatctgcttgcagtcatacatggtggtcatttgtcaatatcttgatagcctgataggcaggatcacaactagaaagaaccataagtagtggcggcttggaccatataatcttttgcatacctacaaccaaaccttgtttaaaccatagcaaccataactttgatctgaaattctgaatgcaacaaaagctttgcccacactgcaacttttctggaactctaagctgcaaagattaacttgagctatttaacttattttttgaaagtatactgttgggtagtaaatgccataatccttgtattcttacattggtggtattttaaatccattctttcaggaagtggactgactggcacaaacacaagcatgtttcctgaggtggatagtacttggaaggtatgttctaataaagatagaatgttacatgtttttttatatatattttctagctatgcaccattttcttagattgggttatctttaccacctactgccaggtgttaggatggaatggtctggtttggaataaaagcaatttttaatcatggaaaatccccagtttctatattcagaagcaatgatcctccttaaataaaatgttcccaccacaaagaaccttcacatgttatgacaaaatgctgtttgactaaataataaagtagaagtgtaccttgcatagtggctgatgtaatggactgtgttaggtccagcaaattgtcacttgttttccctatcaagaatgttgttacctctcaacttaggatgcttagtcagtattgggttaaatactaaatcccgtataccttacatatattttgtaacagtatttaccacccattttgtagcacaccccagtaatgatctttaaaatcttggtattcttcactcttcatgcattagtctgaaccacaatttagtacttcaatttggtaaatatattgtttctagcatttaaataaataattagtcatgctccacatattgtttgtagtagcagatcttttttttttatctttatcaattattttttatttcacacgttaatatattagactcattacgatcgctgtacagacatttcgcgagatacagagactcttgagcaaaaccaatggcaaagtcatcgctgatgtgatgacttattcgcctcttgcggttcgtgaaagtaccaaccttgatgctgctacaaggtacctacaaacagtccattagttctcaggaccacgtctaccaatttattatcagacatcacgattggtgttcatttgtttcaggttgctacttgaaaccaaatatcgcagattgcctgttgttgatagcactggtaaattggtgagttgatctgcctttccttccttccgctttcgtttcagtagtatctagtcttaagtaaagtttcttttctcaaggttgggatgatcacaagggggactgttgtcagagctgccctcaaaataaagaagacagctgaagaaactgcttaaattagacagtgtagatgattctttataagtcatttctgggactgcagtcacttggaaatttagtccactgaaacattatttggtgaaatgaactacatcagccttacagatactgcgaattcgacagtcaattcttcttggaacatagatggatataggtattgtattgttgcagatatttggaatatagccgcaatctgtttggggccaccagatttggtcgcctctccttattaggtagcataacatggagaatgttattatttttatttttacttttatcattgacttgtattcaagaacatcagtgtattgaaatgtaacacttctgatatgatgataccttccgcatctgggttgaagtgaaaatattttccaatgtttagattatacaacgaacaaggttgtaaaaggtaaatttataagttagagcctacgtttaatttcatcatggtagttgtgtagtttttgagaatgaagttgaaaaagattatatgtttgtcagcatacgaagtaaaggccaccccttttgcgtcactgacgttctttaaaaaagaaaagaaaggttgtaagatcttctaagtatatttttggggtttatgttagtttgatagtttctaaaactgataagtcatcctcttgacttttgtaacaattcaatttactcctaaactataatactagacatttgacacccatccatgttcatgctacgtcgagatccttgatcatctactcgactgtttgacgccaccgtcatctttccgaacatgtgccatcgtggcttagggctcatggtgcttctagactcgtagtcggtaagattagattcttagtgagcaatgaactcatttacgaagggaccctacctccaatggtaagataccgaaaataaatttgataaaaagatgggtgcagtagttgatgcctatcgcaaaagtagggaaggggagggttagtcatttaaaatcagacgttaccctttttatgataatttgtttatagtggtgaaaaaataattcttgaaccagggtgaaaatcattgactaagttattaggtttgtcacatagtgatggtgtgatatgacacctcatactaataaaatatgttttaatagtactggttgtaaatgacttgtatgtttaatatgtgtttcatacttttaatagtaacaaccatggtaattgtgtagttttttactcttttgatttattttgctgaagttccactaggaaacaatgaagttggacgagattataagtttgtcagcatgtgaagcaaagaccacccttttataaaataaaaggttgtaaaatcttccaagtatttttttgagggtttacattagtttctaaaactgacatgcaatcccagtcactcttaaccactataacacagtttaactccacatacacggtacatccaaatacattcataacagtacatttataattgtctggtaatcatgtgcaatttaccccaatcccttgacttttgtgataatccattttatcccctaaacaataataccatacatttggcatccaaccatgtccatgctacggcaagatcctttgtcatccactcgacagcttgatgccaccatcctcttccgaaaccgtgccatcatagcatagtgcttatgctggttctagatttgtagtcaataagactataatcgtaatcatagttaccaaggagctaatttacggaggaaccctatttccaagagtaagatgttgaagatgaagtcgatcgaataggcaggtgcaatagttgatgtctattgcaattctcaaaagtggatggagggagagttgtttaaaattggatgttacccttttcataataatttgtttatagtggtggaaaaataattatataaccaaggtgaaaaacattacggctaagctagctaatggatttgtcatgtagcgatgatgtgatatggcacttcatactaataaaacatgttttaatagtatctagctatgcttataatttagtatgtttgtcatacttttgttgttttcatatttattttaatttcaactgggccatacaagtgatattgttcaatccaaatcaataatcttttatgacgatatcaacgaagtaacataagacaatgcatttaagagctccttgtaaggctcgaacaacaaatggtaacaaatcaaattgaaaattttcaatataacaatattggtaaagacaatccattaagattgcgaataaccaacaacatattataagtttatgtggcatttttagtcggactaactctaacatatttttatctagtttcacgctaatagtgttgcctaaacatgatagctcgatagaaagaaaatataataaatttgctcgtacattggtccgttttagtctacccactctatttgtggttaagtgacatgattaaaatgttacacaaatttatataagtaggtataattcaactagttaggttccttgtggtagaaccgatccacttaggttcaagttctagatagacttgacacgagtgtttatatttttggctaattattctttcattaagtggtagacgacttactatgtgaggctgtattcgggagcgccacagaaaactatatatatgcattaacacatgattaattaaatattagctaattccttttttaaaaaatagattaatatgattttttgaaacaactttcgtatagaaaattaataaaaatgtatcgtttagttgtttgaaaaacgtgcacacggataacgagtgtaagcgcgcggtgaatccatacgcttgcgctgtgtttcttacaaagaaaaataactagaaaaaatgcccgtgcgttgtaacaggtgaagtctattttaatcttattattgttatatggtttagttaagataaaattcaccgtgggagttcgcttggatatatatatttttagaaaatcatgagctacagttaggagtccgattgtctcaagttagcatgcgagttttttaaaaaaagattcttatatgtttccttccgtattaccaaaagtaaacgatcttaaaaatcgactcaaataccacggatatgtatttccaaaagcaaacgaacttaaaaaccgacccatacacggatgacatatcaaaataccggcaaaaacatctttaatttttataatagtagagatagagatatgacacaaaatttaatttggaaaccttttttaagtagtactattagtggttgtttttgctctaccgttttgggttggaatttggaataaggaatacctctaggtgataggtccgagtccggacggaaccagctggaatccatccaccgaagtggaagcgccgaccacgtcacggatccttcgactacgcggacacgtgcacggcccatgtgtcccgataggagtcgtcggatggagggcggaggcggacggagggtgaggatccgataagggttttgggggcgggggtacaaataccggggctccccgggcctcgctgcctccctccctcgttgccgcgccgcagttgcagttgcagttgggaggcaaatctctctcccaacccttatcaaaccctaaaccgaaaaaatttaccccccaaaaaaatccgcaaaaacaaaaaaaacccaaatcggagatggcggcggcggcggcgcaggcgcaagcgcagcaggcggcgagctccgcgtccgagggcgggtccccggcctaaaacatcgaggccgctgcggcggcggccgcctccttcccggcgacctcgctctacgtcggggatctcgacgtcagcgtgcaggacgcgcagctcttcgacgtcttcgcgcaggtcggcggcgtcgtctccgtgcgcgtctgcagggacgtcaacacgcggaggtcgctcggctacgcctacgtcaactacagcagccccgccgatggtacctccccgatccgcctcgccctgctcgattgctgttcttttcccacgaatctagcatctaggtttaggtggattgcttttttttccttttcccaagacgattagggtttggtactctttttttttcttttcacacgtttagggtttggtctcgtcggattttagggtttggtctcgtcggattaggtttgctaccgtcggattagaatgccattagaattgatgtcgctgcggcagtgttaaagcatgcatatttcttttaaaaaagataggaaggctgcccttcttttttctgacgtggttagggtcctgatcctcagcgagctattccattgcagaaataactatggtttagcacaaatcattgccttcccccaatataaatacatttcagtggttcttattttcatatttgtaattctacatcatgttcggtaatgtccattaatctgttatgttggaagataatgcaaatcatttaagatggtacataaacacccctattgagcatcacatttctgtctagatggcaggcacgataaattttgatatgaatcctccttaaattgagtaaagttattatttttataacgtttgtattggagattttgggcttttgcttattttggtgtaatatctcctgttctagtaaatgctctcatctgcagagatgcacgtgaatctgttatgtcacctaaaattttaaaacatttgagatgccatgactaatatgcaataatttctaagttgtgctgcctttgggaaacttgcacattttaaaattctttgcctaacaacatatatttatttactactggctatgatagttgtctatttccttttcttacagaatatccacatgcatctacaatggttttatttgttgcttgacttttgtattagtcctttcatactaaatacgttatatctatcttgcagctgcacgagcgttggaaatgctcaacttcactcctatcaatggaaaacctatcaggatcatgtattctaaccgtgaccccagcttgcgcaagagtggcacagcaaatatttttatcaaggtatctgtgcccactcttgaaagctattttttcatcttttttttttgtagtttgacatcctgacttctcttttttcagaaccttgataagtcgatagacaacaaagctttgtatgatactttctgtgtgtttggaaacattctttcatgtaaagttgcaacagatgcttctggagaatcgaagggctatggctttgttcagtatgagcgggatgaggcagctcaagctgctattgataaactcaatggcatgcttatgaatgacaaaaaggtgtatgttgggcctttcattcgtaagcaggagagggataattctccaggccaggtcaagttcaataatgtctatgtaaagaacctgtctgagaatactactgaagatgacttgaaggaaatctttggaaaatttggaaccatcactagcgctgttgtaatgcgtgagggagatggaagatccaagtgttttggatttgttaactttgaaagtccagatgatgctgctcaggctgtccaagagctgaatggcaagaagtttgatgataaggaatggtatgttggaagggcacaaaagaaatcggaaagagagatggaattgaaagagaaatttgagaagaaccttcaagaagcagcagataagtatcaaaacactaacctgtacctgaagaacttggatgatagtgttgatgatgataagttgagggagctttttgctgagtatggcactattacttcctgcaaggtttgtttacttgtctgcctatgcatgtgtttcaatgcttatcaatttctggtgctaataatagaaactgtgccataggtgatgcgggattcaaatggtgtcagcagaggttctggatttgttgcgtttaaatctgctgaagatgcttcccgagctgtaagctggatgtgtatgcatgatatttaggttgctatgtttcacagataataatgtcttgctttaatgtctccctacagcttgccgaaatgaacagcaagatggttggcagcaaaccgctctacgttgcgcttgcacagcgcaaggaagacaggaaagcaaggctgcaggtaagaaatgatcgatgaccttgttctttgtttttatgaggaccatgaggttcctcaattggccagttttgagagtagcattgtgtgtactttttgcacgtcacaatgtgagtgcgggtgttatttatgcatagaagagtgcggtagctaatattctgtgatgtctcgcattttgaatagaattctggcataccaataaacaagctgtcattagattgaattttcttggctcacataacttgcatgtttttcattataatgcttattattactttctgtagtatgatgttggtggctattccttacttttgcaggcacaattttcacaactgaggcctgtcccacttgctccttcagttggtcctcgcatgcccatgtttccacctggtgttcctggagttggacagcaactgttctatggtcagccccctccagcgtttatcaacacacaggtaaataaggcttaattttcttattgatgtgttcttttgacatcttctctttccataataatcccccttttttttggtgttgtgtgttagtgtgcacaatttctttctttcataagttttagtggtatcttcttactgctttcgcttgtgaccatttgctttgactatttggcggttgcatagtaataagttcttgctgacaaatgcaagatcatgatgtaacgtttaatgccactgtttaatttccagtcctatttataaagattattcctgtaagaatatagcaaacaatcatgtcctaaaggcttttatgataattatgaggtgatcgaatgctagtgttgtttcctttgtgcatttagattaagtggttaaatgatattgattgaacttagacatatgtcttactgttttctgattatgtctcatatattggtcttaagaaaatactacatccaacctgaaagtataaagcttgcttatatgtagtaagtggcaaataattttatctagcaaattgatgtcttcttattctgtgttgcatttatgaatgttatactggcgctgtatttttaactttgcaacattgatcattttcctcatttggttttgcaacacaagatggtcattaacactacacttcttttggttgataagacatgcaacactaagttgtgagcattcagttgtttaatcatgcatctagagctctatgttgcttgctattcctgtttgccgaggagacacaaaactgtagtaatatataacccgtccaaaatttgacactgttagatggtcaagtgcaatttacatttgtttcataggaatagtccaatagtttttttttgtcttgttatgatggactgggtggatacttaagattgtttatatgatttgctggcttgacaattttacctttttttattatagcctggtttcggcttccagcagcctcttatgcctgggatgaggccaggtgcaggtccaatgccgaactttatcatgcctatggttcagcaaggacaacagccgcagcgtccggctggtaggcgtgctggtgctggtggaatgcagcaacccatgccaatgggtcagcaacaggtatgacatatttgtgcgtgtatgctgaacatataataattttccgtaagcattcctgtagtgttaatttgacaattcccttgtgtatcgagtgcctgctgaaatatagttaatgctgcagatgatggctaggggcggccgtggctatcggtatcctacaggacgtggcatgcctgatcctgcaatgcatggtgttgggggtggtgtgatgccatctccatatgagatgggaggcatgcccatgagagatgctgctgcgtcacagcctgtacctattggagcattggctactgcactggccaacgcagcccctgatcagcaaagaatggtttgggacctcatgcctttctctgtttcttatgcatagcgtgaacgtgttcgtcttgaagcgtgacccatttgttcattgattgttgcagatgcttggtgagaacttgtatcctcttgttgatcagctggagcatgagcaggctgcgaaggtgactggcatgctgctggagatggaccagactgaggtgctgcacctgctcgagtctccagaggctctcaaggccaaggttgctgaagccatggaggtccttcgcacggcccagcagatccagacgaacgcgacgcctgaacagcagcttgcttctctgtcgctgaatgacggcgtcgtttcctcctaagcataacgacgacagcaatttttgatccatatctcagttatcttatctatctagaattgaaaacgacttggttacttggtttattggagttttagttttattggtagttgaactaggcatttaggcaatgcgcgtggattgggtattttgtttgctcggatcttttattttgctttataagttatcatatggattgctactttatgtcttctggtagcatcttttattttgtgggtgatgcatgatttagcagtcttgatctgcaccaaatgaagcaaactttggctactttgttggcttcaccggtgtgagcatactgcgtcttcagtcttcacttgctttagaaatttccattcggtccttgcggtgaatatatacgatcatcacaattacacattttcttggctggtactccctccgtcctaaaatataataacaaccctcctaaaatataataacttttagccctagaatttgtcccaaaatataataacttatctaccaatattttctccttaactaattacaattctctatcattcatcttttttcatctatcttaactgctcatccaactataacccttcaccatttatcggagggagtagataattataaacagtttatgcgtccgtccccgtagagaattactaagagcaaaatgaccttcaccacttatcggagggagtagataattataaacagtttatgcgtctgttcccgtagagaattactaagagcaaaatgaggaattcctttagaacacaacataagatggcggatggccgcaggtctcttattctacagcggcagtctcaaacttggcctagcccaacgacgagcagagttatagctgctctctcggcctaggagtgtttgggtctaagactctaaggcaggtagagagatggccctagtgaggtactctctccgtcccaaaaaagccaacctagtacaacgaatctggacaaagggctatccatattcgttgtactatgtgggagtaatgggctagctgtccagattcgttgtactaggttggcttttttttagcacggagagagtaataggcttggttagtattctatttatttataatccacatatgtcggctttcttttccaaagaaaaaaccatattcatatctgaatcagccactcaactacttatccaaatcctccaaaattttaatatccaatctgttttcatctctacttataagcagtataggccggttaatcataatggtcacacatgactactatgatgatatgttcttagatagatgatgcaatcttagatggtagggaaaatttgtaaaattcaccataaacgtcaccttgagcttgagatttcctctataatatgatttgttttaaacaccttctaattcaccttggtttgatattcctccccaattagcaattaccattattcacatgttatttcttcacgatcgtgaaatggagtttgctgtcatgagaatgggtaatgagaatgagtgagtaacgataactaagaggaatcctaaaccaaaataaattaggagggggtatttgcgggggatattaaactcagggtgacatttaggtttacttttgcatttgagggcccacaaatatattaagaagaagaaaatggtatagggctaatctaatttgctctttggtttgaaatcctaggcttgccctaagcatattggcccatatttgtgtcttgacaaaaatagacacgatcatgaccgttggtctgaatcgtgcggcatatctgatgggtattgaggtcttacaagtaacaaatacttgtttgtgcaaccctagacccaccattatcttgtcccccttccccccgccgccgccgccgccgccatttgacctccatctctggattgtcatcacaatttttttcttttgtctagcttctctgcgctctacttgcgaggttgatcacgatcaataggtccttgatttcttcaccatatcgttgttgctgccatcgtcaccgttgccaccaccaccacatcaaggagatttggtgtatagttttttttttaacaaataagtcgccagctagacatagctagataagtcgctgtcatcttgctctctttgtttgtggaaggtgggtgaaggagaaggaagcagatcagatggtgcggccggggagaggacaacggcggatcgatgctgccattgaccacctatcagagtatggctttccgaggcccataatccgtcagaccatcaatgaactcctcgcggacacggtaatctgtcttgatgtttttctaggttatcttcgtgtccttagaaggttgctaattgaacttaatttcagctgtatgggaggaatgggtgggtcttcctagaggaaggctcctaccgcattgtggtcgacagactactcgaaaaacaggcaaatcagcaagagcagcaggaggaagatgcaaaggttttcttttctttcttcctgcgctcatagtttctcagttccatttttatctgcttcggtgtttgttgtgcggagcaagtgtttaagttgcagtagtgagtgacgcaactagtaatgtagcaagaaatttttcattaggtagtctcacttcaaaagttcatatagtaacatcacataccaaaattttcggacaccgtaaatcccatatatagatatgagtacaaatttatatatataaaaaagatacaaatgtagcaaagtgcaaaacaaatagaagtcacaaatcaaactttgttatgctctccgtttagggttattttgtcaatattgttgagcatgttttgcaatacaagtgaacatctcaagaagatagactctttatatctgttcatcaatgaaaatgaatcatgaacgtaatataaattgcacgaagatagtatagtaacattttactaccattaattcgggtttgcacatatggacttatattttcagcagtattaaaatgttaaaatgccagatgcatacgctaatttggagtgattagagtgatcaaataattggccaggaaaaaaaaaccagaaagctattaaaccccagtaccccacctagttttccatggacagacaagtcaattgtacttcctccatttcatattataagactttatatcattgcccatattcatatatatgttaatgactttagacatatatatgtatctagattcattaacatctatatgaatacgaacaatggtagaaagtcttataatataaaacggagggagtagctcacaatcgtgaagcgagagagacgcgaccggcttccaccgacaaatcagctagatgagccctataggaagccaggaaaaggggcgaacggtggccgaggggttggcggccaacgacaaacgccgtgatggcctgatggttgacgggcgggaagggagacatagccgggttctcaaatggcctcccgggacctccacggctcgaggagaggtggactagtggagagagatgttgacgcaccgaagtgagtgtaggatcgagatgtcgactagagggggggggggggggtgaataggcgatttaaagaataaataacacctaatcaaatctaacctaagttgctaggcttggtgagggtgaactctaactaagcaactaagttatgttttgcaaacctagggtgatagtggctcaattatatctctaggaaagtaaattgcacaaatgtaaatgcgacaatcaaatgagacaatgagacaagagatttttcaccgaggttcggaaactcgccggtttcttactccccgttgaggcaagcccaactccaccgctcaaccacgaagccaccgcacgcccccttcgtcaaggggtgggcaaggcgggagccggcccacggagaggactacccaagcctcgatcactcggggtagttcttccttcactccgaaggtggtgaactccaaaccactcacaaaccggcactgggcctcctccacaatcttctcggagaggtcaccgggcaactcctccacaagccgtctaggaggcggcaacctccaagagtaacaagcaatgacccggtgtggagatgatcaagtgccacactagctctacaatggaagcaaatgcacttgactcttggctaaacaaccctctaacacactagatggatgaacataaagctcaagtgagtgtgagagaggtgcaaggagtgtatgcaattgaattgggtgccaagagagcccccttgctgctggtgggggagtatttatactcccacccaccaaaactagccgttgggggcgaaatcccccaactctgtgctctgccggtctgaccggaggtatgtggccggtcagaccgtgctactcaactagccgttgtagccctgtcagagggccccattggcctggccagtcagaccggcatggggtggccggtcagaccggcctcggctcggtcagaccgccatcggctcggtctgaccgaatacggctccgtcggctctgtatcggccatcctgagcagcaccatctcggcctccagggggccggtctgaccgcgcaaatgccaccggtcagaccggccttatgctccggtcagaccgccttcttgcggccggtcagaccggccagggcacgccggtcagaccgccactatgtggccggtctgaccgcccctggtcaggccgaacccagtgaatttgcaagtgaatgtgtgcgtgatgaaaaaaagagcacaaatgaaaatgcaatgacctaatgtggcaattataatcatctctttgctaggtcattacccttcttaatagtacggcgaaactaaaaataaactagcaaatttgatcgccctacacctcgatcaattctaaattaaagcgctagttttaccgtcttctttccctttgctttgcgtcgtcaattttaatccatcgataatcatccatgcacacatatgacgtggacctaacttaaaatgtatagctcaaagacaacggttagtccacaattagcacttatcattaattaccaaaattaacaccgggggcctagatgcttcagtgaggcaacacgatgaatgtgtacaccacggtgccacagcaaagggaaccacgaggctcaggcgctcagccctagttaggaatgacaacagctctgcacctgtcggtttcatcaccccattcccaccctgaggtaaagggaatcatccgttcccatctccatccccacgttgttgtaggttttcccgtccgtccctgcagcgggtatgggtcacccatgggtctttacacccgacaacactatcaaaatataaagtgcaagccaggaacaatccccaacccaggtgacaattagcctattattaatgtattgagtatgcaattagcagtgaaatcatcattaaatcggctgattgaacacaaaattgacccaaaagaataggcacaagcaaacagagtgtaacttcagtgcttgaaaacaagtcaaccttccgtgctgttagcctgctacagagcagcaagatgtttccttcaaagagaaagccaagaagttaacgtagataactaactctggtagcatacaaatcaactactagctgactgctggttggtgatgagtccgcagtagtggagctagaccttgggcgtgcggcctggttgccttgtctcctagagacatgcggcgtggcttggatcccttcacacgaaggcgtcggccatcggtatcgactgtcgatctggtgtcggcctggaggtcctgtaggctggaggcgacgaggcagcgcatggatctggatggagggaagcggcggaggagaggactctatcaacaatgtgagtgtgggatctagggttttgggggcgtatatggtggtgttctttttttctaaagatgaagatgacgtttttttacgcaaaacgatgtgatattaatgtatgattgattgagttttaatcattacaaacttgaaaagtagattaatatgatattttggagcaacttttatatagaaaatttttacacgaaacacaccatttagcagtttgaaaagcgtgccatgaaaatcttaatcttcatctagctcttgttggagaaagaacgggacctatatctgaagtagatcataacagttgggtttttaatatctatatgggtgtgagttaggccaatctagattgtaggccttgacgcgtccaagtaaagtgtcactattttggcaaactagaccattgggcctaggactgctgcatggccatattgtactaggtaacctactacagacaagtcaactacaagccaacatcgaggcatgcatatgcatgctcctaatgatatagtcatgtatcctcgcactagaaggatagaatgagatatggtggcacatgcctggttcatttgaatgatcaacgtgcaagtatccctcagcagggaaggggatccttttttttttgcggggaaggggggatccatttgatcatgcttggttcctcaacaatggaacaacaagccacacgatgggtgtcgtgatgccttctccaagcttggtagcttttgtaggactgccaagtttggggacgtctctagggtctgcattgatggtcttggcatgatgctcttcttctataagttcggcgatcactagcaatgtcaagagtctaatatatttcttgactattcaacaactgggagaactcactgaggcttgttcggtgctctgggttcccaactcctgtcccacgttctccgcgtgcacgtttttcaaactattaaacggtgtttttttttgcaaaaagtttctatacaaaagtttcttaaaaatcaaattaattcatttttgaaaaaaatagctaatacataattaatcacacgctaatggattgctccgtcttccgtgagaggatacaggttactaaccccaagttacgaacacaccctgagtctagatgaaaagctatggttgagaacgatgtcacgtaggttcaggatcctaagtggcacagcgtggctgtatgttctcaacatcacgcttgtatagctggtgtgccatggaaagaccttgatttcacctatcctgaatttattcgcaatagatcaatataggtctagaacttctagtctcggtccgaaagttctcgtcaaattactgaaagttctagttagcaagaatatagcccacgaaggggaaatcacaataagcatgatttgcacaaggtagatacaacaatatgctatgtaaattgataggtaaacattgcacaagctatcacaatgcaacctcacgaagagaatagtaacccaaacacaataacggtagagagagagaaccaattctttttaccaaagttcggatccaacgatcctgtctccatcgagaggctcctacaagctgagttgcattcaaccctaaaacccaccaattaaattggttcttactcagtttaccccttttacttatggaggtggagtagaacctccaaaaacttcccaggctgtccacaatcaccagatgcttgcgagtgacatctagttgactaggaggataacctcgaagagtaagaaatgcgctaaggaacaagctcggtgctgatcatgcccccatgataaatccctacttttaacttgcactcaatcccaaaaatctgtctaatccctgcccacttgatacactagaagctttagatccaagaataagagagatgggaaatgtctaggaggctatgataatccgagcaatatacagactgcttactaaaaagtataatgcgcatagctataagctaactacatctttaaaaattgcatagtaaatgactttaataaaaagcctttatgcaacgaataaaggaattttgtaaggtattgggttcacacagtgcgtatatcgccaagacaaatatgctaagttcctataagacacacaacaccaccacacttgaaaatatattgcatatgtggtgtaaaatctgagtaaaataacactcataaatggattcaccaaccgcctaaaaatgaccaatatatattcaacctaaaccatgatattggttgtatcaaaaaatgcacgcatgtgacgaaaagcaatgatataatataaaatcaattgcttcatgaaacccaaacaatgtctctaacttataaaaagttaacagagtagctatatatataaagatttagtgcttgccactgtttaaattgtactctgtaccaacccctaacaagttgtataacaactgctgtatcaacccctaacaagttgtgtaacagctgaataaaaggattttaaggtaataagtcacttgaactcgcacatattgccaaaaacaaatatgcttaagtccatagggacatgcgatagaccacacctagaatatgggttgcatacatattgggattagccccgaaatatgcccatcaatgcccttgctatatgacatgtatagcatacctattaataagctcttgagtgatagattttctgggtaatgtagatgaagtgcatctcaccagagcgcccaaagtagatgcgataatcaaatccggactggagcaagtactcaaccgatggccctcgtagggaataatgattggtccaatctttgagcgtaggaagtaggcacatggccatgaattcatgtcacatatatccaaaacaagtccaaattgaaggtatgatccttgtgcttgagctggtaaacccctaaaatccttgtgcttgtgattgaaggtatgaagtaggcttgtccttctgttgtagttgaaatagtccattggcggcagctgatgtagttgtcatggaggcgagatcaccaacgtgaagatgatatcgcccatcagaagtgacggagatgttggtggtggagacgaagttgcccatcaatgatgatgatgaaatccaccaaccgtggagacggagaaaccagtcagcgatggtatacgcaaccaacagtaatgacgactggtggcaacagagatggttagctgtgaagacgaagttgcccatcaacagcagcagaataggctaggtcaaagtggcatagcaggatgttgatgaagatgacaatgttagtgatctagtcagattttaacgttgatgaagtccagcttcctgaagtaaagaacctgatggatagtagttgaccgaagatgaagataatgccgatgacgaaggtgtcgatggtgacgtcaatgataataatccatcaaaatgtcgagaatatatccatgctcgagcagttttcttgacgttgatgtgtgcgtgacgaagattgatgcaacacctcttgattatgaagatgacattagaacttggtattgtagctattggagatgcttcacttggaggaaagtagatgttgatgctgctgtccaacttgccgaatctaagtagattggttgataactccaaactccataggcccaaacttgttaagctcaaagtcatatacgagttgtactccagagggcagagttgaatctaaccaggacatgtaaattaaatcttgaacttgatatttgtgaaactcggagtaaaccgtggaagtagctgagatccaatgttgccgatgagaatgtcagagttgttgaagtagaacgcttgctctagaatgaagatgaagataatgactcccaaagttgactcgttggctggttaattgattacttcatcttgacataacgtttgtcgagatttagacgtgtttgtgcagcccccgactctatacttagttgggaacaactgaacatagagtcaagaaactatagcttcttattgtcgagtaaccatcacttgagtaaagatatgcgttgaggatgttcgagtagaaatcttgaggattggagcaccacttgtagtagattagcacgacgtcatatttggtggcgcatgctgagtgaagtagcaaagctggtgaagtagaggcgatcggaattgctggtgatgaagatgatcggctgcaacagaagcaacaatatgtgaagatgaagttgtctaataatgatggcgaaggcgctcacccgtggaagtgagagcaccagtcggtggcggcgtaaacaagctggtggtgaaaacatggtcacccatcaatgacagcataataggccagcggtaaaggcaaaggcactagccggctgcggtgaagacaaagatgcccatcagcagtggcataatctcacaaccgtgggggcgaaggcaccagtcgacggtgatgaaggcaagctggcggtgaagacgaagacgaccatcagcggtggcataatcgcacagccgtggaggtgaaggcaaaggcaagccggtggtgaaggcgaatacacccattagcggcggcataataggccagccgtgaaggtgaggacatcagtcggcggcggcgaaggcgactgacggtggtgttctgactgatgcattcctgaagcataagagataagcttatagacatgaatccctactatgcatatctggatttggatcctatagtataaacatgtaggatgagtagtctttgatgttaatataatactcgaggaaaattcaagcattttgcaatatttataaatatgtatttctcctcgtatcaattttagtttccttgagtagttgacttcctatgtttaaacactatgcccaactagtcatagcccccaagcaccgggagtcggctcaaggcaattcccaaacatgcataggagtaacatgaattcgtcattcatggaacagagctttatagatcaaaatatgtgctaattgggtacttcaacaattatcaatagcagaaaataaatgattttatctctatgcttttgatttattcgagtaatactactaacgaaagatctgcgctcgtcgatggtgctggaactgtgttggcgcgaactaagtcgacaaacacaacgacctgggagatctgcttaactccagtgcatgaccaaaacttgatgagatgtgggtgtgctagtcagtttgatcctacaactgacaagatatataaattgaagatcaccaaagagctgatcagctgacaagccggtggactagttccagccgatgcccataccagctgatgtcgatagggttttgagctatcggctatatgtttgatgtagaatctgacacttgatgtaaataatgatataaagataatcggctgatgataatgtaatgtaacaataatataatccaatcggctactaatggtaaagtgttgattcgaaggttaaaacatgcatcagctggaggtccgatgtcattaaatccaaacgactagataaatagtaaaacctttgttgtgatcggctaaatcctacttgtatgtaatccttgtaagccgatgcaacgtccagattactcatcggctgaaaccccaatgaaacccttattggcaatcaaaaagcaggcaagagattatggttctaaacacgactagggcagttgcagcgcaaagtatgaaaagaaacaaaaatatctaggcaatcaagcctttgactgattttctgggtggtggcaggggcggatacaggcatggggcagctagggcttgagccccatgcctggcttcatgatccccattataattttgaaaaataccatgtaatttctaaaaatatttgaactctcattagttcagccctacgcgtgtagattttctggctccgccactgggtggtggataccttagttaatctaatctagcaagataatttagtcgatacctgcataaaccctaaaacgaatctcagccgatatgagcaaattaagatgctaaactagatttaactaagatatatgataactagcggttgtagaagatagattagaacgtctaaaacgacgccctaatctgccaatgcaaaccgctgagacaagtcatacctcttgtcagaagatctaagctgataccctaaatcgaagtaagaattcgtcgaaaaagtagaaatgtaaaaggtggcgatgcaccgaagttgtattgatcgagagatagtttacaataaccctgggtgtacatatttatacctataggtagatactagtccttcttggacaagaaagaatcttttctaaagataaaaggaaaacataaagtccttatcggacactaaacacactttcctaaagataaaaggacactaacaaactattcctaattaatagttaaactgccataccgcatcctccttgaactcggtcacttctggataagctttcttcagtagattaatttccttaaccgaatctactaagaatccgactattggcgacttgataattcctataagccgattcaaatactctgaagccgatactgactctaggccgatgatgactttggggcttaccaaatttcactgttaacacatgccccccaattttggagtatgagaactcatgcttcaaaattatcttctttctgattttgatgactccaaaattgatcgtcttctgtatatcacaatcaactttcatgagctgatactgtttgcatcaaatgagctaggctgttgaactcgtggcaaaagaatttgtccttggtaggtgttgatagcccttggaatgcaagatctgctagctaccccgatcacactcgttgacggaaaactctcgacgcgacccctacctggcgcgccaactatcgaatctgaaaatcggcaataataaaaggggtagtgcatgagacctaaaagtggatggatgcggagacaaggatttagaaagtttcatgctctctcgatgataagtaataccctactcctgtttggggattgtatccgtcgagtgtgtattattctgacgatctaatagtggttatgcccttgaggggctccctgcccaccttatataggtttggggagggtggggggaggttacatagccaaatatggcatcggtttacttaatctactgtacaatattactgaaccaggactttagaccgttcctttatatacaaggaaacataatacccaagtcatgatgtgttacatattccataaacataatctctcccatatatccagtcggttaacccagccgtgtgggtatatggcacccataatctccacataagagatcaagaatcagaaaatgctgaaacatttcacacaacgctaaaacatctgtgcccattattgtctcaattttgtgggtgattgtttgtgagagttgacggcaaagctgacaccattcccccctttttttttttttacctttttgaccgtcagcttcattgccaataatatcaagtgctacttctatagaattccagttcatattgttgtgcttttcttcctataacctggtgtaccttacatttttagttatcaaaattattggtgtatctaacatttttagttaaccggattgtttgtttatctaacatttttggttaataggattgttagtgtatccaacatttttagttaataggacatagatcagtgcacgttagccttcaaacctccttgatgtattctttccttttagacctctcatgttgtttctactctctaatctcatgatattgtaagttatttcctatcataacatgtttagttcagttggttgccaaacaagtcataattttccattgggcttcccttgtttaagcagcatgaaggaggaactactgcaatggagccgcttccagagaatggcgtgcaaacctcacaagctgaagtgccagctgctgcatctgagccagccaaagttgtagcagcagtggccgatgagatgcccgattctacaacttcagtgccactccctatcactgcagctagacatactgcctcaacaaggcgcccatgctatggatggcttattgagagtgaatccgaggatgatgaattggacaatggagtgtcagctgttgagcaatctaatcctccatctgctacgaatcataagatgagtaatggatggtcatatgttgagcaagcaaggccttcagttgctatgagacatgaaatggaaccatatactcatcatagagggatgctctcaaagaggaggcggccgagcggatgggatgtgcgcccatcctattaagatggtgttgtttcattctaatcataaaaacaataattttctttcaatatctttgtctgatctatctagattgcaaacaacttggttgcttcgtttatctgagttttagtattatttggtggttgaaagaggcatttaggtaatgtgtggattgggtattttgtttgcatggatttgttgttttgcttgttatgtggattgatgctttaaggtctcctggcactatcgttcactgtgatgtgagcatcatgtttatttggttcaggatttcttgaacatttaggcaacaacattatgatagataatgtgttaacacatcactcttctgaccggttgggaactatgcaatttttatctgtaggaaactagatatggaatttcttgtcggtaaggattagagaaannnnnnnnnnnnnnnnnnnnnnnnaaaaaggaaaatgagatcctattcaaattggtagttgttgttgcagtatgcctaattcatgtagtcttgtagacgagaaacctaatgtctataagaagttagaaggtaagttagattgaaactttataaaaatgttcgaatagtagacatgctaccatagccattcatccaagtgcaccatgcacttgacagtcaaacacatggtgcacatggacaactaggtgacacctaccagctaatacacaagatctaggtgagcagtagaaatacacagaattattggttggttgacatatacaagtaacgactcagcaactcagcaatttgcttcccactttgttaggactagcctattttgctccttgagttatggtcgcaaggttagccctaagcgtactggcccaatgggattaggcccatttaatgtggcattcgtacttgacaagaatataatattgtatctcaccatcatggtcattgttttaaattggtagctcatgtttctattgatgagcattatgattttgctattgtataaccctagatattttttcatccgccatcatctcctatatggctgatgccctccaccaccatcgccgccacattggcctcttaatcacgttacatttatctaccacattgtttactctggtatcaacacccgttttgccaaacttctccattctcccgttgataactaaacttgccaatcagcaccacttcctcttgcctcaccttctacatagatgtaagattgaggtaaaagcggttcatacactttcttgttatttttgacatatcatcactgtcattgtagccgcctccgccgcaagcctgtgacgtgctcttccttataaggtacaaagggagtagtaacacaagcacaataatgatagatagaaaaccaattttcttattgaagtttggatccaacgatcctatgtctccattgagaggctcctacaagataggttgcattcaaccctaaacagcaccaagcaatcacaaagactgggcttggttctcactcaatttacccctttttcttatggaggcggagttgaacctcaaaatacttcctgggctgtccaccagatgcttgcgagtgatatctacccaactaggaggataacatccaagagtaggaaatgtggtgatgaacaagctcggaaccaattgtgcctcaatgctaaaacgtttcacacaatactaaaacacatatgcccattcttttttcacaattttatgggtgattgtttgtgagtgggtggtgaagttgacaccattccctcccatttttccccctttttgaccgtcagcatcattgccaacaatgtcaagtgctacttctatagaattccagttcatattgttgaacttttcttcctaccacctggtgcacctatcatttttagttatcagaactattgtgtatttaacatttttagttaactggattgtttgtgtatctaacatttttttgctaacaggattgttggtgtatccaacacttttagttaataggattattttctttttttatatttttggatagcttgtagatgactaattgttgacaatgaacgattctttcgggccagcattcctcaacttagactgaagacaaattataagtaacaaaactcaagtatgatgcaaaaaatttcaaaactaatattgctatgcacataccaagaaatgacatacttcaaaaggattcaaatgaatttactgttccttctgaaaccagattgttctaaagtacctcaatgatgatccaagtatacttgataggtcatttcagaatctttgactccattagagttaggtccatttccatgaaatacttgattaggggataactcttctataattaatcaacctcaggtggtttagtaacaatttcctaaaaacttcatagaagctactaagcaaaaagcgcttatgtcaatagctgatgaaaacttcccttgggtatcaacatcctttttgcctaacttctccattctccctttgttggccaaacttgctactcaacgccacctcatattgcctcatcctttacatagatgtagggtagaggtaaaagtagttgatacactttctcgatttttgtgacatattgttgccacaatcgctgaccagcccatgtcatgtgctattccttttaagggacttgactaacatatacccaataatcatcaccgatttaaatcgtgcaacacatgttttgatggacgttaagatttttccaacaatataataataaatggttgtttggcaacccaaggtaattcttcttccaccatcgtcttctcacacaccaccaccactattgcagttgccaccacctttgcattccccaccgcccgacatcgatctccacattattagctttgtcatcgctgctgatgagggatgttaggtctcgatcttccgatcggtattgtcgtattgataaacaatcgatttgggcagagtcgcgacacaactcgatccggcttctgaacgaacacgctactgagccccgcaatcgcagcaccacgtctcctctggttatcaaccatgccgaaacccggttgacctcgtcgagaaggctaatccttgcatgcgaatcgaagaacacaagcaagaccaagatagaatgcaacacaattgcatatgaatgattaagcactcgactttggggttctacaaaccgatctagcggcgaaactattcttgacagattacactacaagataattgagctattgccaccaaattattactacaaaaaataattcgtagcaatatattgtactattgcaatgatagtttttccgtggtaaataattatattttattgcaacgatctacaatcgttgttttatttagtagttttgttgcaatagaaaatgagatatcgccacaaaaaatcgtattgttgcaaaaaacatgttctatcgccacaattttaatttttgtggcaatttacatagtacatggtacttttcactattttttgttgccgcgatcaacaaattcgttgcaataaaaaaattgttgtctcataatttaacttaattttttcatatgaacacggattgagacaaattttatatggaaattatagctctcgacgagatctacaattttataggtgataaccttttcatttgaaatcttttagatattcaaatctatgattcaaatctcagttacgtaggctcaaatggaacgatatgcattttcaacagaattgatgcgtaggtgagttggtaaaggagagcttgcgtgaaggataggtcttgggttcgtatcctagccaagacacaatatcaaaaaaaataaatagataaaatagataggatgatagattaatatttgaacttttagtttggtacataaaactaatgccacatatggagtggtggcaataatttttattacaacgacgtgaagtgttgcaatatgactttttgccacatccattccgtggcaacatctaaatttattaccacaaaataaaaatcgttgcaataacctattacgacgctatttattaccacggctagaaacgattttaaaattgtggcaacatgcatctattgccacaattttagtattgatgccacgatttttttcgtagcaacaaatgatttttctagtagtgttaatctaagcaaaacccgaatctaaacgacacaattacaaggcccgaaacccaaaatcaaattcggactaaataagatacgtggcttgttttgcagattcccagcagcttggtaggaattttgacgtgggaccaaaaccatctaaaattaactccataagctttccaaaaagtactcatgggcccctaaattccttctagatcagcggctaggtccgtttgaacttgatgctgtcaggaggcccgaatccgttttcaaaacatgtagaactttatctcgtcttctctggaccaaaagtgacgtggtgaggtagaagtggacttggagaaggtcttggtttggtccccaatcaacttctttaatcatccatgcattccttacgctcggtctcttttctttcgcccaagcaagtacctctgcaaacgaaaacacaccaaacttattgtgtagcaacgtttgttcaaatatataacaagtaaatctaatatagaatatatgcacctttggttgattaatacacataaggtagtcatggttatatccgagctagttgtgtcctcatcatcctccccttcttgattggaaaccgtcctcggtttcaccttgtcatggagcatattgaacttatctttatctatcataacatctggtgaggaacatttcttgatggtcatatggttggctcctgaaatctttgtagtcgcaaaaccacaacactccccttcttgcaaaccaacttgtaactcatttaaacaactagaggaactagatagagaatcacttatacgcatgtggtcctctagacaacacatctcatcatgaaaaggaggtatcatcaaattctcacaaatatatacttgatgtacattatattctcctttactatcataattgccaataacatgaaaaatcacatcagaagagcatggcaattcaaatctagcaaatagtttcttctctaaaaagttgagtggacaaagatcatcaaattaaatataaccccaagtatttaaagaagataacaatttaagctcttcattctcgctagcaatgtgaataacatgtttaaactcaacacatggtggctctactatagaactaacatgttcattcactagttgtggcatggatataagtgaagcatcacacaactcttctttatcacaagaaacatcaagcaaattgttttgtgacaaaggtatttcaacaattgtttccactataggttgctctaatgtagcacaagtagtggatatagttagcacatcataactatgcatagagttagcacatcataactatgcatagctttagtagttgtagcaccattattattacctttcttctcatcttcagaaattataggcgcttagtaattaaacattcctcaagcatgcacggatctatggacaggtctttttgctcttcgtctttcttctcttcctcctcatcatcttcaacgtcggaggtgcttatgtagccatcttccatagcaatgtatgcacgttgactagggaaaaccttctgcacatggccaaatccatggcagcggtgacactgaatcctgggcgtgcgtcccgtcaaagcggcagatgaggcactcttggtggatacctgcgaagaaccttcacctgaatctgtaggtcgtggggaaggtggttttggcgctatagaaactccggacgcaactggtcacttgctcgttggtggggtcgcccagaaagagatgggcttgggtagccccgaagatggctttgtccacggcatgtacgtgcgctgatcacgcccctgcaattccttctctgcaagcatagcaaactgaaacaactggttgacagtgttaaattccttattttctaccatgtcctgaatctcgcgcctcaatcccatgtaaaagctacaaatggaatcctcagttccctccactatgctacatcgcatcaatcccttttgtagctctccatagtaatcctgtacagatttatccccttgttctaaacgattcagtttcttgcttaaatctctataataacatggaggaacaaatctatcacgaatagctaccttaagttctttccatgtagtaggtaaagctctcccaacatctaacctagaccaccaaatataagcaaactctttgaacccactactggcttgtcgaactctatgttgctcaggcacaaggtgggcactaaacttttgctctactgtcatctgccgatcaaagtatttcttagcatcataataacccaaaaagacggtattttaaacttaaccttagaataaggatcatcgggcacacaattattgttgccttattggtatcgctgattttaagcaccactcatacctgtcattgcaaacacaaaaacaataacaaacagtgaaggttatccctaataatctactacgcggtgtagtgatgcctctcaacaactcagccaaatggagcaccttaccaagctcttacaagtgtcttactagcaatgctaaggacggtacaaccggtggttggttcatgacaccttaaaggacgtgatgtggcgattgcatcaatctagccggtgtgagctcaacaaaaggggaagaagcactagcaatccctagtcgcaactcccaactcgaccgataaaaacttctgaaaagtataaaaacggaaactcaacgatgagacaattcaatttttcaaggtcctggtaacaaccgacgagatgcaaaactggacccaaagctgaagtacaactcacacagacttgagtgatgaaccctacacctaagtgatgaacatatacaatactcaaaactaaaaattaaatctaagactaaaccaacactcgacccgatgatgcaatctagaattcaacaaagcaaaatctaatagaacaatgcaacggctcaaattgtctaggtaaagaataaatatttttttgtggcaattttctagttatgcaaatataaattacctaacgggcaaccgcgctatgataccaactgatgaagggatgttaggtcccgatcttacgataggggtcgttctcccacccctatcgtattgataaacaatcgatttggacggagtcacgacacaactcgatccggcttctgaatgaacacgctattgagccccgcaattgcagcaccacggatcctctagttatcaactgtgccgaaacccggttgacctcgccgagaaggctaatccctgcatgcgaatcgaagaacacaagaaagaataagatatattgcaacacaattgcatatgaatgattaagcactcgaatttggggttccacaaaccgatctagcggggaaactgatcttgacagattaatctaagcaaaacctgattctaaacgatgacggctactgaattaatgtgattagggacgtcctagggttgccctagggcgcacactctcttgggctaagcccacggcacaattacatggctcaaaacccaaaatcagattcggaccgaatgagatacgtggcttgttttgcagattcccggcagcttggtaggaattttgacgtgggaccaaaaccacatgaaagtaggctccacaagctttccaaaaagtactcatgggccccgaaattccttctagatcagcagctaggtctgtttgaagttgatgctgtcaggaggcccgaatccgaatccaaaacatgtagaagtttatctcttgtcttatatgcacaaaaagtgacgtgatgaggtacaagtggacttggagaaggtcttggtttggtccccaatcaacttctttgatcatccatgcgtttcttacgctcggtctcttttctttcgcccaagcaagtacctctgcaaacgaaaacacaccaaactcattgtgtagcaacgtttgttcaaatatatagcaagtaaatttaatatagaacatatccacctttggttgattaatacataaggtagtcatggttatatccaagctagttgtgtcctcatcagctgcgtttttttttctagcttctcaattttaatttgagtttttctgaccagatattgctatttttgcattggctttccttactatccttctacatatatctaaggcgagggtgatcacaattcatatacatccttaggtattcaccataccattattgttgctaccatcgctgttgttgctgaagtcacatcggagagatttggtcaatagttttttgtttagttgctagatatccattcatggtttttgtatttggatggcaaagaggtcgtatgttgggaggatgatggcacacaatcgatgcagctactatatatgacctactcatttcaatttgtttgtagaaataagagatgaagaatcaggaaatactgaaatgttttgcacaacaccaaaacatttatgtccattttgtctcatcaggcgtctgtttgtgagagcgggcggcgaagctgacaccatttcatccccttgttttcacctttttgactaccaacttcattgccaacaatatcaagttctacatctatagaattctagttgttgtgcttttctgtctaccacctagagtatctaacatatttagttattagaattattggtgtatgtcacatttttagttaactgcattgtttatgtgtctaacattttttggttaacatgattgatggtgtatgcaacattttgggtcaatagaattatttgcatatctaatatttttggctagattgtagatgactcattgcaaacgatgaatgactctttcgggctagctttcctcaacttatactaaagtaacaaaattcaagtatgatacaacaaatttcaaaactaacattgctatgcatatatttagaaatgaaaaactccgaaaggattagaataaatacaaattcgccattccttcttagaacacattgttctaaagtacctcaatgatggttcaagcatcctcgataggtcttctcagaatctgactccaatagagttgggtccattataatgaaatacttgattacgggataactcttctataagtcaccaaccttaggcggtttaacacaaacgagtatttcacagataaccgagaagaaattatgttaatcggcacaaaaaacaaattggtcccttcaacgcataaatggttcataaaaacttcatagaagcatacttagcaaaggtcacttacctttcccaattctatcaataagaacaacttatgaaaaccactctatgttgtgaaagcataggccgagcggaaacatcgattctttcactggcttgtactacatcaaagagtgcttactgcagggaccatgctcatacgcattggccatgtaactgaatatgctccttgtgcttggacactttcgaagataccgatcaccttttcagaaattatgatttcacaaagaaggtttggcatcaaatttgcaacttgaaagtttttaaccaagtcgggatacgacaatgtttgctcaatatctccttttgttatctatttagattgcaaatgaatgacttggttcctttgtttatcggagttttggtgttatttggtggttataatagacatttaggcaacgcgtggattgggttttttgtttgcatggattggttattttgctaaaatttgttatgcggacaaacattattttgtgtcaccatcatggttgattattgtttgaaattttgtagcacatgtttctattcatgggcattatggttttaaccctgtatttcttcatctgctatgatcacctccaacactgctgccaccaccgtcatcgccagcaccttggcctccaaatctagttacatccatctagcacatgatttgctttggtatcagcgccccttttcacctaatatctccattctccgtttgataaccaaacatgcaactcagcacctcctcatcttggctcaccatctacatatatgttggaaatataaggaatttacgataatatttaatctagaaatctagggagtaaattacgacgacataaatggattactatcaatagttaggatttttccaattagacatgctatggttgtaaactatggaaacaagcatatttaactcatttgcgcatagaaacaagatcaatagaaagaaacaaggaggagaataacatatggtgctggaacaaagtggttgtgacaatagcgagaggagaaccgttgccgttcctgctgttgccattgccattcctgttcctagtctcaccactagacgtgatgaagaggaagctgttgacatagttgtactcaagcaccaacgcagtgcggttccaaaaaacatgattttctcttcctctcgatgcaagatcaaggaaacgggggttccaaaggcctgctctcctagcacatgtgcatgcactcgcctggatgggataatcatagcatcaacataagtgaaataggatgaaagtgtgtattctctcctgcgcgggagatcaaattcattcttcttttataggagaaaggaagatgaagaggaaatgactcatggaagatgaacagaaagatagtaacttatgcatcaaccagtcagcaaccatccttcactacaccaccatgaaacaaccatcaatttgatataattgaaatatcaaattgacgttggttaccattccattaataaattattgcattaattctaaaaaaactcttcatatttacctttgataactcatgagaagatgaatacacagattctagcgtaatgagccttggaatttaattgatttaattgattgcaattgattaattacccaattaattcaaacagatgtaaggtggaggtaaaagtatttcatacactttctcgatttttgttccgtaccatcgtgatgaacccttagttccactcgacactcaaggctgttgttggcccgatcttttggtgagttgatgataactacgatttcaaagaaaggttgacgacctgactacaaccgtacaagacgttgttgtgttgcgcctttgcgatcgatacacctctccgtgggttattgatcttgccagtgcaaatcaaccctattgaagtgaccatggctactaaagatacaaccattgctcacatcatggaagaacaagatgatatcaagatcaagtcaaccaagtgctggaatcaaattcggccacctgctacactactgaattcaaacggccaccgaatctgcgtacaacctccgttttcggcccgtgagtacttgatggaaagctctcggagtcttctttccaacggatctagcctcatcgccaaattccatccaagccatccgcatattaagaaacaaggttctgcgtcacctgtcatgggcctttggccttgtaacttcgtttgggaccctggcccaagtggggcccatgtggggtgcaccacaatctggtggagcacgaccctatgaccctcttggtcattctcccacccctataagtagctaggtaccccttcagggttgcttgggttttgtttagatgaaagtttagccattgctacttccttgtagcgcgcgtgtcggctagatcgtccgtctgcttgtattcgaaaccccaacttatcgtgtgtattcattcctatttgcaattcagattgcttttatcttgttcttgcttgtttcttcgatttgcttgcaggaataggtgattaaccctgagttccactcgacactcaaggctgttgttggcccgatttttcggtgagttgatgataactacgatttgggagaaacgttgacgacccgactacaaccgtacaagacgttgttgtgttgcgcctttgcgatcgatacacctctccgtgggtattgatcttgccggtgctgatcaaccctattcctacaagcaaatcgaagaaacaagcaagaacaagataaaagcaatctgaattgcaaataggaatgaatacacacgataagttggggtttcggatacaagcagacggacggtctagccgacacgcgcgctgcaagaaagtagcaatggctaaactttcatctaaacagaacccaagcaaccctgaaggggtacctagctacttataggggtgggagaacgaccaagagggtcctaaggtcgtgctccaccacattggggcacaccccacatgggccccacttgggccggggttccaaacgaagttacaaacccaaaggcccatgacaggtgacgcaacacctcgtttcttaatctgcgaatggcttggatggaatttggcgatgaggccagatccgttggaaagagtactccgagagctttccatcaagtactcacgggccgaaaacggaggtcgtacgcagattcgggggccgtttgaattcagcagtgtagcaggtggccgaatttgattccagcacttggaggacttgatcttgatatcatcttgttcttccatgatgtgagcaatggttgtatctgtagtagccatggtcactgatggaaatcaggtggcacatgctttattgggggttaacgtcttactaatattttacatataaatagttgcttgtgcaaccctaaataattcttcatccatcatcattttctgtccatccaccgccactaccattgttgccaccacctccgccatccccatcatccaacctcaatctcacacattattagctttatcatcgccagccttttttctaccttctccatttctatttgagtttttctgaccatatcttgccatttttgcatcggcttggcttactatccttctacatgtatctatggcgagggtgatcacaattcacacacatcctcagttttcgccattgccgccgctgcaacatgagagatttggtcaatataattttagcaagtagatcactatccttttgtggttttgtttatttgggaaggtaggtatggtgtcacgccccaattttcgttcgggattgaaattatcgacaaggcctcgatatcacacatgggtaccattcgtcctcgctagaagatgaatatcagaggacgaggatgaagaactagatgaagaacacatggtggcggttgtggtttcttgtttggttgtagagtagatgaatggaaggtctttgtacatggtgttggttgtgcgattctttcaactatgaacataggagatgctagcggcatgatgcttgatgcatagtagtactactgttctatctcgagagtgatacggcaacggtctctgtatagacaacactaaaactaggactaggagtagtatattagtatgcccttcgtccaaaaaaaatcacaggataaatcacataacaagtttagccttggattgcttaccaaaatttttggcaagagtggctaggctagtgtttggttgctaccatagagtattcctccatggactttgccaaaatcaatcaaaccaaaaaactggcaacgccaaaattttgggtacaaacccaataagttacaaaatttttggcagcaccaatattttggtatggttgagtttggcaaagagccaaacacaccgtatgatttaatatgacgtcttccctctttgaattgggttctaacacaatttgatttgtagctctaaactgaaaagtgtgtgtttggtgttttctgttcctatctatccagtcaactaagaacgtgcatattttgtaatgcagcaattggatggagcaatggaggacacaccaatcaaaaatagcatgccaatcgtagagatgcatgaggtacctgctgaggctgaacccacagttgaggacatgcaggaggcgctcttccagaagcagaaggaagaacagctccagctgcagctgtttcaacaggaagaggaactggaagaccaacagcctcaggtggttcgctctctttcatttaatttgatgcattcatttcttgatgatcatccaattctcatgcttcatcttaccatcaactggttgctgggggtctaatcgtgttatctctttttttagtaaaagctctctatatgttgaaatgatcacaactatcataataaacattttggttttttagttctaatatattgtgcatatttgtagttctagtaactatttttggtatcagagagtttcttttataatacattgtgatgtgtagttagtaaatacatatgtaatattgcataatcatcaaaattttatatttccattgcaccaaaattgacccctcttaaggtctgaaagttttcaaaacgaaaatcaaatgatccgaatcgaattgcctcaacttgataatctgcttccacccacccaactgtgtgtgtgtgtgtcacacacacaaacaaacaaacaaatgtgaccacaaaacaccgaacggcaacacatgtcactaacaagcaaacacaaactaaatgccgggggtaagcaacctacagagaagctcatagctccagctaaactccacaaactacattccttttctattgaattagcactatttaaaacacaatcattgcggtgcttcctaacgtcccaagccactagggattatcaacgagttcagtcctttgtgcaactcttcaggataccccttgatggctttgccccaccatgctgagaaagaaccggtagtattgcatttgcctcacttttaaatattgaagatgaactgtacttttacccaatagtattgcatttgtctctttaaagcccatgtttccaataatagattgttttagtagtttcaatggtgtacatggtaatactgcgacatgggcaatgtacattaatccctttttttttttgccaaatttaaaacatatggttgctgaaattatccaaagtagcaattaaaggttgactttcctgtcatgtcatctctacagtggcataacccgatacacaaagctggttaggaggtaatgtgattcattattgcaagtttaggtgcttaagctggttaggagtcacgatcggtgatcagccattaaaacacctgttatttccattataagaaactaaatgaagcagtgccagaaaaacagacacaatgaatttgtttgcttaatcactatacagtgagatctgaaggatactaattattaagattaaatttgaaggctataaatttttgctggtgtgggttagccaatttgcacgctttttcttgaatgtgtcggcaggaggactaccatgttaaatgaaaaggagaggagaaattaaaagaagccgaatttacaaggtggtacggggtactggtggccccactggatggctgatttaaaattacatagtggatacttgtgaataatctgtcctagatagcttgcttatgctagaatagaagaatgtgcctccccttttatcagttcaccatgactagtgacgcaacatctttcctcgtctgtccatgggctagtacagatcagggatattgtcaacctgcatgttttatagtgaataacatagtagagagggattcgcgactaaagaattcacatttaaagggtgtagggctcttccatattaggtgaattgattgtgtctgaaaatgtacagtaattcctgaaaatgatttgtattttttagactacttcgtagctgactttgtttcgtctcagtacatgtctatttctctgttctgaacatggatggctgtcgagtctacattttccagacctatcattggtttttcaggttcacccactgctgccgaagccatcaaaattatcaatgtgacctaccttatttgataatttgaagaactaaacattacgtgcatgtttgatattttggtatggttgagtttggcaaagaaacaaacacaccctacgattcgatatgacgtccttctggtttgaattgtgtgctgaaacaatttgatttgcagctctaaactgaaaatcgcgtgttcagtgttttcggttcctatctgtccagtcaactaggcagatgcatattgtgtaattattaattggaattcgtgtgtaatgcagcaattggatggagcaatgcatgaggtgttggaatcagccaaggatcaaacttcacacgagattacttggtgacgaacaccagcgacgacgcacgccttttcctttctgcattgcaacacacacacgtatatggaatggacacaagaacagaagcctttcagcaacaaatgccttttcctttctctgttgttcactcacttaatcaactaatgattacatggctttataagcctcacaagcgcacatacttcagagcaaccaatttgcctgagtctcacgccacgtacgcgtgatttacttgacccagactctaccgcatgcacttctcctctaatccatgcaacacatgtatgtacttatctactaagtaactaactagcccattcattaaggcatgcaacatatgcatgttctaactagctagccacttgacccatttatgcattggccagcctcaacctgaacacatcaagtttccagccatatgcaaacacgtctaacacatgacgtgatcactctagacaaaactaattaacaataaaagaatcatatgcaacaagattagtactaacatgaggcaccattggaaagtaacctgtcaatcgtagaggtgtacgaggtacctgctgaggctgaacccttagttgaggaggtggatcccatgctggtcgacgatccagctacagtaatctgtggcacaagacgaccatgctacgggtggcttatagagtatgtgagcgaatccgacactgaagaggagatgcatgttccaagtcaagaaagcttgtcctgtaagcggaagctgggataatttttcatggatgtggtctgcaatctgttgatgaaaaggtacatacaaagttccaagtgtgttcattattttgcttctctttttacctggtacctgtgtgtgctgttgtggttttggtattccagctgctaatcatcatctcttattgtttttaacagagtgcctggaaaagaagaatcaatgtggtgtgcaaggcataagatatggcccttgcttttaaggcagtctgaagttgcttctgactttgctcaaaacagtagttgtacaagtattgacacaaagcagccaatttgggttattggacagaatgatctgtactgttgactgtagacattgaaaacatagtatactcctacatattttaataggagtaaagtctatcaccggtccctaaacttatatcgttgtgtgatcccggtccctaaacttgtaaattgaccgttcaggtcctcaaacttgttcgactgtgtcatcccagtccctaaacttgcagatcacttgtttaggtcttccaacttgttcagctgtgtcaccccagtccctaaacttggatttgaatatcatctgggtcaaataggacggtctaaatactttatatttaaaaataattcataactttttcatgtgaactctaatgaagataaactttatatcaaacttatagcccgcgacgcgatctacaactttgtagttgaattttttttattttaagtcattttttgtcccaaaatgtaatttaaaattaaaattacaaaatctataaatatgcaacaatattttgggaccctaaacagttttaattcaaaaacttttcaactacaaagttgtaggtcgcgtcgagggctacaattttgatataaagtttgtcttcattagagttaacatgaaaaagttatgaattattttttgatataaagtttttagaccatcctgtttagagaccggggtgacacaactgaacaagttgtaggacctaaacgagtgatctgcatgtttagagaccgggatgatacagtcgaacaagtttgaggacctgaacggtcgatttgtgagtttagggaccgggatgacacaacggtataagtttagggaccggtgatggactttactcttttaatagataacaacgttaattttttttatacatttaaccattcgtcttattcaaaaattttatacaaatgtataagatataaatcatgcttagaatactctcacaacaaaataaattatagttacgtaaatgtttcgaataagacgaatggtccaacgtgtgataaaaagttaacggcgttatctattaaaaaagggaaaaagggaggtagtattagagtacataagctctatgcaacaggaaatgtcaaatgtgggatttagttgatctgtgctttgcatagatagaacctgaaaacgtacattcggtttgaattaggacccttttccatgtctttcgtttgtatgcttcaaaagtaaagatataacgtcaaagctaatgaaaatttcaaaaaaaaaaaaggaatttccgttgccgggactcaaacccgggtctctcgggtgagagccgagtatctaaccagctagactacaacggattatggcctcgctgggttttctgctctattgtatagtgatgtggaaaagtctttactgccaacgaattaatttttaacaaagtcaccatggatacgaatactacgtctaccacaaatataaaattagtattgtgagtctaaaatttaaaacttaaaccctggtgagttgattccacgtaaaaaatctaaccggttaagctacatttaatttgtgatatataaaacttgttacattggtctgatcgaaatatgtgcctgccggaacataatggacctattgtttgattaatgatgtgaagttaatataatactacctccgttttttaatagatgacgccgttgactttttcgtacatgtttgaccattcgtcttattcaaaaaatttacgtaattataatttattttgttatgagttgttttatcactcatagtactttaagtgtgatttatatcttatacatttgcataaaatttttgaataagacgaatggtcaaatatgtaagaaaaagtcaa

SEQ ID NO: 61684 - DNA, 1201 bp, Oryza sativa
ccacgggagtaaaatgtacttttttttattattagtttgtgtaaacaactaaacacgattaagcttctctactactccctctatactcataaaggaagtcgtttaggacaatgtttaagtcaaatcttgggaatataaatcattaataattctcaagttgttgagtttgaaaatgtaaaaattatatgaatagatttgtcttgaaaaatactttcataaaagtatacatatatcatttttcaataaatatttttatagaaaaaagaagtcaaagttatgttttggagaccgtgtcgctgtccaaaacgatttccattacgagtacggagggagtacctcttaattagaaaaatacactacctccaactttccaagtctctgaaagtgtgcaagtaatgtgcatagactcttgcctgtagaaagaaaaaatgcctagtggcagctggtgttgaactgttgcaattaattgccacaatggatggaccttatgctgttgcgaagagtcctcgtcaaccagattaccagcgctttgcacaatcatggtcagcactagccaagttgctgttgttttgatcattcttgttaagatagccaaacattttttctagtggcaagttgccctttcagatatgttgtctgttgttcgcacacggcgacctcgcattccttcccaatctcttgcagaagaacacattaaactagtaaccaacttgtaattgcactgcagatccaatgcatgcagaatgaaaaaacaatgcacaactgtacaccctatgcagctagctgtgcattctcaagatatatcatgtatatgtatatatatagcagatataaatctgtaagcttcagccaagcatggaattatggagtagtactgtaagaaaatgacttagtgatgagtccattatttcagtaatttaagtattggttcttatccattatctaaaaaaaaagtattggttcttatgccatacacttatactacagagaagaaaaatcttctcactttgaaatacagctcagcgtgcaccatgacttatattgaatacagatatgttcattaagctccctccatctcaatttctcattgttttagcatttaaattttttatcaaaatacttgccattatcacatttaaaagcatttttagaaatgtctgtcccatcctacccttcattatctatgcagtcatacgtacgt

SEQ ID NO: 61685 - DNA, 72830 bp, Oryza sativa
  unsure (1)..(72830): unsure at all n locations
catatgaaatataacacaactgtcctggtatttttatttggttttcctatattatgtattgaaatcaattaaaatgtatataactaaaggatctacatgctgacacactttgtggaacctgattttcctgcttgcagttacttaggttactagtaactacagtgtatgcacttgatctcacgatggtgaatggagcaaaagaaaccataccagtatactctgctaatgcagaaagggcaattggacttgtcttgaaccgttcctttttgcaaatgtacttgagcctaagacccaacaaagacatggtcattaacaacatggaccataatatattgtggctacataaaaaaaagtttggtgtagtgagatgtaacaagagtatttttacataagtacctgttgacaacacgactaatcgttggctgaacaaacatatgaaccctgtaaatttaagcaagtccttgtaagaaatgcttagatgatttaacaacggcacagaattacagtaaaaaccacacaagaattattacttagctacttggcgaagttgtctcagagctggagcataaagatcattgcatatacaaattacctgtaaataaatgcattattatttaatcataatgttaaggcgctaaaattatggcaaggaatggctagattgcttacaggtctcatcagttttggtattttgtgacctttctttgaggactttcgtacttgagtatcttcagcactagtgctgctgttagaactgttgttcttttcagcattgatctgcacaaaagagtcaattatcaatgaactacagtaacatatgaattaagctagaattgatgcagcatttatcactagcataatgcagaaccataaaaaaaacaagaagagagggaaagtaagaaaaggtagcaaaacatcatgttgttgaaagtgtggattaggtgctaccatctttaaaataacctcgactgcacctttgccatcaccaagtgctccatcaatttcatcaattacctacacaagacagcagaggtctataggatacagtggaggtaatttatttatctgacagcatgattcaactcaccagacacttgggtttcgaatcagacatgattgagttcatctgaatgacatcaagaattttcggttcaatggatgaagcagaacgatcatcactcgcatttatctgcatgtagtatgatgtaagtagtgtataaatttttaaccaaagataaagggcccaacattctaatactcaattagccaataaaccataactaacaagaggtgatgaggtcagagaaattctgctaagagcatatcattattttctaataaaaattgcaatggtcccagttttccagcttataaaatgtaccaaaataatatgaaacggaagaaatcaattcgtgactagatggtatgtacagaacagtagacaacttggaaggatatcaacagatatgtttgatgcagtaccagataaaaggggtgtatactcctcgttatatatgaccaaacagtcaaacataacagattatacaacactatgttgaagaaccaaaaagaactacacaaaggacatgaaatcacataatcagacctccacaacatggtagccacaatgtttagctgcaacatgggcaagtgttgtcttgccaagcccaggtggaccacatagtagtaacacctgcaacatcgaaatgttatctaattgcactagccagcaacttcttggtagaaatatatcctgcggtcaaacatatcactaaagacatacaaaacaatgctactaagccaccttttgttctggtgcattatcagtcgtgggcctcttgttaaaggagcttgtcaaatcctctgagttgctaccatgtgcattttggagcatgttgtcttgactcataccaggacctcccttactcttggagaagaaatttctgttacttgaattcttttgaatagcagaagaatgtcggcgtaaggcagacaaaacatcatcacctgtagcacgaacgtgggatccaaacacacaggagtcccactgttttagccacagaagtacctgaatggcatgcatccgtacatgtcaagagaaactcaagcacacactggaaacctgacaccaaatagcaaaatctctatggcggaaggagattattgcagtaaaggccttatttataagtatatattttaagagagttgaatagacatttacctccctgtttgtgtgttcatcacttaacagctctgtgaaagaatttggtgagtatttttccacccaaagttgctctgtaactagcggagtcactgggcaactctcaagattttgtgtttctgcactctcctgcaatgccttcataaccattgcaaaatatggatcagtaagatatactgcatttagcttatgacctactgcaatcaacatggtcttgagcggatgaaaaaatgttatggtaaaaaagaaaccatttgtaccatctattcagtataaaataatgttaattatcattacttaaagagtacttcacttttttaaaaaaaaaactattgtcaataatctcatatacacatatacctttgctagagcctcttgctcagcacgacttgtcagcgaatgaaaggattctgagagaagccctgcagaaggacaaaaggcgaaagcaatataatgggctatcaaaaatattagtcgagtgcatgttggttctcaggagatatttgaaagcgcaaaatagaagtacacttagtaactgacccttgtaattgaaatttggtttggaaatgcgagtcctttgtctagttcccccgattcctcccccatccaacccgtctgttgcaaccttcgcataaaccctctcaccattgggcgcggtgacagacatacagtccccccggatgtccgacgcgaaccgcgagattgtcttctcggcgacaacttcaacaacaggaggcggcgagtaccgcagccagtcctcgtccccatccccggaatcctcacgatccacattcctccgcttgctcctctcctccccctgctccggcggaggcggagggggaggccgcttcaaattgccttccgacacttcatcttcacacacatttggccaaccgcatcagcagtcgaaacaaaatactctcgagactaggttaccatctaccgtgagggagactgtgcacgcacctgcaggtttcgagggggcagcggtggtctcctgcggggaacgccgcggctggtccgctccggcggcggcagggaggaacccctcgtcctcggggtcgtcgaagtaggcgtactcctcttcctcctccgggaggagcccgtggctctccatccactcgagctcctccggatctggcatatccatgtccgcctccatcgccgccgccgcctcgccgacgcagcaccgagcagaaggggagggagctaggcggcggcgaacgggcgaagtggcggggaatgggaattggtgattggggtgtttcgcgccttccggcgagtggttttctcggtctccgagggagacgcggggatggtggtaggtctcggcccaacttgttacttggcccaataatgtcttcgaagtccattggattggtgggcttctggataggaataagtccactttaactcccttaaaaattatagatccaatttgattcatatcgctgaaccgtaatgtttggatatcttaaccccctaaactataaaaactggtgtattttacctctctcatctgttttggaagacgatttcgctgatgtggtactgtgacttgatccaacccattgagtcattttgtggggtccactcatcagtgacccactgacccttctcttccttcctttacccctcctagcttcgcccggtagagcatccatccatggcacgtagtgagtgaggcagcggcgagttctttcgatccagctgcatgctcttgctctatttttccctttcctttgtaaatttggcgagttctagtcttctaagatggaggagaccgttgtggaagttggaagcaacgagtggctcgaagagcaccatggcgtcggcagtggccttggcgcacgagctgccggaggcccggctcggcgctagggcgcggctgaggctaggggcgaagctccggaggaggtgtttacacgagctgatgcgcaccatctcatgcttcaagctcacttggtccttctcctcgttggtgagccgcatctgcgtcacctccagcttcaactcctagttctcctaccgcaccgacacgtagttgacctgtggcgacatcgccccgctcccccaccccactccctgccgtcgtgcgactacgtcgcggtggcgatggcggccacacacccgaagaatgagcgttgtgttgtgcccgccgccgccctggattgtgcgatggagctgctcagctgctcgaaggagagcatgtgcaccgctatctgcacaggcagctactcgttctgcgccgtgtgcaaaatcctgtgtcgttgctctgctggcgggtaggctccacatgatgactcagtggattggaccaagtcaaagcgccacatcagcaaaaccgtctttcaaaacagtcgagagagttaaattacatcggagtttatggatcaaaatatctggtatgcagttcagtttcaaagatatgaatcagattaaacctatattaagggagtcgaagtggacttattacgtctcaatattctggcgagattgggctttccagtttgtaccttggatctgacgccgaaagctcatcagctgacagcaatggtgaaacaaagatttgcagtagtcccacttcgccttcgctgctacggcgatgctctgcgaatctgcgaaaaacgcaaccgaccaaacaaagttttccagctcggaccgcatgcgattctttgattgtgtcggggtgtcaaatgaccaaacaaagtgttgattcgttgtggacttgtggactcggagcaacttgttcagttatcgttgtcgttgaaggggaagttgcaaaatccatgttttgtcccttcatattgcttgatacctgctgggaaattcagggtttcaggcacccgtattcacacacagatgttcgcctctatgatcacttctcttctattttgccagactattgctgtgtagttgcagttgcaggattcatatagccaagctcaaccgtgcaagacatccgtgtttaattatcaccgaaaaaaatgcagcagcatcaacgagtacaaaatgctagagcaagttgcaacacagctcgccagtctctttctttattctccactccagatcttgaatcctgattagcaccgctggttttccacccacggaacgatgtggagacgagagaattgcttcgacgacaatagcggagaaaagcgaccgaaagaaaacaagcatccgcggttaagcaaccttgcacgccatttcctgaatataaacccgatctttgtttgtcttgatttctacgaaagctcaatgcaagcctgtcgttggctgagaatttgagaagtggagatgcttgttgcacctaaaatggaagcattccgctgggcccaactgtaccatcctgaccatggtgtctgtctacagcttgtagtagtaggacagcgtaggagccacgagactgcacgatctgctgttccagataaagacgatgatgaatgccagatgctcctttgtcttggaccagctccctgtcgtcaccattcaccaacccatgaggacgggaaaaatcaatcctccgcatttttattctctgcaatcaagtcagcacacgatgggatcacgcccggcgccggcatgtcgatcagtagtctcatgttcccctacgacgggggaccgtggcactagctttcttcttttcttcggtgttcaacacaaggatctccaacttaccacaacttctagatgaaaacgaagtggaattggacggataatagcaacgcctatattctaaaaacacccgaccgagtcgctctcacccgcaccaataatgccacatgcagatgatatcacaccgggaatttctgctgctctcggtctcacgaaagcggtcgggcagagcttttttttttttttagagaaacaaccgtggcggcagtagagaaccatatagatggatctgactatctaagtaaacttaggctgtgtttagttccacgttaaaattgaaagtttaaagaaattaaaacgatgtgacggaaaagttagaagtttgtatttgtagaaaagttcgatgtgatagaaaagttagaatctaaacatggccttaatagaatacataaaacatcacaaggtcatgtgagaaatacgtgactccatgtgcgtcccaaaccaacgggaaaattattactgtgtgcagatgcagttgtagccagttatggccgccgaagaattgagggtttgagaccgtgggagtatgatacacagtgatcgtgacagtaatttacaggtgcctgctttgtcatttgtcagctagcagctttggcatcttaacgcccgccggatcagcgacctacccccattttcttttttcttttaccggacatgcgagtagatctggctaatacgaggtgaaaacagatgctttgcttggataaccttcttaatcacaatagctgagttgcgtcaaactccattccggaaaagaaaatagctccatcatacatccatacgtagccagtaggcggtggcgtgttgccaagacatcatggtttagcgacgggggcaagttgtttgtacttgattatacataattatttttaaattatagtcgtgtgttaatctatgtagataaacgtatacttaagtatgaaatatctacatttagcgatatgtttataagtatccatcatttatttttgatagtaatatatgttaaaagacggtgttatatttgccgagtgagtatgcgtgcgcatatgatccgcgcacaatagacagagagttccacatccatgatccgtcgtgtttgaaaaatgtttgccattaagaaaggatatcacaatttgtttctccactaaagaaagagataggcatcaagtacttcaccttgctcttgctgatcgtatatctcaattatacttagcttaaacggtgggcaatcctcaattgccatctgctggtcatcgtgacaaagaaaaaaaattttatcaataaacatttatatttatattatgtacttggtgatttaaaaggtaatataaaaaataaactaagataaaaaaacttaaaatcaactttaaaattaagtttcggtcgctgcgataaaaaaaaaaggtgaatgataggaggctacaacccttttctttcattggattttgccagattcacggattatttgttatatgcttccaaaagcatttttaagagaatattatactaatgttttgtttaaattacttgttcaaatatattggttaagttcatttatgggatatttaattatatcatactcgtatcaataggcaatggaataacacgtttagtcaagtacataatatcacaggttctttgtgaatgcgattcatggattatttatattaaaaagatagcaagagatggattgggagaccaattttcaccgaacttcggcttacaaagataccacgtctatgtgagggactttgaggcgaatctcggttgatcccaagcctcaccaggtaaccaccgagatcgagcttggttcctaggttgtcttgccttgcggaggtggagcaacgccttcacaaacttcctaggttgtcttgcctgcaagtgctggatacttgcgtataatgtccaaccagctaggatgagaacatataagattaacaaacttgaagacgaaggccaaccaccgatcgccaagtgctcaagccaagtcctggcactcacaaactcagatcctgcaagaaatccactccaatcttagtttcaaaacaaaaaggtgatgcgccttgagccatttcactgtttagctttcatttgtggggttagcaagcctttagataatcatccattggactaatacatgtgttcaacacttaactagctcatttgtactttaattattgctggaggtaggccataagatttttttagctggcatgcatcatcatatggtaatgaagcataatggagcatggcgaagccatgagaagcatagcgagacatggcagagcgaagcgaaatgcaacaaagcagagccaagtaagcctgccaatgggctggattgaaatgggcccaatggattggtttcagctttgggtgtagtttggatggatggaaatggattgaggagtttaatgggctggactggttagggtggaggtggaaacggtttggattggattggtttttggtttctgatttttggatccaaattggattcagtccatggatttctttggatgcactagacagtccagtactctccaaacctagcgtcatcagtcgtccacggctccactccttccaccgccgccgctccctccccttgcttcgcctcctccacctctccgccaccgtccgcgaatccgccgccaagccgtcgccggtcagattccctcccccaccaccattgcttttctttttccctggtttttctcggtctttgatctatcctggttgttttgtttgtatttttttttgggtctcttcctgatcttggtggttgcaagtgcaggtgaagcagaagaagaggaaggtgcgtgcgccgccgggcgttggcgaggatgtcctcctccggtggtccggccgcgtcgccaatctccctgagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgaaaattatttaacatatcattacaaattgagtcctgatatgattttgagatgcaaattaattctatggtcaatcgaattttagtgtgcaatttttagattgtagcacgtgtacaatgtgtgaaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattggcagccaccaaaaagtcaggaacaagtcaccttattaatcacatagccgaatcatgtccagctattgatggtgatgctagaatcaacttccttgcaacaattaagaaacagactggggaaggtttcgtgtttgttcccaagagaagccgggagctaatggtcagattcttcattcatgcaggtgccattcaagaaaattgaggatccttattttttggagtgggtggagtccatgcagccaactttcaaagttgtgggggcgtcaaacacttcatgatgatgcctttaacttgtatgagcgaatgagggaagacttgcatgctgaattacataatcttgatttgcacgtatgtctaacatccgatatgtggacttcaattcaaaatataggctacatggttgtcacagcacactatattgatagagagtttaacattaagaagaaaattataagctttaaggaattgaagtatccccacacgggattcaccattgaagaagctataatgagttgcttgacatattggggcattagaagcaaactgtttactataactttagataatgtcagtaataacaattctacatgtcaagagttgataaagaatcacaagaatgcattgatgtttgagggtcagcatttgcatgttagatgttgtgcccatatcctaaatattttggttcaggatggtatgaaaataattaaacctacaatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacagatctgtcctggatagctatgcaaatcaacatggtgaagttgcacctactgaactagaatggcagaaagttgaatcaatttgtgcttttcttaaagcttttgaagaagccacattatcagcgttagcagataggaaaccaacatcacgtaggttcttgcccttggtgctacaaattcgtcatgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgacagagattgtcgaaaaagtgggttctgctgaagattggttgaaggattattatgaaaaatacgaagggtttgtaagaagaaatgatgaacacatgctttcacattctcgtgaaggcagcagcagtgttggatcacctgttcttgggaaaagaaaactcgaggaagagtttgctttatacaagtctcgaaggaggactgcacggcaaacgaaatcagaatttgccatatatttagaagaagatgttgaggaggatagtgagagtttcgatgttttggactagtggaagagacatgctaaaaaattcccggtattgtcatctatggccggagatttcctagaaatacccctcagcactgtatcttccgaatcagcattcagttgtgggggcaggatacttggtgacacacgaagttcgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcataaatccacccgtggattgtgttgaatttggactgagcaactttgtgggttgggttgggtggggttagctcaaggaattcttggtctggattggagtgacaattttgctatagtcactttgggttgggttaacccattggcaggcttagagccaagccaggcggaacattgcgaagcgctctggagtcgggtgaagctgttgagtccaagattgcgatcggcctatggaacagatgacaaaggccaccctaaaatgccttccgagaaaggactgtcccagtaggcgacctatacataacccactaaaaataaaaaatatatctgtaaatatttctatcaaagggattgaaatataaaagcctatgtaagccaaaccctaggattagctgtttgagctataaatttataaatatcccaaaaaaaaaacactgtaagacattggaaaaaataatacatatcttgctgttccttcatcccaacaattactactattattatcaatcatctaaaacccgtaacggcacactttcgtccatgactgatgctgatgaagttctccgtaatgatatgtcatggagttgtttgtttctaactatcaacacgctacacgcagtggcggagctaccacagggtctctggggtctcgagaacccactaccgtactataaccatgggagatcccatgaaaaccccactaaaattttctgtcatacatctattagaagagggggctataattttatatagtttgttcaaaccctccagttaatcttttctggatccatccctggctacacgtggttgtcatgttaggttgtgtggcttgcgaactgtgttttcctcgtgtctcctttggaatggagggaaattaaagcatttgagttcgtatgggttacttatttgaattctaagttcaaaccggtacttcatgcgagaatcacgtcaggaatatgaaaggctcaaagaggggaaaaaaacatgcagcacgaaccgaggcccaccggaccgggcacatgcgcggccactggcaggcgggggctaccgctggctgcgggggctgcgggccagagtctaggctggactggccggacgggaatcgcctccccgtctcgcacctggcaatcagcatcggccggcgaccacacacacgagtacacgacacatccgatccccatccgtcctccgtacgtgccaatgaaatattcggccggtggggcggaggcacgctgtctgcagccagacgcagaccaccggcgagtgcgatccgagtggccgagcccgagagaaaaaccacggccacaccaaacccgccgtgcgggggaagaaaaaaagcacaatattctccctctcggcctctcctcgccgtagtgccccctcggacctcggttgattttttggttcgcgcacgtcaccaccgagagtccaccaccgcggcgcacgggaggaggcccgattcgattccactcgcccgttcgttcgctcgtcctatttttttcttccccccaccacggcaattttttctctcccacggccgccacgccactgccagtcaacagctgcacctgggctcctcctctcctcgtcgccgtcaccgtcgcgcgccgtcgtgttggtggtggtggtggtgtgcgggcgggcgggcgccgctcgcgtccccgtgacgctgcttcccagcgccgctgcctccgccttccacgccgcgtgggcgcgaaggcggggcttgggagttggaggaggaaggatagggggcacggcacgggtggcagtagtgcaaggcaagcaggtccccgtgtataattcgggcggcggcggcggcgggttggatcggggaatcggcgacgcgggccagaggaggaggaggatggggcagcaggcggcggaggcgcagccgctactgctgcagggggaccaggtggacgccgagtggggctgcaggccgcaccgcattgtacttttcgtcgagccgtcgcccttcgcgtcagtgctctctctcctcgtagtcctactagtcagatcatcgtactagcttagatcagatcgagatgtcaaacctgccgctctttcgatctattgaactgcaaagtcaatagtttttgctcgttgctgtttcgcagttacatctctgggtacaagaatcgcttccagaacttcatcaagcatctgcgagagatgggcgatgaggtatatgatctttttacttcatctggctgctggctgcttgtgtgtgtagggcgtgtatataccttggaattgacgtgtgctctttcgaaacagatgttggtggtgaccacgcacaagggagctcccgaggagttccatggagctaaagtcattggttcgtggaggtaatccaatacaaactagaaactacttttaccttccatttagcattcggtctacctgaggagcaccaaacacagaatacaagaattactttcctgaaagcacaaaacttgctctcactgcgaaatagggccttactcgcatgctgaagcaaaaggaaacaatgcaagcgaagtgtcatctagtcaactagcatgctgatttggaacatgtgcttgttgtgaggtgaaattggtgatgttgcacttgttttccaatattttgtctggtcaagtcgtcaagtatatatattttagaggacactagaattcttcttgttgaaatttcttctatctgcatgcacttaattgcctaaatttctatttctcagttttccatgtccgttataccaaaatgttccactctcgctggcgttgagccctaggatattttcggcggtggctaaatttaagccggacataatccatgctacttcacctggagttatggtaatcattaaaaacccaataggtatcattgtcctttctttttgtagtttctcactatatattgtgatttcaggtttttggtgctcgctttatcgcaaagatgctttcagtcccaatggtgatgtcatatcatacccaccttccagcgtgagtttctcttcttaaaatcatgaatacttctgcgatatgagtcctgcatgcataatattgttacgagcagatcttacagcctctaaattagggaccagatatagtactgtagggcaagaccatcatagtccagtgatttccctggcagagatatttactttcgaaattttgggaaaaaaaaacacattactatgtcatgctattggaggattaaaaaaaaacttggatgcatatgcatggaatcaacaggcaaaagtgttgcctccccaatgttgattaaagcatccaaccgaggcacatcattacaacactaattctttctgttgcaaattataatacctggtgttgattcttgagctgaattcttgtcatgactttcaggtatataccaagatacaatttaaattggttacttggacccacatggagtcttataagtaagcataacatcacctctcagtttgttcttcataaaagaaataatctgacagcaaaaatacaactgttctttctcattaaatttgtactgacactcttattttgttttgaaggatgtcttcataggtctgcagatcttactctagttccgtcagtagctattgccgaggactttgaaactgcgaaagtagtatcaggttaaacaattaagataaatctatatttcttcatttcattccttcatccatcataaccgtagtttccttgtctcttcagcaaatagagttcggctttggaacaaaggtgttgattctgaaagtttccatcctaaatttcggaagcatgaaatgcgcattaaattgaggtttgacctatttctttaatattcaatagcagtatgtgaaaaaaaattgtgcatagctaacttattttcctttttctctcttgttagtggtggtgaaccagaaaaaccactcataatacatgtgggtcgtttcgggcgtgaaaagaatttggattttctgaaaaggtaatctttttggcttgtacatatcactgtttgtcagtgtaaaatcaactccaaacaaaatttgaagaatatagatgggggaaaaatggaaagagaaagctcctcaactaacaatggattatttcatagtacatccgtcccaaaatataacaacctagaaccgaatgtgatatttcctagtactatgaatctggacaactacagtgaaaacatctgtggcatgttgttttctctggcatggccattttcattagttgtccctgagttagcataacttgcaatcgtcttagccttttagcttgaatcatgcttgtaatatgacttacatggtcctgtttatgactttaaccaagcagccatttcaaattcgtcacatgtatcatagatcacttatctgtatgtcacatgttcactacatggttgttattttgtcatgtcatcagaactttgcttattttggtgacaatacagggttatggaaaggctcccaggagtaagaattgcttttgttggtgacggaccatacaggtgcattccttaatgttaaatatttttcgttatcaacaagactcatacatgataacatatatattgaaatgacactatttggagcacttcagttttatcttttgcgtatgactggtattatatgcacaactgtaggtgcctagccatctgtttgatccctatagtttcatcttgaatttggagaaacttatgcggcctgtttaatctttggcagggctgagctggaaagaatgtttactggcatgcctgcagtattcactggaatgctccaaggcgaggagctctcacaagcatatgccagtggcgacttgtttgcaatgccttcagaatctgagacacttggtcaagtagtgctggagtccatggcttctggagtcccagttgtcgctgctcgtgctggaggtatacctgatataatacccaaggacaaggagggtaaaaccagtttcttgtttacacccggggatctcgacgagtgtgtgaggaagatcgaacagctcctttcgtcgaaggttctaagagaatccattggaagggctgctagggaggagatggagaagtgtgactggagagcagcctcgaagacaatacgcaatgagcactactgtaccgcaacgttgtactggaggaagaaaatgggcagaactaactaggtttcgcttatcgattcaggaatcgttcaccgccgtctccacctagttactgttaataaccaaagagtttgtacattgtatccaacagcagctcgcgagtttgtgcggctagctgcattcatgtgttcacaaatcacaatcatgggatggccactgaccaaaagcttgtatgcgagtcatgtacattagacagctctttgagattggcgattactatcgaagtgctaactgctaatttagaatactggaggagttgcctgctgtagtgctgtctctagagtgaaagttgaattgtgtgttgttactgtgagctgctactgccaactttctgcctttctggtagctttgctacatttgcgttttgaacattgccatagcgtaaaacctcgagactacggctgtgttcagatccaaactttggatctaaactttcaactttttccatcacatcaaccttacatacacacaacttttcagttacatcgtaccaatttcaacccaaactttcaactttggaaggaactaaacacagcctactgcattttttcatgccgactgcgagcttggcagagtgttgagtctgttccaccagcagaagtgtgatctgtaaccctgtatcggccggcagttaagctgcaggtctaaacagcacatttcacgcatacctatcttatcataatatttatgtatacaggaatattattaacttatataagcacaaaagcgaagatgaagtcaaacagcaagaaatacgtcctgatgtaaatatgtactacttattgtccaactccaccaaaggctgcagtacttaaaaacaaagctacaacttaggaagaaagggtcaaacagcaagaaatacgtcctgttgtaaaaatgtaatgtccaactccgacaaaaggctgcagaacttaaaaacaaagctacaactttatacttcacaagatgaatcaacaaattgaatgagcgcggaaaaatgtggacttaatatggttttccacagaacatatacaactattgcagcaaaactaacactacttaaaacaaagctacaactttccattttacaagatgaatcaacaaattgtatgagtgccccaaaatgcggacttaatgtggttttccacataacatatacaactattgcagcaaaactacactatctctatcaacacaatcccctccgccccaaaaaaaaaggtgatatccatgcaaacagcacaagcaacatgttttcattgacaattgattaacaccacaatattactccctccgccaagaaaaaaggtggttttcatgcactatggcataagaaacatgtaattgtgcacagtcgatgtctcagcaagcaggttttctgtctctgctcattacttgtttgcatttgacttgctgaacaattaaacagaaaggccatggaccgtgacagtagtagaaaatcatcagctgtacgtttggagaattggaccttccatgtactgaatggccctatccattatgctcaccaacaaaatggtaagttttcagaggaattgcagctgcagatgcatctcactacaaaatcagtcctgaagtatgtacgggtaacaacaagtaacaactgcaagtcacatatgagaagcttcaagctattgctgtagacttttggcatttgaagcagcattgttattcatcttgcagcactatcatgacttctccaccttgactgagaatgctgtctagaaatgcaataagtttttctttgtcctgaaactccttgggtgcagaaaaatcactatccaaattaaaccaagtgccattaatgcttcgaattgccacccaatgccggccagtccaaagccctctgaacctcctgacgggtacattgatcatcagaccaaacaatgcatctgcatccagatcgattgaagaagcccctttccgatgatcatgccagattaccttcttctttctagcttctaatgctgtgatgagtacatttacatcatagttcccggtgaatacgttgtggtggggcttaaaaatcaatgacataggagtccagtgctccttatttggatcaatctggacgagatttccagcaatcccatctaactcagctcgggtgaaagattccttttcctgaaccatacaaagcataattgacagttaaaaatcggtacacccatgctgtttctggtaggatcacactaccttttctgatttggtcataaacggttaagcaggcaggaattgaaaaacacttgtttgtaatgctcatgcaatcatatagactccttgcttgcaagtacaaaattactctcagattcacataagcagcaatttcacatgtcgtgaagaaaatcaacaggacataaagatttatctctactaagctatcagctgaaattcatgattgacgagagctttaattatgattgaacaaaagcgtgctagacgaatgtgaaatagatataaatgtgatgcgcggttgatgaattcatggaaaacattgtccaatccgccgaaccgttccaacaaataacactgagagtgaccgacttaagtatgctgtagctttcagatgcgaaagaacactattccagttttcctgcgtccaatatcgtgagatatttcaccagcacacaagttttgatgacatcgattcacatggaaaaaaaaatgcacatcatggacaacagaattggagtacaacgttcaactgctaacaatttcctcactaatatcgattagtgacataagccacgcaaaataaggaaatcatacgaaaaaggaacggaagttatgtgaaactctcgagagaaaaaaaagtagagacggtagatagaacttcttttgtttagaacacaacaggataacaccggaggggagagagacgacagacgagctacctgcataaggttgttgagggcgtggaggagacagaactgcagccgttgcctctcgtgatacaccttgctgcttctgctgctgccgccgccgccgcccatcgcactcgatccctcctcgtcttgttttgcttccgatttgggccccgattccatgcggagatggtgcagggaggagaaggagggttcgggttcgaaggaaagattacagcggcccaagattcctcctctttcttctcgccgccgcccgacggccgccgcgccgctacccccggcaggaacttctgggtcgtccttcccttctttaccaaacgcaacagcacacaggacaggagattcaccgagtcccggactcaggacacgtcgcgtgttgtggtcattgctatttcgcgaatacaatttcgaaaagaattctctccatctcgcttcctataacttttttgctaccgaaaacttatatactaccggtcactgaaattaggaaaaacttcagccgacaaaactataacattgcaaaatcacgagttaaaaacacatgttgaaaaatattatcttatgtgtcattgatacatctgtttagacttcacatattatgatactttactactcgcttatttttatgatggcaatttttaaaaaatttctcaattagaaactccaattagaattgctgaaacaacatcacttttacagctttaccctcttttctagggtagggaactgtttacactaaaattgtctgtgctctaaatattcgtagtttcaaaagtaaacatatataataaagaactctaggtttttaaccataccagcaacctcaaattctcgcttcatcgcataagcatgggtttggttaaatgattggaatcggttgggtcgggataaacctattttttagggtgtttgatttggatgtaagtgagatggaatgttccttgaaaataaatattccccctaaattcgaattagcactatacttagagcatctccaacagatgcctaaacaggtcccaaaaattaaattttaggattttagttcaaaggaaagctccaacagctgcccaaacttgctcccaaaaatcccccacgcccaatccagtcccaaaaccgagtcagatttggggcagccctgggcgttcccaatcgcagcgatcacacgtagatttctttgctcgcgccaatttcttcctcctccctcctctcctcgccgtgccctgctgccgtcgctcagtcccctctcctagctcgcatcagatgccgccaccctgccggtatcgggctttctccgttccattcgtctctgtccagaccggcacctccatccacgccgtcgtggccgttgtcgtccacgccgctagggccatctgtctgcatactatcggcaggtcatcctgatccacccgccgatctgtaagctgctcaagccctagtactgaatgaacctaacggcctgtttggttggagggagtttttaggagggattgggagtttagagggatgaggctattaagagttttgtttggttgggagacatgagaattttggtaggatggagatagggaattgaggaaggaactcccttcttttcaatacctgggtaggggcaggtaattgggagggaattcctcctttactttttctaagcaaatctcagccatccctttttattaatgacataatctccaactaaactccttatcaatttccatcacctctaccaaacaagatattaggattaaaaatcaaattcccatcttaatctcatcatcaattccctcgtgtaaactcccaatccccttccctcgagttaccaaacaagccgtaaagaaagttttgacgatgtgtatcgttgtactttttctagagcaaattgaatctgaatattgtttggtggatgtctatttgctattttgcttgcacacaatgacaaatatggtgttaagttttggttgattgagaaatcattattttgaggttaaattgtcggatgagggcaacactgcacttggttttcagtttgctcaatgtttttcaatttgcaacactacactgcactgcctgtcatgaagcaattgcatactgaagcttcaagagattctgcaagctatcaagtctttgatgctgaataatttggcgttggtagtactgacattgctgaactgaataatctggtttagaatgtagtctgaaaatctaaaccatattatgcgtgtggtacagtcaaaatttcagtaaataataatatgtttatgcctttttacataactcaggaaaaggagagggcatgacctagccttattcttgtgatgatttgtgacaccaaatcagggaaggagagggctagaaatggtaatgtttgttggcaatcataattggacttcagaaattcaatgtatttgttaggaattcacctagatatattcacgggtattatgaattcaagggatttgttttgtagcgatttcagggatccctgtttatggttatactttttttagataatggaagctttattaatctcaataaaactctatcaagtgatacaattattctgagagcacctccggcttctgcacccaaagagtgcacacaaccaacaagaaagaaacaaaagataaactcatcatccaaatagcatggacaaaaagaacttcaggagccctctaaccgtagcctagaacaccacccatgcgccggagtagaaaactccatggccactagctccaattgttgacaagccgcaatgatagtaccccgcaaattgaccttctgaaggatagcccatgagcggagccaatgtgtaataaaaaagataacctgcaaaggagaagatatgttttttctttcaaaaaccacatcatttctgcaaagccaaatagaccaaatagtggtagttgcccctaataagaccaaagatctcaaattgcgtggttgtcttcttatccaatgcccaaacatatgagttgtactattaggtaaactaatattcgaagcaaactggattaaagaccaaactgcgcgggcaaaacgacaatcaaagaacaaatgattaatagtttcatctttgtggcagaaagaacaagacttgtttcctctccaattccttttaataagattatcttttgttaagactactccatgacgtaagtaccataagaagatcttaatctttaggggggctttgatcatccagattcttttgtttatattgggaacatcggtctgcaccaacgaaagataaagagatttaaccaagattctgtcatcagtggttagattccatttaaactcatcttggtcatgagataatataatattagcgatgcgtgagagaaggtgattctacgccactaacttagagcgagtaaggtccctgcgccaagaaagtttatggttatactatgtcctcattttcaatttcaagtaaagcttgtaagcatttgccaattatagtcatcccaagatccatgattgttggagagctcagtttcagcacatatgtttcgtcaaaccagaactttgtcatagtgtaatctttacttgacctagatccacgatatagtgtcataatgcaaggcttactagctgctggcaccctcaccgtgccgcaggctggccgcgcattgcccgggctaccggctcccagctgcaatgccccgatcgcctaaccgtcatgtctctatggtgattgcctgctagcctgctaacgactactccctccgtcccaaaaaaaggcaaatcgtgggttcccgtgccaacgtttgactgtccgtcttatatgaaatttttttataattagtattttcattgttgttagatgataaaacatgattaacactttatgcgtgacttatctttttaatttttttataattttttcaaataagatggacggtcaaacgttggacacggaaatcagggtttgtctttttttgggacggagggagtatgtggccgcgatcggcctgccatgccctgatcttgccaacgatcagcctagtagcgacatactccctccgttttttaatagatgacgccgttgactttttctcacatgttttactattcgtcttatttaaaaaatttatgcaaatgtataagatataaatcacacttaaagtactatgagtgataaaacaactcataacaaaataaattataattatgtaaattttttgaataagacgaatgatcaaacatgtgagaaaaagtcaacgatgtcatctattaaaaaatggaggtagtacaagagaaaccagattgctagaaatagttgaagaggacccaccagcgatgatgtggcataattcaatgcttttgggaactaaaaatagggaagctcgtggacaagggggtgatttttgggctcaaattattttgggatgaccccaatctgagatttttgggagttaaattttaggcatctattggaaatgctcttaacaactagtggaccaattcaacccacttcctctcattgattgtggaccacaccctccgattccttaaaaaaaaatcatcacatccctcacgccaaaatacatacaaatggtccctttgaatcacatgagtggaaaacggaggaataggaaaaacataggattataacagaaatgcaaatgtaaaataaatgattacaaaacacaataaaaacatgtgaatgaccgtttgattgatccacaagaaaaatacatgaatttgaggagagacaaaaactcaaaggaatttttccatgaagttctacctcatgttaaactttctcaaaaacttatatgagaagaaacattccataggaatttcattggatctcatggggtattcaaagagcgaaatcctctaaaatttctataaattccctttgaatcaaatggagccatcccattccaaaacaagggatggacctaagtacctaacatatcccacctcatgccaaatcaaatacatgagtgttgttttgaacacaatctaagatgagaatttgttttcgccgctcattgaaatcatatctattgcgccatcgacaattttgagatcctcccgtttgtcattacttagttggcgctctactgctcatccctatttatcttctgtcattcctctctatcaatagtgcttggtcaacaaatttgccccgaaagacgattaaataaattttatagtgggagaaaacacatgttttttttaaaaaaaaacttcaaaaaaaaatcagcattacaattgtcataagaatgggaaaacctgcaacgtcccaaacaaggccttgcaaaggatcataaggtcttcccagcgctgatgactgatgagtgatgagaacgatgggcgatccaacgagaaatcaagggcagcagcatattccaagggttcgacttaccgccggtaaccgcgtgtttaccgtgattaccggctttatcgcgggggtacggtaatataaataccgcggtaacctccttaaattcaaataaatttaaaaaataatttgaatttttgataaattttgcaccatttcgtacggttttttgcggtaaccgtgcttactgccggggcacggtaaccccgcccccggcggtttgggaaacctgggggcggtttgggaaacctgattccaactcgcaggaactcaagtatactcaacgcagcagtacagcgcgagaaaaccatgttaacagtaaatctatttatacatcgctgtccagtcttctcctatgaagtgtacagactgcgccatctccacaacacgccaagccgtgagatattctgcaatatccctctgttcccttttcatctgaactaaaaacctgaagggaaaaaaaaaaggcccactgtttcacggttgaagaactcgtcgatttaattttgtcaaatctaatctttaaattttaactattcgtgtaggagtaccctccatctctgtcgaattaaaccgtgtttttaacgtaagacgaccaatttaaaaagagtcgaagtggtctgaagtctgaactctgaattttgttgggggaagaaccgaagaggcagtgccgtaaaggcaaaagaaacaagaaacacggcccgagtctagtcgaccacgccccgcgtccgtcttcccccccaaaacttcagcaaaagcaaacgaagtcttctcagattaattctcgcgtcgtgtcagaccacgctgccgcgggggatctgccgggtggcgaggctgcggagatgtcggacgcgctgatcaacggcgtcgccggcgccggcggcgggatcatcgcccagctcctcacctacccgctccaaaccgtacgcgccacctctcctccatccttggattgctagattgtttgggtcaattgcttggttgtttaataacggagggtttgggggtgggtgcgcaggtgaacgcgcggcagcagacggagcgcgacccctccaagccggcgttcaaggacggcgccgtccgccagatgtgcctggtgcttctcctcctcctcctccccaaattcccttctcgtgttcatgcgagctgacgagcaatctaacccgacccgagtctaatgctaccgcgatctctttgttcttctgttcttctgtggtaggtggtgaagcatgaagggtgggagcggctgtacggcggcctcatgccctcgcttgttggcactgcggcctcccaggttgctttcgttttgctgatcgattttcaccagcttccctgccttgttggaggattagctgtaccagcttctgaatcgaatcattgtgtctgtagggtgtctactattacttctaccagatattccggagcagggcggaggccgcggctctccagcgatccaggagaggaatcggcgatggatccgtcgggatgctccaatccctcactgtcgctgcgctttctgggtaatcctattttgcttgtgcgtctgccattggcttatgctgttatgcattgtgttgtctttttctcggtatgatagttgtaagctcattcttgttcttaatggtttacttatgatgaacaaccttcggtgctgttgttttgtttgcgcagatgtgttaatgtacttctcacaaacccaatttgggtaattgttacacgaatgcaagtaagtaatgcacattattgcagtattatttcccaactgactacttttagtgtaataagaaattcagtggcacatcctgaagtataattcattcttgtctgcagactcaccggaaggcaaacaaacagcagagtcctctggatttgacgtgtgttcttgacaaggccctacaagctcccgctgttgaaaacatacctcacaagactatccatgttgtatgtaactttgatcatttctctttcaggatgagatactctattcttgcaattacatgctgctgattactggatccaagactaacagctgttcttatatggaaaaaaggcctcatttagtttttcctaggcctcatcccagttcctaaactgttagctcagctttttttttttgtccctaaactgcggataaaacccatccttcatctctgaaaaccaagtaaaacttgtcctcctaagtacttcatatagtcaatatgcaagtgctaatgattcagactttgtttggggcatggttgattgactccgtttggctgcagattcaggacctttacaaagaagctggatttttgggcttctggaaaggtgtagttccagctcttattatggtaagtcttatgtcgcattttcttttgctaagttatttcttttttacaagttattgtttccatgtttcatctgtcatcaggttagcaaccctgcaatccaattcatgttgtacgagactcttttgaagaagttgaaaaagagacgtgcctctaatttgaagggagctgatggactgactgctcttgaagtaagcttttggcttttggcttttctggtgactgggatcattgtacagatttattaggatataaccaatttgcatcatgctaacttgctgcattggggcctgaatctacccgtaacgctgacttgaaagtttgttcttctagtaacgatgtttcatgtccagtaattatatgttgcatgtcttaacttcatttaccatgatgatttgctgaaaacactagtatttcttatatgctcctaatactactatttctttgttagttagctatgttatagaccgtcttcatctcacgctgtaaaatccttgttcagattttccttcttggtgctgttgccaaactgggtgcgactgttgttacatatcctcttctagttgtgaaggtgattatttgaacaccagttacagcagcagccgtttctgtgcacaattgagcagacatgtcaagttaaaccatgttttttttttctacaggcaagacttcaggtgaagcaaataattgatgatgacaagaggcaccgctacaaaggtacatcgctggcctttattctttaaacttcattttattatttagagtgaattattatttaatgagtgatgttgctccatatcctgtttctgatagtctttacttctcttctggtaataatatttgctgttctctgactttgttaccaaatacgctatgcaaattttattgcttgcaggcacatttgatgcgatcacaaagatgatacgttatgaaggtttgtcagggctttataaaggaatgagcacaaaaatcgtacaaagtgtttttgcttctgctctcctttttatgattaaggaggaactggtgaagggcgctcgattattggtaaccggcaacaccagccttgttaagaagttaccatcgaagccattaagatgatctaggttgtacaagagttagttccctacttataccacaattgtttccataaagcgatggacagagttgccaagcgcccctgttaggagatatcaagttatctgtgagactctgatcgactgtaggctctccaaaaaaaggagattaaagatgtagtacaattaccactgtgattcttgtaggaaccaataatgatggtatatattgggtaggctatctctgttgctcgtgtaaagtatactgttatggaagattgaaacactagaaaataagttggcaatgagaatcgcaagcgctagtcatctgttcagattacttgagtttctttagcttgtttgttagagctaaccgagaagaggatcgcaatcgtgaaaacttcgcaagtgttcagaacaaaagtagaagtagaaaatttggagttcctgtccatttttagcataactgtgtctatggtgcgccccatctgtcaatgtggttctcaggcaactgttctgatacacaagtgctaatgagcaatctgacccgacaaaaaggaaatgaaatttaatttgattatttcaaactcattttggtgaaactaagcctccttctttactaagatgcaaattcttcctaacacattttttaaactgctaaatggtatgtttcatatgaattttttacataaaaatattttaaaatatcaaataaatcaatttcaagtttaaaataatcaaaacttaattaaacataagctaatgggccgttttcattttgctttcctattttatttcatctttattagaaaaaaaacaccatctaatagactaatactgcctcgagggtttttctttaacaatatctaagtttttttaatgaagagatgcttcttctaaaatccaaacacatagtagtgtgtgtatcttactggtctggcgcgaccgactaagctgacactcgcgagagtgtggccggtccggtcgggtgggggtggataaggagatagagaagcggccgctccgcagctgcagcggcaaagcctccccgtcgtccagcccacgcagcgcaccgcagcgagcgaagccgccgcaatggccgcctcctccgtggcctcgactctcctcctctcgctctcctcttcctcctcgcccttcctctcccccacctcggtctccttcctcccatccgccgccgccgccgcctcctcctccccgcgcgtcgccgtcgccgccggcaagcagaaggcggctatctccgtcctccgcgcccttcgcgccgaggcggccaccctcccggttctctccttcaccggggagaaggtcggggaggtcgccctcgacctcaagtcggcgccgccctccaccgcgcgcgccgtcgtgcaccgcgccatcatcaccgaccgccagaacaagcgccgcggcacggcctccacgctcacccgcggcgaggtcaggggaggcggcaggaagccctaccagcagaagaagacggggaaggcgcggcgcgggtcgatgcgcacgccgctccgccccggcggcggcgtcatattcgggcccaagccccgcgactggtccatcaagatcaaccgcaaggagaagcgcctcgccatctccaccgcgctcgccagtgccgccgtggccgacgatgcattcgtcgtggaggagttcgacgaggagttcgccgcgggtcccaagaccagggacttcgtggccgcgcttcagcggtgggggctcgaccccaaggagaaggccatgttcttcgccacggattttgcagacaatgtgcggctcagcggaaggaacattggctccctcaagatgctaacccccaggactctcaacctatacgacatcctcgatgcccgcaagctcttcttcaccccggccgccattaactatctcaactccaggtatggtgccaccgtttttgatgaatatgaggatgataccaatggcgaggatgatggtgaggaggaagcagaggagttgcaagaaggagaagggagcgcagaggaggctgctcaaggtacatagctatgcatgaacaatttccaggtgtctttttattgtttctatggtgggcatgtgcgaaatgactttgagtaactaatgctatccagtgatcctttattttacatgttttagttgatagttaggagagaaaatgctctgctttaatggcatgtacagtagtttttttttttatcttttaactcttagctatgctctgttgtaaatatcatgatcgatgctatacgtatgctgataaagatcctgacatgcgttttaagggtaaaaacaagataacgtggcaaagaaacagaaaatgtagccagttttgtcttatgaataccatcttaattattatggagaaattctttgtggccttgtagacttatggagctaatttttttttcgaaatagttctcttatccttaccagcatgcaaaaggaaaaatgcttaccatgctaatgtacatcgtatggttttttttcctcctgaaagatccaataagtccatgacataattcaatggtctattttagaagcatgcttagagatccacctacccctatgctagctctcagtagacccactgagtctgtattttactcgttattttgcacctccttagggtttttattcagagctcatgagcaactcaacaatttgcgaatagaaaatgacttcacctaatggtggttaaattttcggctgaaggtggattaagtcctaagcactaaactaaaaaataagaagaaatgagactgcatggaatccatgaacaccactgaaccagaactctggggatactggtacactccttataatagtgtcacaatctgctgtgccacacagctacccctatcacctatcacttgaaacattgtcagccattggcactgtcatcattcacttcaaagatgttctgttagaccttagaaccatcttaataaagtagttagctgtgaatatgctggtttaagttgctttagaggtaaaacctagttaaacacatgttttctccatcactcaagcacttccttttcgtaaatactatgcatagctacaggactaagttattattaattgacattcagttctctgttacattttggtgctgcatattataactttctcttattttgagcatttctcaggaacttctttttgtatgactttcagatgaggctgcagagactgaggctgatagcaattcctagggaaggaggtgtagatcgcgtgtttttcgtttgttggtctggtaattgcttccctgatgcagaagctttttggcttacttttgttgtaagtttataatgtttttttttcactgatgcagtatattagatcttcaaactgcacatatattttcaaatacaatgtcgtgtcaaccactgcatatttttcttccaattttatacagaaagtgcttcccaatcttgcttcaaaaaaccagtgttgacctgctggttaccactaattttctactccctccgtttcatattataaatcattttgacttttttttcctagtcaaacttatttaattttgaccaaaatgatagaaaaaataataacatttttaacacaaaacaaacatgttatcaaaaatatattcaaagttacatttaataaaactagtttggtattataaatgttaccattttttttctatatacttagtcaaacgtacagaagtttgactccgaaaaaagtcaaaacgacttataatataaaatggagagagtaacatcttgagtaggggtatgattacaaaatcttgtctccttaaattgttgaattgttccttgttatgactaactttttcgctgggtgagctctaacaagtaacaactaacaagtcttttcagaggacttgctgcattttacaatgtggaaagtagcctagctcaacttggacatggagcactggagcagcatagcccgggttagatgctgatcttgaaactctaagcccagatcagtcgtaaacaacagaccattttgctcaggtttacttgtagatcacctgagggtttagtgaaccaaccctctgcttatgcctaaccataatgattccatcatttttctttcttacctgggtcatgcaagaagagttgttgggccatccttaagtccacccagacaactttggaccagatcatcacctttctaattgttctgacattgcactacaagtggattatgggcttatgggcaaagctgcgtctgtactttagaaaggtgcaagatctggtcttttgctatgtctagtattttatgtcatttttagctggtgctatcggtagaatttacttatagtttgctctgtcttactctgctttcaacaatatctaaagaaatcatttgtgagattgtgactgacataatagtgctgtatctatgaaccgaaaagggaagagtcttgcttaggttgagccagcttctttggcactatcttttaaactttttggtgggcaaaaagctatccatattatactagcccactatgcataaaaggcatacaaattatggggatggacctgagcacataatttcactctcttttttttttcttgagactggccattgattggttctagtttggaatattggatcgattgactataactgtttccgtccctacatgttaggtctgcattatgctccttggaaggaatcattagaaagaaaacttaccactacactaaatgtcactcaccgtattaagttctgtgcaaatatgcagcagaattctattgtgccactggctgctgttgtgcaactgaatttactgggtgggattcttaaactaaaaatataccagatcatctcagagtctccggaagtaacaggaaaaacggttgattcatccttcaggctactgttaggacacgaaaacaccagtggaagaaataagttagcatgatggtataaatcttagacattatcgtcgttgtcggttgcttttcggcgtgttggtctgatctccttcggagctcttttatcatccgtgtcgtaaagtttgcacacgtcgctgtcgattagtccatccacagctttgtggccaatgggccaagttactttgctccgattcatagtgctttgtggttgtttgacccaaaagctttacagtccatcttttcatttatatttatacttattagctaaaatttaaatttttaactttaaatttaaagttgatttaaaggtatttttatcgtagtttattttccagactttgcttttagatcgttaagaacacatctataaaagttgtattcacaaattaatttttgttacaaatatgtcgtttcttttttttcctccaatgtaccaaacgatgggtctattagtttatatgtcttttgactgttgtcgcatttccgtgaaattttcctcggaaaggcatctggtatggttggacccaggcctttatatcctatctcccaatcgaatgtgcatgcaacttatggctctgccgtctatacgtgttctgctcagctgctctccatgctctgcatttgtagtgtggaaaataagaatttagggccctttgaattataggaatgaaaaaatagaggaatagaaaaaacataggattctgacagaaatgtaagtgtaaaacagaggattgcaaaacacaggaataacgtaggaatgaccgtttgattggaccacaggaaaaacacagaaatttgaggagagataaagactcaaacgattttttccatgaggttctacctcttgttaaaattcctccaaaacttatatgggaagaggcattccataggaattttataggattccatagggttcatttctttaatttaaagggcttggtaggaaaaattactataggaacgaaatcctctaaaatttctatgaatttcctttgaatcaaagggtacaagtagtctatacgtgttctgctcagctgctctccatgctctgcatttgtagtgtggaaaataagaatttactaggtacaagtagtttgagggtaattgaaaaggatatatttagattgatatgattttaaaccatactattgaaagtggctatacattaaacaagcctgtagatctagatatatcgatttatacaactagaaatatctagttttacaaaatcttggatccgaaagtgtgttaaataagatgttaggaaattcataggaattttaggcccctttgaatcaaaggatttatatagaaatttcataggatttaaattctataggaaatttttcctatttggccctttgattcaaaggattgaagctttccaaatcctatgaaattcctatagaatggcacattgcatatggattttggaggaaatttagcaagagctccaacctcttggaaaatttcctttgagtctatctctctcatccgattcctacgtttttcctgcactccaatcaaacgaccattcctgtgttttgcaatcatctgttttacacttcaattcctgtcagaatcttgtgtttttcttattcttccgttttttctaccctgcgattcaaaggggcccttagaggattttattcatatatgaatttttcttacaaagccctttgaataaaaggaataatcctatggaatcctatgaaactcctatggaatgcctcctctaatgcaagtttcagaggaattttaacaagaggtagaacctcatggaagaaatcctttgagtctttatctctcctcaaattcctgcgtttttcctgtggtccaatcaaacggtcattcctatatttttcctgtgttttgcaatcctctgttttatacttacattcatgtcagaatcctatgtttttttctattatttcatttttttcattcctatgattcaaaggggcccttagtgaatcctatgttttttctattattttatttttttttattcctatgattcaaagggacccttattgacctagcgagacaacgtatggttctgtaaaataaaaactgtaaacacacagcatgagcagccgagcagggagcggtgtagtgggccaaggcagccaccgtttcttcccatttccccccaagacaaaccaaatgaatcgctagttgctatgcctattagcgatgtctgttatctttatgtctttcgattgactctaattttgatctttgagcaaaagggcatttagctgagtagttacaaagagtctcagtacatcttaggtccagagtttgattttttgtgggagcgaattttccaacatttaacggctttgtgcttttaatggtagacgacgtatctctaggatggatttgccgacccagtcttcgaagatgcttataggggtagggtctgcatgcgtgcgttcatagtggtgtgagtgtgcgtgtgttgtgaatgtctgcgttgtaatatgtaatcgggtagctaagggtcttattccaccatgggtgacatagttacattagaattgctagctaaaaaatcttcgtggttagtcaataataaatgagagttgaggatttgtcccatctttatttcttattctgacttatttttatctttactattttttcaacaaacttataattgtgcgtctcatgacagaagccaaagatacaatccatttttattacctaaaaattagtgataccctaattcaatcaagaccgaaggatcccaaggctcccagctgcccattccagatggacggcacggatgtacgctgatgacatctgcgctttactggttacaaatatagaggatctgcgcccctcgcgtcctgcctggccttttccgtgacgagacgacgcagaacagaccgatcgcccgccagccatgtgaccatctgccgtcgcggtcgcgccggaagcccggaaatcgcacccgcgcgggcacgtcgtcgtagctttccgccgaaagcaccggtcgatccatccatccgcccccaaccaactgccgtttctcgctggctcgctgcctctctctcctcctcggccgctcggcgtcgcgcacgcccggaagcgcgacaccaccacgtatgcacgctgaaccggccactccgcgtccgcgagcgttgatgagctgacacgcgaggagggcgttgccgttcgttaacgacaagatcgattctggatagcgtcatggtctcatggagtcttaaattaaataaaaatgatagcgtcatggcgccgaaaggtgttgcccattgcccattggttgccggcccgagtacagctgcggaatgattgaccgggatcgagctgaactcggctatactctcgtatttgccggtgcggccggttgctatgtgcggataagagcaagtttaatgagcaattctactgtgtttgaggagtcctcataattcctaggtatcaagaggtataaaaaaaatggtacctctgatatctcctcaaggacataaaattactcaagtttaatagtatagccaactactaactccaaatcatcaatagtcaatttaatagccaacttatacaatagttacatataaacatatactacacttttaatagcatagccaactgctgactccaaattatctatagtcaacttaatagccaattcataacaatagttacaattaatactagtcccacatgtcatacgcacatgtatcttggagttcgtgctgcagctggctataaatctgtagcccgctgctattctttcttctcttttatcttctcgaaatgtgtttatagcttgcttatagtctgttgttgtatctgctcttatacaagggacaacctccacacaatctccaataaaaatacaagatgatgtgagagtaaactaatattagagtatttgttacctattaattaataggaagatgatataaatagtttaaattagatgtgtcactcgtcttcactataaaacttgccgttttagacgccgaaatttaatgacgcgctcggtcaaaaaattttattgttggtactgctattcttagggcgtatgctaaataaagaacccccatgcgtgcgcacgtgagtattgtaaatctcttcggatgagagggaaaaacggaagaatatgccaatggtacccactcgttcgagcaatctagaaggataactcaactcacctgccctcgtctctcgggtcatgagaatatgccggtaacaaatggcaacgtgctaatataacttcctccccttcttacccctcggttcctgatgcccaacatatatatatccctccttcctccatatccaaggttagttctacatttcacatctcttcattttctttggctcttcagagttttgtccatctctatcttcagagttcttcagagtttgcttaccatatgatcgtgatcaggtttgtagccagccaaatcttaattcataagaatgcaagatattcatgccttgacatgtgatttctttatttgtctatccttttcaggtatcggaattctctttatttataactacaatgcaatcgctcattttacccgtaacaattaccaagagcttgtttagttgacaatagagatatcaagtcaaataaggttgtttgtgttacacaagataccgatgaattttgtagtgttgcccttctattgggaattcataaatgttgccttgatgagatactacagtaccaataagttttttttaatgcctagaggttaatgaaacgtatagcatatggtccgcaaggctaaccaacagtggatcatcccaaacgaaaaaaaaaaactatgcatgtctctcccacgcgcattatttttcaaggtaacatacatgagccttttatgcacaagtgcatagaattgcaactataagatttttttataatagctttgatatatttaaaattttattacacatgtcctatgctaagtttcaaatgtaagttgaaaaagttggtagataaattcatggcctaataatgatacctacatgaagaggaacacttctacaagcgtcatcaatgttatatctagctatctgcaagttgagggttttcgtcaaagtatggcatcactcaagtcacacctacttaattcaagcatggcgaaccaatgaaataggactaaaaccataaatgctagataaatcatgctagaaactcctatcataatatattgctactaaatcacttattaccatcattagaaagagaatatcattggtactagctattaagagccatgtcagccaagtcacgttctacttgtgacggggcaatgaaggacaagtataaaggtgtgtgtgttgtgtgtgtttggggggttgggggggggggcaatggaccaacatccggtacttttacatgtaaaaactaataaatatttcatattagtgttagctatgtccgatctcattcgagacaacttgttgatacttgctaccccaagtctacatatagattgttgacatgtcagatcaaaactatcattattaaaagctcttctaaatgcaatttgagcttaactcagtttttttcagcctattccttttatccctcatgcctaaaattgtacaatggttagccctactgcaaacgaccttgcacaataaaaaaatcatgcataattgcatattcgagtgtaaattctttttgcatatgtcttttggacagtacacctgatatgtactcactccatttttaagaaagactaatttttaactataaatatggatataaactatctttagatttgtgttaaatggtgtgaagttaaaaataaatgtggcatcctaaatcgatccatacacactattttgtctattggatgtgcacttctgattttttttcttaaaagtttaacttgtctagtactatcgtaaaactatgttgttaaaagttaccattgtatatacattaaataacttgccctcacgtctttacaatgatgcttttgtagctttccctcatttttaagattgaaggtttttatgttggattaattttgccatcggatatcaattgacagcgtattacattgatgcaatttttcttttagctatttcttatcataccctacaggtaattctcaaaatcggagagatttacaaggacacaatagcgatataagtatgactccctcggagctctaattatatagcacaaggatgattcaggactcatccaccatataactataactctctcagggctccaatcatatagcacaaaaaggattcagaactcatccataaacagtgacgatgacccgcaaccactgcgagaaaaccttgaccacggacaacgtcagagattttagccacaggataacaaactcacaggaaatggaaggaaagtgagaaatatctgcagccgccgtcagcctcaggcctcagccgctggcaaacgcaccgcatcagcagcagcagcagcagcagccatcccaagcgagagagctttgctttcgcgagtcgcgcgactccgccaggacaggaaaaaaccggaaaaaaaaaaccccgcaataaaatttccccaacttccgctttttccttgcctctccccaccacaccacaccaccccatctcccatctcaccatccccctttcccaccctcccgtgcgaacacacccgcggcgcggagcccagatcgggatcgcgacggatcggcggcggcggcggcgatgggaggcgaggcgggggagcggcggctggggagggcgatgagcttcgggatcccggacgtggcgctggggctggtgatggggttcgtggaggacccctgggaccgggacgccatctcgctcgtgtgccgccactggtgcagggtcgacgcgctcagccgcaagcacgtcaccgtcgccatggcgtactccaccacgcccgaccggctgttcaggcggttcccctgcctcgagtcgctcaagctcaaggccaagccccgggcggccatgttcaacctcatccccgaggactggggcggctccgcctcgccgtggatccgccagctctcggcctcgttccacttcctcaaggcgctccacctccgcaggatgatcgtgtccgacgacgacctcgacgtcctcgtccgcgccaaggcgcacatgctctcctcgttcaagcttgaccgctgctctggcttctcaacatcctccctcgccctcgtcgcccgcacctgcaagtaattattttttacccttacaaaatattactcgagtgagtcatttaaggttctcctttgttcgcttaaaaagtgttgttgtaaaagggatttgggtatggtttgcttacggaagggaatactacgtcttaggagttctctcttgctttggtcactataaaaacatcttagttctagaattcaactttggagataattgtagctcataggtattaaggaaatggtgtgctttaactgtcacaccctaattttctagtgaggtgcgaggatttagcttagatccaaggctacttagtggaaatggataagtagaaataggttactgcaagagtgcggtggatttctagataattgaccagccatatgttgtcatttgcaggaaacttgaaacgttattcctggaggatagcataattgctgagaaagaaaatgacgaatggattcgggagcttgctaccaacaatagtgtccttgagacactgaatttctttttgacagatctcagggcatccccagcatatcttaccctccttgtgcgcaattgtcgaaggctgaaagttttgaagattagtgagtgcttcatgcttgacctggttgatttgttccgtacagcagaaatattacaagactttgccggtggttcctttgatgatcagggtcaagttgaagagagtagaaattatgaaaactactatttccctccttcattgctccgcttgagtttgctctacatgggaacaaaagagatgcaagtgctatttccatatggtgctgcactcaagaagttggatcttcaattcacattcctttccacagaggatcactgtcagctggtccagcgctgcccaaatctggaaatcttagaggtatttcctggtagattagttgcatgtctttttgttatgtttcttgctttgaggttttataggaatattcaacatgggctgataatcctttttctcatgtcaatccaacaggtgagggatgtcataggggatcgtgggttagaagttgttgcacaaacctgcaagaaattacagagacttcgagtagagagaggagatgatgatcaaggaggtcttgaggatgaacatggtatggttacacaggtggggttgatggctgtagctcaaggctgccctcatttagaatactgggcagtgcatgtcactgacattacaaatgctgctctagaagccatcggtacatacagcagcagtcttaacgatttccggcttgtcctgcttgatagagaagcaaatataacagaatcaccccttgacaatggggtgcgtgctttactgagaggctgcaccaagctccggaggttcgcattttatgtaagacctggggctctatcagatgttggccttgggtacattggtgaatttagtaagacaatccgttacatgttacttgggaatgttggggagtctgaccaaggactgcttcaactctcaacaggatgcccaagcttgcagaaattggagctgaggggttgtttcttcagtgaacgtgcattggctgttgctgttttacaacttaaatcactgagatacctatgggtgcaaggatacaaggcatctcccaatggcactgatctaatggcaatggtgcgacccttctggaacattgagattattgccccgaatcaagatgaagtttgcccggacggtcaggcacagattcttgcatattactcacttgcaggaatgagatcagattaccctcactcagtaattcccctctatccttcggtttgagtgtatatgtctgataccaggttgcgaaactcacactctagtataggccgatattgttccaaattctacagtttgctgctcttattctgtttagcaatgagcacagaacaaatgacaaataaaagcaggatagctgttagttcgaggaacatattataacatcttgggactaagaattttattgcatatctgaggggtatcacttctgcgaaagctcagctcaattggccagcacggatatgtaaacttctccattttgattaggatcggacacacaattttgtaataatgttccttgttcaatgtttagtagtattatttgactctttagctttgtgtcacattgtctcttggaagatcgccgcactgtgttctaataagtcattcgctgtacaatatttttatcatccacagatcacactactggctgtattcttgctgtgacttttctatttcttctctctttggttgtgtaacgccccttgattggtctgtatgatggcgcgctgcttcttactttatcttgtttggtggaaatgtggaatcatgcatatcgatatgtaattacatatttcaataagagaaacaatagccaacctcacttttctaatctatctatgtttactcctaaatcctaatagatttgttgataggttctatgcgtttttggtgcctattcattttgtttggtttgggagtgccggtttgtaattgtgtatgcacatgctcctcctttacgtcctgtccacccttttttatttcgagtatggtgttgtcggtttacaaatttatgaggtgaggtggatgcaatctacttcctccatctcacaaagactttatttttagattttcgtatctaacatttaaccgtatatcttatttgaaaaaaaaatgaaaaaaattaaagaaaatagtcacacataaaatactatttatattttatcatctaatactaataaaaatattaatcataaaaaatagttaaataaaacgaagagaaacattatatctaaaaactgaaaaataaagtctctgggagacgaagggagtagcctataaacttgattcggtaacttgatttgcccacagtagcacaaaacccagcctgactgcctgaaccaactgtgtctgcctgcgaaaatgacagcataacagaacctgatacaacacacagtaagtatcaatatgctacagattgtagatctggacaccataacgaaccaccaataatatctgcctacgaaagtaagcataaacatatagaagtatccgatacaatacgacacaaatattatggtacacggtttctaagttggaaacaggtgcaaagtaagcttcacgagatacagacatacacttaggcatagagagctttattgatctctagaacatcaagcttcaattcattctgagcgctccctggagacagaccttgagtaggaactgcggctgtgagagtagctctccctagaatgcctcttacccgacgacctgctgcgcgacggtttcctttcactgtatcttttccttggagaatagctccctgacctctgagaatccggggaacagctatgggagtagctcctctgaggtgatacactgcgagaatagctccgtcctctagcacttggagaatagcaccttctatagtatggtgaaacagaatggtcataggaacatgacctctctcttctgtaacggtatggagatcttgaacggtagcgggaaccacggtaagatgagtatgaccgacgccgtgaaccacgtgtgtcatagggagagtatgatcgccgtctaccataaggagaaggggatctgccatacggagagtaggactgtctcctttcatgtggagagtaggatctacgcctctcatagggggagtatgatcttcgcctgttgtatggagaatatgatcgccttctaccataaggagaataagaccgttctcgctcaggtgagtagcgtgaactgtagcggtctctttcaacaggcgagtagcttggggaatacctccgtgctggtgtcactgtataataaaaaatattcagcaatcagttgtattatatcaggaaaggctagcaatgcttcctattttccagagaaatgagaccaaaccatccagacacagcagcagttaaatcaaacttaccacatgatgattttgtgcctagataccttccgggcgttggtgttcgaccacgtcttctcttggcctgtggaaaggattcaaataagccttttcgccatattagcattaaagagtgatgcaacaaattgggaatctgaacgacatgattaatatggagactatataatgtagggcatacaaccctttggttgaggtagcatgtttggctgttaggttgtaaatcttttgaatttgacgtagagcagcaacggacatctaccctgctgctgtcaacaaaagcttcaaacggaagagcactcaaatattcagctcagcaagctaaatgagcatataaatttcactccaagtagaagtgaagaaattcagtaaatatattgtgattataccttctctacagttatcacacgaccttccaacactgagcggtctagatatttgatgcaaagatcagcctccttaacagtagccatggtaacaaatccaaatccccgggattcccttgtccatggatcaagtactatgctagcatcaataacctgtaatacggtgagcttaaaaagttgtacactattttggtatccctttgcagatactctataaaggttacctctccctcagcagaaaagtgtttctccagatctcgatctgtcacacgagcagataagccagtaacatacaggttgttcccagggttttcaacatcacttgagtccacacttctaaagacatcaaaaggatatcacatactcatcagaattacagtaggcaaaaatgttcaccctcgaatatagagtgaaggcagaaacatactaagcgctaagataaataccatacctagaacgactcctataccttgaacggctgctccgtctgggcgatgtagaatatgagtcggactcatatctatcagtaggagccaatcaataatcacaagacagggcttcaaaaaatgtggaaaaaaattaagtttggtaatgcgtaccttgatcctctggagtacgacatctgcaagatagacatatgattgcatcaatatccactagagaaacaaatatatacaaaaacatgagatgccacttgaaaatgtaattataacaaacagtgggttcatagccttttgaagttgtaactgattaatttatgacaccttggtgacaatannnnnnnnnnnnnnnnnnnnngcaaaacaaaattattatcttcagaatgaagagatgacccagagtatatacctagcgcacgccaaaaataatccacaaaccaacataacgaaatgaacaagaaactgcaagacaggagattctttgtttattttcagcatggtaatcatgaactataacttatgcaattgcgctcagcaattgaagcttccaaccatacagtccctaagataaatcgacttcctaacactgtccctaagtttcctccgaggcatgtaggggcactatgcaagtttcgaactttcgacagttgcgtttcaaactacatatacaatggacaaaaaatgattatgccacaagttgtacaacaatttgttcccttcatttcttcatttcgtgcccctctagaaacccatgtactagcaatctatacctcttcttttgcaaagcaaatacacgcaaatcagatcattttaacaaatgagccgctatccaagatggggaactcctgccgcaacgcttcgaactacagctaggatttatctttatatagattaagaataacaaaaataaataaatataaacggatgtttttatacagatcagaggggcaaaccatcgccatactggaacagagaacgaacggattcaccgtctttagcagagataaaacatgaggagaatcagaggcagcaataataccttccttcgtcgcgacgatccgtgccctagccgagagcgtctctctgtgccggcctctcttgttctcagtcacggcgctgcctttctgcgcgtcggagcgcgtgcggttgggagaataaatggaagtgtggaatggggaaggttctggacggaggcggacgcgaaagtttctcaaatctggttgatgaatcggttgcgcgcacgaactccgccttcctcttcacgccttcacacatggcgcttcttggagccattggtttttctttcggtttgcagtaaataaaagtttcccttcagggtttggtttactttccaactttttcttcaaacttccaattttttcattacatcaaaaatttttacaaatataaacttttaattttttttctttaaactttcagttttaaccaaacttctaattttagtgtagaactaaacacacagcctagacctcttttggtcctatagaaaattagagcattttaattataatgataattctaacgagttttttttaaacaaataattcaatcctatactcccctgtaaaatttctataaaatggacacccccaacagagattttaatgaaaatataagagttacaatccttatgtgtcttacaattgtattgttcatctatgttacaaatattagggcatgtttagttcgcggaatgaaattttttgggtgtcacgtcggacgtttgaccggatgtcgaaaggggttttcggacatgaatgaaaaaactaatttcataactcgcttggaaatcgcgagacgaatcttttgagtctaattaatccaccattagcacatgtgggttactgtagcacttatggctaatcatggactaattagactcaaaagattcatctcacgatttcccccctaactgtgtaattagtttttcttttaatctacatttaatgctccatacatgtgtccaaatattcgatttgatatttttggaactaaacggggcctaagggtgtgtttggttcttccctttcccaacttcaaatctttgttttatgtgcgcacgctttccgaactgttaaatggtgtgtccttttacaaatgaaaaattctatgtgtgaacctcaacataggaaaataataataataaaaagaatggttgattgattttgctttagctgttctatttgtcagagtaattatcgagttatgaaatgctatctccatccaaatcgcacccccattggttggcttattcttggaataagccaaacgacacatttacaaacaataagtaatttgtgaataaagcatttatatacgtgttcttagcgacctaaaagtaaatgctgaaaaataaacttcaataaaaaactctaaaactagcttcaaatttaaggttgaaaattcaaattttagctgataagcataagcataagagaaaagatgaagccgcatatggcgtatccaattaaactacaaaacatattgctaggtttaatgcaagtaggacatgatataaagtagaataactatatttacttttagtcactttattacggtggttcttgcaatcagtactcccgcattcaaattagtgtcaccgagcgctatttgtactttttaaaaaaccgctatttgtttttgggttaattggatccatgccattgcaactttgtgaaattaaaaaaaataccactactattcgtcatatcggctatatgccactagaaatttctaaaattgaaaccataccactcgcgtctcttttttcgtcttctctctcacaccgtctctgttcctgtcctcatcccctccctccttcctcatctccgttcccgacttcatcctcctctctgcgtgagcagtagaacttgatgagggagttggtgacgacggggtcccgctcccgcgtgcgccttccctttccctcttcgtcgctgacacggtctcctcctccccgccactacatatttctcttgccggcgaacttccaccgcacgcgcacaagcacaatcatcacagactccggcgatctccatggctccattcagtggggtgatgacgggtgcgcgagcgcgtcgtacttgaatgcctgcgcgtgggtgaggcacgcggcggcgaggcacgcgaagcctgcggacggggaagggggcggggaagacaacgacgcgagggcggcaaggaggagggagagggtggacggggtgggcggcgaggcctcacagatgcgggagtagagggcaagggtggcagccgcgggggcacagcggcaggccagcgcagcgtggagcgggcagccttgggagggcgccgacgagaaggcggcagctctgcggagaaggaggaaggtggggtccagagccaggggaggaggcagcagaggcggcgtgagagcgcgggcatggcaggagggcttgggagccgccgccgccgtcgctgtcctcgatcccctctatggccgttgcctccatcctcgacgcaatttggagctcgggagtcgccaccgccgccgctgtcctcgatcatcgacgggaggtctcgggagctgccgccgccgccgtcctcgatgccatccgcggtgggagtgctcgggagccgccgctgccaccgtcctcgatgccatccgcggtgggagtgctcgggagccgctgccgctgtcgtcaccgctgtcctctttgcaatcgcagggatggaggaaaagatggagaagaaagaggagggagatggaaacgattaaatagggaagaacgagacggcgtgggagaggagacaaaaaaaaaagggatgggactcaggaatggcatggtttcaattttagaaatttccagtgaacatgtagccgatatgacgaatagtagtgatatttttttaatttcgcaaagttgtagtgcattgatccaattaactctttgtttttagcatttgaccattcatacttaagagagaaaatgtgaaaccatatataaagttctctagattcataaaaaaaactaaatataatataggcacgacacacattcacataaaatctcatctataaactcaactttgttcgaggtaataaaaaagatagatttcatgtgaatagttatgtgttattgttcatcaaaaaattgtcatttttgttactaccaaataaaattgagtttgaacttgagatttggtgtggatatatttcatgtctacgtcaatctccaataattatttttctcagatttattaaacttttagccctggtttttaggggtttttttcttatttgatgattttcaatgaatatgtaccttgcttaaaatagtggcggctggtgtggcagcagtcatttggactatgtggaaagctagaaatgcagcatgtttcaatgataagaaaatttaagatgatctcgttgaactaattcatgaagtatgttattggatcgaatcttggtccattttgcagatacaggaggacgagcgaaagaagactacaactgagggtagtgctgctaaggagaatagccgctgagctatacaactctgtaaatggatggaagctgcaaacgttgaggctgaaatgaagaaagatcatgttttgtcgtgtttcgtcgtatatgtctgttgcaagtcctttggggattcaaatttgataatggaagtctattatctattttagtttagcatgcagttactgggtatgttgagttacagacttaagttcggcacctgaggttggcaactaatcactgttgcatggaaaacagagcggtccatcagtgcatgattagttaaatattagttttttttttaaagttgatcgatatgaattgtttaaacaacttttgtatagaaaaattttataaaaacgcactatttagcagttttaaaaggtgtgcgcgtgaaaaaaagagggaagtgagctgggaactttggctaccgaactcagccttacaggtcatataaactctgttaaaagactttgctatatgcgtttcgataaagaaatgggagacgaaccctctctttcttaaaaaaaggtaccctgcttaaaaacacattatatattattaattgtaaaatgcatgatgtaatgtatatgcacatgaaacccccattagtcgtttcatagtagttcaaacattacaataattattgatcaaaggctacattatttaagaacatatggagtaaccgcatataacaagagagaaacctgtttagtgcctttcaaacttccaactcttccatcacatcaaatatttggatatatgcataaagcattaaatatggacgataaaaaaaccaattgcacagtttacatgtaaattgtgaaacaaatcttttgaacctaattacaccatgatttgataatgtggtgctacaatagacacttgctaatgatggattaattatgtttaatggattcgttttgcaatttacaggtgaaaactgtaatttattttgttattagtctacgtttaatacttaaaatgtgtgtccgtatacgttaattttttttaccaaaacaactaaacacggtccttgtcgtgaaaaaattatatatttaaacatagcagtaataggtagatggaggcaaaccgaacatgtaaataagcatacatgtttatattatgttttgcaaaaagaaaaaaaaagaaatagacagagggagcatgctatgtcgatcataataagtatttatatataggatctgttcagattgtagccaaaacaaatattatcaaattttagcaatcgacaatttggcaatatcatcgttttggcatgatttcttatgtatttcctagagtttggtaaaaaactaaatgatgcatatatttgataacttttttaaaaaggtatggtttgaaataaaattaatctgaataacgccatactagttaatttgaatttgaaagctgagtggaggaatttgaatatttgatcggcgtgaaggtcgtctttccttcgcaattcacaaaatcggtccgggtcgaaccaatcaaccaaagcccagacagtacaccaaatccaaattggcggttggatcgagccagcgccgcggccacggcacttcagtgctccatttgccccaacctgacaaaaccaacccgacccgcaaaaatccctcgacacagcagcacacaagaaaagcctctttgctcgccggagagagatctcactcccgcggcggccatggcctccgggcaggactcgtccagcacgacgctgatggatctcatcacctcggatccgtctgccgtgccggccggcggggcgtcgtcgcaccagcagtcgtcgtcgtcggcggcggcggcggcggcgggtggcgccctggggaggcccgcgccggcgccggcggatcgcaagtcgaagagggggaccctgagccagatccagaacgagaccatctccgccgccaaggcgctcaacaaggccctcccgcagcgcaacaggaagaagaaggctagtctcccgttgccccaacccccggccgctgccatctccgcaccccgcttccagtctgactctgttgcctctctgctttctcgtgcagcccgtctcgtacgcgcagctggcgcggagcatccacgagctcgcggccacgtgcgaccaggttcgttctgctacttcggttggatcgaattgcgtggtttgagcttggatctgtaggctttagctgctcttgtacctccctttctgcagaaaagttctcagaggcagcttgtgaatagtgtattccccaagcttgcggtgtacaattctgtggatccttcggtggctccatctcttctcatggtaagtatgccgtcctctactgttttagctctttttatggcttcatctttcacgtagacagcgtaattacttggtaaaagcagtaactagggtaattctcagaaaattcgactatgttagcaccacaatgcattgtcactatggtttgagtctctgaggagatcaatgacaaccttttcatgtttaaaacagaggaaaaaaagtacgagtacttaaatatgtgttgcaacttggaactgaaactgcacacatcgcataattcactgttagattaacctaacgagatcttgtttacttcagttaacttttctcttaatcgaatctggttctgtatttacagcttcatcagcaatgcgaggatagaaatgttctgcgctatgtatactattatctggctcgcatattgtcagataatggtgcccaaggtttaagcgctgctggtggcatacctaccccaaattgggatgctcttgcagacattgatgctgttggtggagtgacacgagcagatgttgtaccaagaatagttgatcagctctcagctgaatcaaccagcgatgatgttgagtgtatgcttttatactgtgctctcaatatacgttgaagttgtattatgcaaaacttgtattccaaaccaacctcttgtcactgttttacattttttcctcattggtactgctccccttttgcactgatcacacctcatgattagttctaccatattctaagcatgctatctcattttggtgaaataagtattatgttattttcttctgttttgcatcttagtgagaattatatttctagtaaacatctaattctgcataaatgataccatatgaccaaataagaatgatcacaatattattatgcatggctgagctaaaacaagatgctctttaatttcttgaaccaagcatgcttaattcttattaagttgcattgggtggttcttcatagtgctaaactatggattctggtctttgaagttcatgctaggagacttgctgctctgaaggcccttacctcctcctccacaagcaattctgagatgttggaaaaactctacgaaattgtgtttggcattttggagaaggttgataattgatatgcttttcatattcagattagttcctcaaagttttattgccctaagttcctttttggtatcccttgtttttggctataaaattgacgcttttcttctgtccatgatgtattctgaatcctttcaggtggctgatactaaacagaaacgaaagaaaggtatatttactaagcaaggtggtgataaggaggtactaaacagaacgaaagtactatttattgtatatgcacttaacccttttcttagaggtttcttatctcataccttgctgataatgggagttaagaatacacttattggaacattgtagttaacctggtagttttttcttgactagataacaaagtaggtgacaccacttcctgtttattttgagctggacttaaaattcctcactagtatcagtacaagctgtctgatgatgcctttctaatttgcatttctttgcagtctattatacggagtaatttgcagtatgcttctctaagtgccctgagaaggcttccacttgatcctggtaatccggcatttctgcaccgagctgtccaagggtaagtgtgaccttttttcctctggaaacttaagtttaggtttattttccatgtctgtttagtttaccagttatctactacctccatttcatattatatgatgttttggatttgtcctaagtcaaatttcttagatttcgaccaactttatagaaaaaaaaatcaacatctggaacaccaaattagttcatcatatccaccattaaatatattttaaagtacatttgctttgtgttgaaaatgttgctatgtttttctatagacttggtcaaacttaaagaagtttgacttaaggcaaacccaaaacgacttataatgtggaacaggtcgaataggttattgcttcttttgaggataaatgggggcatgagtattgttttgtggtatcttttatttgattatacaataatagtttttcttattgggagcctagtctaaactaaaagattagatcattgtgatgacattgctaatagtacggcgaaggaggattcttcagggtgtgcttaatggagaatgaatattcgacatctgttggtttgttaatataacctatcttgagagatctagaaaggatgctattctcgtgtctaccttaaactgcaataccgcattagtgttttttagacggatataagattgtgagagccgatgctctctttaggccttaatatggatggatatccagtgttcaagcaggtaagtgtaaagacggagttatcaaatggtaaacttcatcgaaaagaatttctccctacaaagattacaaacaactccttaagctacatatttgtattgaagtcttctttaagcaaattgatcatttcattgtgttgtctgaacataattatcaaatggacacctaagtttttgtctatctatttttatgaccacttgattctgcttctgcaacaaaattacagaggggtatagcctaatcaaaaagtatcatcaaggaacctgctgttgcataattatcattttattctcatcagacctggtacaattgcagggttgaattttctgacccagttgcagtaagacatgcgttgtcaatagcctctgaaattgccgtgagagatccgtactctgtcgcaatggcactgggtcagtttactcactgattgttgttcatcttatttattgttcttgcaagcagacaaaacatgggccattaactcgtggtgtagaacatacttgatcttttatgtgcaaggaattgtatagaatttcgactataaattttttaaaaactgtcagctgtgatatatttagtcaatatgcagtaaatttggctcatgccatttcgtagattctcattctcatgtttgttttttgttttgcaggcaagaacgcacagcctggtggtaatgttttttcccctttcttctgtgtttcatttgaacttaacttgattatgcatctgatttgtgttttagagttctagttgaaccgaccgagtttgtagaattaggatttctaatgatatgggctgtattctgcgaagaatcacgtgttaaatcgcattcatatattgttgtttgatttatatttacttgttgatgcactggcatgaaatgtaaaatataagcaataatctggggaaaaggcagtacctttctgtcagttgctaatgtaatacgtgctcaatgacaacaagaaatgccgtacatgtattctttgatcaccatatttagttcaatggtatttgagacctgggtgacttaatagcgcaaccttttgtttattgagtattttagtgtatgatatatggattttgagaggcatgaatcaactaatggtacggtaattgcatataaatagcttcggacaccatctgattgttgtgactgatcttgctgttgattgttttgaattccacaaaaaaggaatttacctgcttgtatatctgattgcttacaaggtgtttcttttttctctttgagtttgttctactttgatgtactcatttcctattattacgctgtgtcaaatttaaccaggagctcttcaggatatccttcatttgcatgatgttcttgccagagtttaccttgcaaagctgtgccattcaatttctagggcacgtgtattggatggtgagtgtaatttgtttttgtgcctgtcttaaatcaagatgaacatgtcatgattccagagtgaatgcatttaatcgtggttctggtcaaatttgatttacgcagagagacctgacataaagtcccagtacagttctctcctttaccaacttcttctggacccaagtgacagggtctgttttgaggccatactctgtgtgttgggaaaagttgacaacacagaaaggtactgatgaggtttcaccaatttaaatttctatataactttgtttcttcacttcagttcgacttgtacgtctgtgtttttccatataaattactatatcttgcagcacggaggagagagctggtggatggattaggttaacaagagaaattcttaaattgcctgaggccccttctgtagcatcaaagggtattctgtcaaaatctgaaaaatcttctaaagcaaggcgtcctcagcccctcattaaacttgtaatgagaaggtttgtatcttcattcaaatgttcaaatagtcggtctctctattttgatttccctgtatgttttctcttgttcatggatacctattgttcatttttctcttctgtcagactggagagctcttttcgtagcttctctcgtcctgttcttcatgctgctgcaagagtagtccaggaaatggggaagagtagggccgctgcttattctttaggcgcttatgacgaggctgccaatcttcaatcttattctgataatgtcgagtctcttgattctgatcttaatgagaactcacaacctgaaggtaccatgatattattgtagttttaattattcaattataaatcagcgtgaatcatatgcagcgtaaattttaattttatttaaagtaatggaagatggttccttcaaagcattccttattgggttggctggaaaactaggaaattagcagcctatagatgtaaatacatctcttttagaattaggctggggaatgcatctttctaagcatgaaatttaatttgttgcttacatggttcactagcgtccccttcttttgttggaaatcacactatggggtcctatggtttagtaatattccactttctattaaaatcatgtaactgttcatgttgcagctactcgaaaggctaacccactatcaaatggacatggtggaatggacacaatagcaggcttattagcatcactgatggaagtagtgcggacaactgtagcatgcgagtgtgtatatgttcgagcaatggtcatcaaagctttgatatggatgcaaaatcctcatgagtcttttgaagaattaaaatctattattgcatgtgagctggctgatccggcctggccttcttctctcctgaatgatgtcctattaactctacatgctaggttcaaggtattgtttcaccccattttatgcgttactaccagctgtgtgcctcaaatataggacatatgagtttgaaagcagattgatcgtacaatagtgacttcaagtttccataggttttgatgatttaaaaacagcattttatgaaaaaaaatgaaggcattcttttcccttggacatttgattgtaattttaacaggctactttacttgcaactaattctgtttagactacctttggcattgttttgttctcccattgtttatgtggcccaagtttgttgtgcatacattttgtagctattaatttgattattaataatcttttatcatttgctaaatacatggtgatttattattcgtttgttcttacatgataggcaactcctgatatggccgtgactctgcttgagattgctagaatttttgctaccaaagttcctggcaagatcgatgctgatgtactacaactcctgtggaaggtatatgccttttatcatacattacgattaatgtcatattgaatcaccaaggtttacttcatgaaagagaccccaatttctgtggtcagtttgcaaagctgcaactacttctgtttggatgagacttttttttatacgataaaactatgacaataataacatttgttatctttctagacatgccttgttggagcaggaccagatggaaaacatacagctttggaagctgtgacaatagtccttgatctaccaccacctcagcctggttcaatgtctggatttgcatctgtcgatatggtatctgcctccgatccaaaatcagctatggcactgcaaagattagttcaagctgcggtaagaacaaattctccactaggttaattttttcattgagcatggaatcacactatgttgatgtcttggcccttcggtggatcaacaggtttggtttctaggtgaaaatgcaaattatgctgcttctgaatatgcctgggagtctgcaacacctcctggtactgcactaatgatgcttgatgctgataaaatggttgctgcagctagctctcgcaatcctacgcttgctagtgctttgacacgtctgcaaaggtgtgcattcagcggtagctgggaggtatgcccttctgaaaagctgatggtattgcatcatcttataacactggcatttttcttatctcattgtttacctccgtagatccgtattgctgctgtccaagccctaaccaccattgcaataaggtctggtgaaccttacagactgcagatatatgagtttcttcatgctttagctctagggggtgtacaatcaaacttttcagaattgcagctaagtaatggggaaaaccaaggtgctagtggtactggtcttggatcattgataagcccaatgctcaaggtcctggatgaaatgtatagagctcaagatgatctcgctaggtatgtcacccccaagattccattggactgttgtagatagtactgaactgactactttgtgtgatcatttgcagggatatccgtcagcatgataatagtaagcaagaatggaatgatgatgaacttaagaaactttatgagacccacgagaggcttcttgatttcgtctctttgttctgttttgttccaagggccaagtacttgcctttaggtcctaccaggtatgtgtcaatctttgggggttctaatctcctaaagcagtaaaactattcctggattcaaaaggttaccttattgctacaactgcttaaagttagacctataaaattcactactcaccacacgacgactattcctaggactattaacctattgcttcacagcccatgtcatctgctttcttgtcataccacgaagcattctatcacaaaaggaagagcataatatttagtaatttgataagttacttctagctgtttcttgatcccaaaagggcaattgggtgtaatgggtgtctgccttttgtcctattattctttcatacctcattttccgtgatgcggtattgtgtaactaccctatatttaatatcatgtaatgttgaatctaatctgcagtgcgaaactcattgacatctaccgcaaccggcataacattagtacttcttctggtctaagtgatcctgctgttgctactggcatatctgatctcatgtatgagcccaaagatgtgcccaaagaggccactcttatacagactggaattgaccctgatctggctatggcctgggcagcaggtttggaagatgatgtttgggaaaacaacgcaccagctgtggataaagtatggttttttactttgctttgctgttaattcatacgtttctgcttcctatcaattcatacacgtgcaagttccccttttcctgaattcgagaacaattctttgtatcgtttatgttctttcttcttggatcttatgcaggtaaaggatttccttgctggcgctggaactgatgctcctgatgtggatgatgaggaatacatgaattctaggccatcagtcggttatgatgatatgtgggccaagacaattcttgaaacatatgaagcagaggcaagtgctaaagcattatcgagctactccctcattcccactcactaaggcgcggttaaacttgacacagtcttcaaaattaatctttaactttaaatttctcatatattataatgtttgtagcaacaaaatcataatcatatgaaagaaaattgaaatgacattccaataatattattttcatcaaataaaatttaatttataataaactatttattggtcaaatatttagagagttgaatcttaaaatgcgtgcgcgccttagtgagtaggacggagggagtacctgatttcagatgttttgaattgatagaaagtatcaaaataattcaatttgtttttatatgttgcaggatgatgatggaagatcatctgggggatcctctcctgagtcaactggttctgtagaaacatccatatcgtcccattttagtggcatgaactatccgtcgttgttcagttcaaaaccatcaggatatggggcttcacaacaaacggtattcttttacttagtctttttagtgttaaagtgatctccattattgggtttcacacttaataactgttggaaaataacgtactgaaaacctatgaaatcaaatgtatgcatgctgagatgggcatatttaatttaattaaactttaaataagaaaacaaaagcttttacttattcaccatctggaaatcaagtcaccgaacagcaaacttagctattgatgtaggaacctcgctgctgcttcataacaatagatttccagatggcatcatttgcttaaagagcatcggtttgcgttttgtttcagatacgtgaagaaccaccatcatattcaacatcagttctacagaaacgtgagtcattcgaaaacccccttgctgggcgtggtggtcggagttttggatcccatgaggacgaagacaggagttcagggaaccctcaatctgggaaagcactgtatgacttcacagcaggtggcgatgatgaggtatggaggctgaaattgtcttggttggctataacgtaacatcctgagcttcaatgcttccttgatcagagcttgataggcattagctgttgtgaaacatagttatttcagtgaagcgaacctcgtgcttttcatttgttacaagaacttaatatcttaattaattgagatagctttttaaatttatgatttgataagcgagttctgtagtaaaagagaagaccaaatgaaagcacaagtaaattatttgaagtgattaagctggctcttatttcttgtcttggaatgcacacaaaagaaagtttatccatgtaaatttctttcagttgagtttaactgctggagaagatgtggaaatcgaatatgaggtcgatggttggtactatgtaagttctcttctcactttctagtttttcttgttctttagtcatgcgcaaaaacattttaatattggttattattgctgtatcttcaggtaaagaagaagagacccggaagggatggaaagacagcaggtctggtccctgttctgtatgtgaattcgtgatagctatgagtcctgtgacataatgctctcgaaagctgattcggagtaaacgggcatacatatggcgtctggggaggttccttctgtgatcttagtagtgcacataaccttttttgagctccctagcatttgacaggcacatgtccttgttggaggccaaattcaatcatcgtgatgtctgtaagacgcagcaattttcttgctggttgtgtttctttgctttatacacaccacgagtccattcaattcattgtttatgtgtagagatgtacacgtgcttcggggttttacctttcgtgtgctattctggcccgtctgttatgattgaaagacgcagtttactcctctagttctccatcagataggcattattttgtcaaattgttgctctattggaggctgtaaactgctgaaggctgtatcttgctccccaccattatttcggtcttgtttatggtgattcagtagaagtagtaggcctgttaatttgtgtaaattttgtcttgtgcggagtatacatacatgaacacatacgacaatggaatggtatgcgtcgataactttcttactctgaacacttaatgcagtatacgctatattctggctatttttatggttttcgattcctgtatgaattgattgttgtgaaattcctggatcacagtttcaaaatgagggctaacatcccgtaattttgttttatagtacttgactacttgtacagttgtactaaagtcggtactcggtagcaacacaaacaatgcatcgatactccctatgtctcgtaatataggattttgctccttccaattatcccacaatataaaagattttggtgtaatacttgtcacatcaatcaactcaaattcaaatttctatctattttaaccttcaactatccactcatccataaacaagggaaagtgatttcatccctcgaggggatatcctctcgtttcgtgcatatcacctaaatagctataaaaaatataaaaaaattggcaatatagattaatatgaaatatatcactccacaaacattgcaagtttaaattgaacttctacaagttacaacaaaaataacaaatatagttgcgaatgtgcgataactattctcagcttaatttgttatttttattgcaacttgtagaagttgaatttggtctttcatatttgtggactggtatatttcatattaatctatgttgttgttgacgtaaaacacgaggcctgggagatctgcttaactccagtgcaggtccaaagctcgccttcgggtgtgttagcgtgccagttgatttgattctacaatcaacaagaaatagaaacaaagagatcgcggttaaatctataaatgatagctgatcggctaagtgccgatgacatatcatttatctttgagccgatgtcatatgtaaatcgatcggcgactataaatagataataaagaactaaacctactcgatcggctgtagatattaccaatatatagttcttatatcgatatatatttaaatcaagtgattgagatagatcggtcgccatgccaagacagtataaatcacttggatcaaactatatattaataacaggactatatatgtttatagcatagccgatcatataaatttagcatgtatcggttaatactccgatactactctatatcaggatattaaaacaagtataatatatcaaacaaaagcttgatatacttaaatgcaataagatcttgacataaagggcggatttaacatgtcactgaagcatatagagcgaatatggttaaatcagataagatcggctgaaactccgatactaccctaatcggcaaccagaaggcgggctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctgcgctctactaacagatgttagccgattgtaggttagatagcgatattgcaagagattatgtacgatatatgataactcgatgaattacgtaaacaatattagagtatcataaagatggaagcactaatcccgagaatacaagccgtcataacaagttttacctcttgttgaagatcaaaaccgatgcagctcaacccgaaagtaagaactcgtcgaaataaaactaaagcaaaaaggtggcgatgcgccgaaattgtattgaacgtgtgtgtgttttttattacatagggctcggggtctatttatacccgagaattataagatatgtccataccggacacgactattatctctaacaaactctaagataccataagtctttgcggcagacttttgccctaaacatatctctaaggaaattacataaaacatcctaattaatagatataattaccttttcaggactctatccacgtgcggcaatcatcttgaagcatatcaactcaaacccaatgttggatacgagtcatattgccggaatcggctgtatcacctaacccagtctgattcagatttagccgattctagtcgtagccgatctggactccagccgattcttactctgttcccgcaacaacccttatctttggttccgcttcgatcccatgttcacccccgatgctgatattaccaaatttggtcgttaacagttgtcaatgtcttttaaaaaattttaataaacaacgagaagaagtcccctcgagaaataaaagtttacgtcccacaaacaaatcttatttaataagggcattctattcttgcttaatcttattcaaaagagaataatccttgggagtacggagtactgcactgctcctaccttctgcaaatccaatcaatcgcgggttaatatcccagcacaggtcctcgtggacatcgtcgtgttgtcgggcgcgtgttcttgtgagccagcaatctccttcgatctgcgcgccatcctccccgatcgtgacctgcgccatcctccccgattgagactcgcgccagcagaattaacaatcaaggattgccttttcttccacagaaaaaaatcgccttctcgcgggtgggtggcagggtgggtatacgtacacgtctccgaagccgcaaccaaaaccaggcaaccagcacgcgatggggaggggcgagcaggaggcggcggcgagccatgggttcggtagcatggaggagttctgggggttctacctgacccagcactccaagcccggcacccggcggtggcacttcctcggcacgctcgccgcgctcgcctgcgcgctcctcgcggccgtctccggccgcgccgcgccactcctcgccgcgcccgtcctgggttacggtatggcgtggtacagccacttcttcgtggagggcaaccggccagccacgttcggccaccccgtctggtctttcctctgcgacctccgcatgttcgccctcatcctcaccggccgcatcgacgccgagctcgctcgcctccgcctccagccgcctcacgacgccgcggctgcctctgcacaccgggactgatccgccgaagtgctcgcgatagcaacatctggaagtgttgatgtgtactccaccctgtaatttgctaatccaatttggtactttttttttgttgcttttatcattttcctcgccgatctgttttggttgcggggaaagggtttggataagcagtgtatccaaaattagtgtggctaggcagtggctgcttaacaaaataatgaccagctactagaccataacataataatgctgtttttatttcctgtaatacttgctgcccccaaacacaaatctgtgatcgaagcacaagttcttgggagtacaacacggttaacaccacaagaaactccttgcagaacagtaaagatgcatgtgtcctatgtgaataaccaagtgtggcttctttatatgctggtggaatgcatacatctggctgtacgtgtagtcatgtagagcgcgcgttgctcagctgtcacttctgttgggcttgtctgacgccggatacacctgaaaccaacaactggttgcttgcttactgatgcttcttgaacagaatttcaaccaaactctgttgataattgctgaagaacaggcatgtatacagcattggacaacttaaacaagtacagttaccgtgtcagctgatgggatccactcgtttgtagcaggatttcccttgcaggaggcatggcgctccgatgcatctgggtcatcagacagatgaaacgaggcgtccgccgagggcttgtccatcttgatgaaccctgttccagtctgcaggatattgacagtgcacacacaaattaagatcataagtgcactgtgatcagttcgaattaatggatggaagcatgagggaactaggcagcgacgttacgtaccgtgtggtgctgcttgccgacgcagccgagatccttgtagtactccgtctccacgaactcatcccctgccttgccaccctcgcacaccaatttctgcagcagcaaaccaccacgtaataacaccgtaagatcaactctaagctttcgtgggacacatatatgaaagtgcagttgagagttgggactgggagacctcggtgtgggcttcgagctgctggaacctgtcgagctcggggtgggagtcgtcggggacgagcgcgtcggtgtagacggcggagggctcgctgcgggagggcttggagtggcgcttgggcgccgcctcgtcgtagtactcccgcacctcggcctccatcgccgcctccccctccggggacaggtgcgcgtcgctcctggccggcctcgacatttcttccgatctttcgcgcgaagcgcgctgtgccttcgttagctagcgctcgtgtaagcttcaagcagtccaaggacgacgaggggactgtggtgcgggtgctcgggctatattggcgtgatggctgcgtggtccgcgccgcgggtggatatggacgagatatttttgtgacttctgaggataaatatctgcagggaggtgtagaggttggtgggtgggtcgattggcttagcgagaggtggacgtgcgcgtgagatgccaggaggacggaatttgaccgcgcgcgcggtgcatctcgcggcggcgcgcgtactcgggtgttcgtttgcaggcccggaacgtcgcgtatgcggccgaaggcccaacaacaaagtccccgttgataactgggcccccgtccgtttcctctcctcggccgcatatctgcacaagacggcaaacaccgcccactcttgcagaattcttcctctccgcttctctgctcatctgctggtggtggctgcagattgcgctccgatggcgcaagcggtgcggccgtgcaatggtcggcgcgtcggtcgctcgcctttctctactcgatggtatggcttatcctagttcgcgcgcatggctttgattttgtgctggatgttgcagccacccttctcgcgcggctccgtgacggcgaggcgaggttcgagctcctcgaggactccgcggccgcggccgcggcctcgcccgctcctgctccagtttggcccggcctcagctgcttttctagggttgctacctccctgtacgtacggctggtttccctttctcctcctctgctgatctttgtgtcgcggtagggttgtgtgtgattcgtccgggggattgcaggaggggcgggtggtcgggggcgctgaacaaggtggagcactacggggtccagagggtcacgggtgatggccggtgcatgtttcgggcgttggtacgtcttgtcctgttcaattgcgcattgggaatttctctggattctcaaggaaaccctggtgtgtctcctcgtaggtgaaaggaatggcaaagaacaaggggattccattgacctcaagggaggaggtacaagatgcaggtaacctgcaattatgctttgttcatggataaatattcacagttgtttgagacagcctgtgcagctgagctatctctagagctttgaatttacatttacgaaagtaactgcaatagctctgaggaaagtatatttaggctgtgttcgtttgtgtgagatagggtgagaaaacaccttgttttccgcgcgcacgcttcccaaactactaaatgatgcgttttttgcaaaaattttctataggaaagttgctttaaaaaatcatattaatccatttttgaaatttaaaatagtttatactcaattaatcatgcgctaatggctcatctcgttttgcgtatcttcccaatcttctcaatcccctatctctcaaactcacccttagatgctaccgtaatcttttgatacataaatcattttttaaaattttattttgttcagcgcactcctacaacttaaataatgcttattcagaaaacagaacatccactacaaaaaggagggaaaacttgtcaacacaaggcatataaagagagagctcctattattcttgtgagattcgagtagcccacttgtccatcaattgcataaattagactgcattgcagttcttatctttggcttcaaaacaactttgttaaagcatgcattaatttaggatttccatattgttcgttccatggcagaagttttaacttctgaccgtaacttatgtaggaaattaacctagctactgtttgaaacatcaagttagttaggcataatttgctgccaccactgttcagacatttcttgttggcacctcaagaggtcattgttttggtcgaagaatgtctagaacagaattcttgcatttaagaatgcatgtttcctaccagtttcgtctcagtaaaactgtcattgctgaaactgtctcagtaaaatgttccctaccagtttccatgttcccttaccagtaataccacccccctatgtgccactttcgcatatgtgacttgtgacgtgacaaaaagataaatctggagtggcaaaaaattaaatgttccgttatccagggggcatttaaattttttccactctgcaccaaacgagtttaatccctctcacaacatcccctcttacaaagtggcaaattcccagtatatcctctctacccagcagccttgtcaagtatgacttttcatgagcaacttcactctccaaataaacttatgacactacccatctttcacctaatgagctgaagattttgcgcacagatttccattgaagttcgaagtttgaagatgatatattattttaatatacttttgtgttgatatcctttttcaatttcctagatgatttacggatggcagtaaaagaagttatctgcgatgatgagactgaacgacaaaaatatgaagaggcagttatagcaattactgtggatgaatcattgaggcggttagattcttatgtcctcaattcatttttatggcatgacctgtgataaagaggctgactatcctggttttgcagctactgccatagaataaggcgatctgatttctggggtggagagtcagaactcttggtatagttttcataattctaaagttagcatgcactattaatataaacagcaaccatacatcatttagacatatagaacacctgtttctagtatatgtatcatactctaaaaaaagtatgtgcaccatgtttatgcatcgctccttaagtgtgccaaaaaatataatattgtttgatcgtttcgctctgaagattctaccaaaagtaggtttacctgtttctagggatgaaactggttcggatagtttccgtccatccgaaccatttttcggattcggatagtttcggtcggaattattcagaaattttcggattcggaaacgaattcggatattttttctcggaaacgaaaacgaatacagtaagggtactatccgtcggaatcggaaaacgctcggaaactatccggatttttttttcggatatccgcagacattgagcaaattttagaaaaaacacgtatatatttataactttttcatacggaatcagatgaagacaaactttatatcaacattgtagagctcgatgagatctacaactttattattgactattttattatttgaggtcatttaaaggtctaaatattcattataatataccatattaatttttacaaaatctcggatctacaattcaaacgacatctgatggagatgtgttccatatcaaaattgtagagctcaacggatctaccactttgtagtttataacatttgtatttgaaagcatttaaagtataatacaaacattacaagtttcgaagatgtgaagtaaaataaataacatctccaatttatacactggtaagtaagttatacatctagtaaaaggtcttgggaatagaaaatgataatcatatttgcatatggatctcttaaaggaacagccatgaaaatcgattttcacatacagttgtgggaccgtatacaaaattgatgatataaatgttggagatgttgaactaaaataataagcgatatctcttcctttatcaagaacctcaatttgaggggttttttatataccggtaaatatttgctaccgtattcgttccgtctcgtattcgctccgtatctgtattcgataatatccgatttcatttccgtatccgagtttttgattccgattccgaaaaaaaaatatgaaaacgaatatgataaagctagtttccgtccgtttccgatccgttttcatccctacctgtttcatagtagagtgtaagggcatctcttgctttgtatcagtacatatggtcgtttcatacaaatctattctacatctgacatattgatgtttcaggttttgtctaaattgtgtcggcagccaatcattatttatattccagagcgtgaggtaagcctctatatacatggataacacatatacatgaatgtgtgacccaaaaatgtaaacatgttgtgaattgtgccttaaagaagagagtatttctaattaaatctatctctagatggttgcaaaataaatgttgttttggacattaatatgagaccataaccagcatttcaaagagacagttggcatatcgttgaaggcaaaatgggtgtcaaaccatgaattcgtactgtttctaatagactttattgcaagagaaaaaatagacaccagatattggtagaccaattaattttaggaccttccgtcaccatgcaaattagatctgggaatgttaaagtaccgagaagacagctagaataggcaatgtgccaaggtttacttgtgcttcatgatgaatggttgagagtgagatgatctgctaaagtgattccaaacatctggatttcattctatatttctgttatcttgttgtaatgctctgaatcctaagaggttcagaatttagatattttttaggttcagaggaaaaaaaattacagaacataggaatgcatttgcaactgatggatggaacttaatgaaaatatagtgaacgtctgaatgcttctctttgcatttttcttgcttataactgacccatcctccagtttggagttgctagttggatgtactcattgcactattgtctgtttccttgcaaacaatcttatgttgcttttctttcatagctagcctttacaatcccccatttcagctgctcgacttacatctttcctgtttgtgtaacagtaccatgggcgtggaaatggttttattcctatagcagagtatggactggaattctccaaggactcaaaacagtggaagaaaaaggtgccagtaagactgttatacagtgggaggaatcattatgatttgctagtataacatggttgcaccgaacgttatcagtaccctgaaggtctgaactatttatgacaactgattttgattccatcattccattgttattctttgatcccacgtagttttttgcttgcgtctctgcagacagcttcgatgctactccatccattccaaattgatctaatatagttttttttgaagttattcttaaatgatctacatatttgtgttcatttattgagtattcgttatttgtacattggagtaaatggacattgatgcatgcatctatgcacacaagtatttataacccacatgcaatatcttgatttgctattggctaagaaatattagggatggtgtatacatcgagtttgttgctagagtaaatatagtatgagagagttattagcttttcttggtcttggtgtacctataaaatatgtagatcaatttggaatggagggagtatatagctaactgttctacctaggaaaaccacatatatatagtagaaaactgaaaactaccgttggatcaaaaaataaatgtctgagatttgtccacgtcattatgagtaaatctgcaagtaaaatttttactcgcgatgacttggacaaatctaatatgtctattttttaccaatggtactacatatgtggtttccaccgtatattttcccgttctaccgtatgaaatccattggttccatcttatctgaaaaacttccatgactaaaatgacactaaacctaataatgtcgcatgagctaattacttcctctgtctaagaatataatagcaacctagcaaataattagacacaacctagtacaattaatctggaccggagagggttagtacattattctcctaagttactatatatattttaagacaaaggagtaggttgttatattttaggacggataaagcaggacaccaggtgataggctagtgaggtcatttggcatctaggctaaggttgttccccatcctagtgatgccattcggcatttaggctaatgctgttcgcagttcgcctgtgattcggttggcgtcacgccgtcaagctgttgaccgtatttccggttggtgccgggcatcgtaataatggcgtgttcgtcggactcggtggttgccaggggcaaagacgatgagaggacatgcttcaaatcctattcttgtgtcgttgcaagcctggttgaccggaatcatgttcttgttggatgagctgtgcgatgcatctactcctatatcttgccatatgttttgttgaacagcaacagcgaatgttttttcccctttgaagcttggttcgtttaatcctaagagaaaaggattgagagaaaataatttcacactacaatacatatgaaataaattatttccaaatccccttcaattctcttgaggaagggattaattgaacaaggcttgaatggggtaattcttttgttgaatcctacattcctattatatctattattctctttgctaaagtattggggaaaaaggttacatttttaaattggttgcaacatattaaaaaaaacgtcacgctatgcttgccaagttatgatccagtggacgaatggtgatgcccaccagcagatcgtacgttcctgacccaaatcacgcttaaaagcaagagttgctaaaacgagccgtaggtgtaacacaggtgtcattggagtaaatgatgcattgataccttgtccgtttgctaagctaagctagagctggccacaggccactgccgtgccaatgctactcgcctgctgtgatgggcccacaattcagcgtctcaccatcgacgtagaggaccgaactcggcggtgcacgtatcaatacaagaaatcgtcctttctctctgcaatgttttttttttcgataaaatggagagagagtacccttccatcctataaaataccgacataatatttggatacacatctatctagatttattatactagaatgcatcacatctagttgatttattgtttatgagacggaaggaaaactacggtgtactgcaatgcgctatgcagggcataatgtgctgctctaattccaagcaacaaatgccaatggaggagaaggtacaaggggatagtccgacgaggcagccggagaaggctggccgacgtcgtgggccgcaccactacgcgatgaaagtatctgtcatcacgccatcatccactgagagcctggcacgcgggccccatgccccgtcccccacccccc

SEQ ID NO: 61686 - DNA, 2668 bp, Oryza sativa
taatttttctggttgccagaaatatcaactgagctctcctgtgcataaatcgtaaatttcctacctgtttttggttactggacacacttatgagtgagtgccctcatgaacaaaatgccattatcaatatgaaacctcgcaccttttgatatggtttgtttaaaataaagggctctaatatcacattccaattaatcgactaccgtaagacgtcatgacaaatggtttgctgcgaaccatttgtcgtaaaattaccagagacggttcgctatcatggatgtctctatttgatagttcactatcacagccgtctatatttcactgctgcatcaaaatccatcaataattagtactataagagagttttgcggatgtgacgttgttgatacttcacagacataggtggtgctcacggtaataattgtctatgatggctgaaaagtctataacaatatttatcatccctagtttaaatttctcacaaatgaattctatagccctcttttctctcctttttcttccattgccctcctcttctctcatgtggctggaggcgtcgtgtatcaaggaattttgtttaaacaatagaatttgctctagtatgattccctgaattatgccagtttcgaaggaacccaaagcatcatgaaatttgcgacttatgaaaattagttgcatccaacatatagcaaaaatacatatcaaacacattttttccttggttgcaactattaaagatggctatttcctttctgataatagttcatagactgatagacatatctaccaatccgtctctgttagttaggcaacataggctgcgttctttccacaagtttcccaacccctttccctcgttttccgcatgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagcctatatagtagtgtttgcactccttttttaataaaattttaacatttaatctgaaaagaaaaggtcaagaggtactaagctaagaataaaagcagtttatgagattagtaccaacaaaatcccagtggaaagcaactgggaactttaattttgggattgggtcagcaggaatctctgtgattatgatctagtaatacaagcaactactactcattatgagcaatcttgagctaagtactagttctgtatgaccagtagaattggcatctcaaatactgtcacgccccgaactagtcccgaccgaaactagcccgtgacgctccaaattaacctgttaatcgataccagtcccaggaaatagtgctggtatcacaagaagacagaatatcacagcaacagaggtctctttattatagagtaggagtacagtcatattgggctacggacagattccgagctcacaactgcattacaaaaggggaacggaagccaagacttggaccaaacatcacaggcgagacttgggaactaggccgaaaccctaaaactcatcgtagccggcttgctcctggaagaactcctcgtcagcgggatccgcttcatcttcttcagcaattggggggattatttatatagagcaagggtgagtacgggagtactcagcaagccatgggaaataagtgtttaatgcaggcttcaaagaaaggctgttgtttttgcaattgattttatttaaactcttttctgaaacaactaagtgagtgcttctcaaacgacacgaatgagacagtgcgtctcgtccggtcggagtatgtgcaatgtatcagtcttttgaatcgatcaaggttggcacccggccaacaactttcaaatggccacccgggcctggctgatcccatcagccgcagattttccaaacatcagtcccaaaccacatccgcaaatttcacaaagcagtagtcaaacaaaactacgctaggaatcacctcacatccgcccatgaccgtgggcacggctgttcgaacagtttaataacctctgtagaggaggtacactttacccacacgacattactaacccggatcatccagcccgtgcagaacggccacaactagagaccttaaggctttcatgacaaggcatttcgaaagccgacacaggttcaccatatgccaacgagaggggtcccagaccaacaacagattagatcccagaccatactgtgccaggaagcccagggatcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcgattttggaaattcatttaggttcgcaagcaccgacccaggtgtcgggttttccaagtcttttataaaacccaagttttacccaagatgtttctcagattttaagtttgaaggcgaccgtcgatactcgtacagagtgcacgattaccgaggcgcaactaggtggttacaagggaa

SEQ ID NO: 61687 - DNA, 2800 bp, Oryza sativa
aatgtgacatattctaaaacaatgaatctggacagatgtatatccaattcgtagtatgtgtcacatccagtactatattgattttttatgggacggggggagtactcaattctaaaacaagttaatcattgatatatcctaataatataaatctggataaaagaaaatatcattatacatacatgatatgatttcattccaaaataatttaacttatatatagatcacattatattttaggttaagttattttagtacgaaggaagtagatctagaattggtggctaaaacacatcagctccatgcatggccagttggccacagaaaacatggtaataagtgcagggtgtgcagtacacgaaatgaaaccggagcaaatagcaaaatcgatcgtccacacctctttaatcactttagctgctttaatttggttatagtggatgaatatgcatgcatgcgggcgtgtgcagcagcagcagtagtaggtgcttgattgacagtttgagaatgagatccacactctaattaactctgaagctgacagcggaccccatgcttcctgctttccctgacagccgtcttctgcaattatcggagtcgaggtactccctccgtcaaaaaaatagacaaaatctgattttcgtgtccaacgtttgaccgttcgtcttatttaaaaaaattataaaaaaaattaaaaagataagtcacgtataaaatattaatcatgttttatcatctaacaacaatgaaaatactaattataaacaaatttcatatgagacggacagtcaaacgttggcacagaaacccacggtttgtctttttttttggacgaagggattagctacctatatagtcatgctgatgcgtgtcatcgatcagagtttagtggccacataaggtgtgcactctgggaagccaaagagaagagagcagtacatgcatcgccatctcttatactccttccttccgtcccataatataagagattttgagtttttatttgtactctttgatcactcgtcttattcaaaaaaaaattagaattattattttttttgactttctttattatccaaagtattttaagcacaacttttcgttttttatatttgcacaaattttttgaataagacgagtggtcaaacattgcaagcaaaaactcaaaatcccttatattatatgacggagggaatactaatttctaaccctgatttgggtgttactttccacttggcaattcagccaactggcgtacattatactgtgtcttgtcatctgtcactctcctatctcaaaccagaaatcactttgccgtgcatgcaaaggcagagcaactccatgtgtagattcagtaaatcggtagtaacattagtcatcatgtatgatttagcttttcgaacatattgatctgatgtgcatgtcatgtaaatacagtcatcaagacaaatacgacgtcctcgtcttttaataaaggaaataaacctcatgtaagagagtcaagttagtcatcttcttcatttaaaccatcaaagaaacatcagagcaacttccgcacatttcttagataatgaaaaacaaataaacttcgctctctcgctcatacaagtacagccacccttgtattagccatgtcttggcagctactcaatcgactacaatctgcaggttgctagtacacaagaagaaggccaagaattacaaaattaagacaaatggatgggtcaagacaaaattaagacggccaagtacgtcatgtaaaagcgtcaagtcaatagtcctttttttccctaacatattgtcaaaacaccaaaggaattgaagttccacacgaacactagcccatccatgtagattccttggcagccacgctcaacaaatttatactatgcaaagaaagggagggaaaaaaattaattaagacaaatggatgtgtcaaaagttagctgaattcgtgcggcgcaagagagcagatgaccaaacaatgctagtcaactcaagtcatgcagctcccttgttataattaattaatcatcgtattcgtatatatattgatatactgaactaatctgtcgttgttgttgtgtggttgtcatgcatatactgtcatgcagcccaacgtttagtgcgatccgacgcaggcaagcacgttggctactttacaccataaaaaggcagttttttttaaagaggacaataaaaggcagttaagcactgagccagtcattacacacaacgctaatcttcgtcctttctcttgtcctgatctgcaaggaagagtatatacagttctgtgctagctaccactcatcagcctaagtgatcgagagatgtggatcgatttgatccaacattagtgctgtgtttaggccttaggtgcagaatcataatgacggattgcgaaagttagcaccgagtaagcagcagagtcgtttttagctggtggtggctggcgccgccgccgcgcgcgccggtacggtcttcttctccggcaccggtgcggtgatgggttggtgccttggcggaatccaactctgcactgcagtctgctctgcactctggtcgacgcgtgtagaggacaggacggaaggcccaacaagtgagcaggtaggtctcgacaatgtgtttgggcctttagaagtcatgggcccaagcgatcaagttgcgggaagggaaagaagtccatttccagtccctctatagttcaaaatgacaaaactgcaactttaatgagaaaactatcagtttgctgcaacattagcggcatgtttcagtttgctgcaataatagcgtgaaaaat

SEQ ID NO: 61688 - DNA, 871 bp, Oryza sativa
tgaaacctctctctctctctctctctctctctctctcaattcctcgccatgttgccgggtcggaagagaaagctttgaaaagcaggttaagttagtgagggagattaagagtaagcaaattgctaattaggagtggtactgtttcaattaagaattcttttgggtgtctctgtctcaatctaacctttttgtgtgtctctctgactgaaagtttggcagggtgattgaccagaggatgaccttttttttttgttgttgttctgaagatatggagatgtgtgtgtttttcttttaaattattgttcagagttactactgcttcattagcacaatttctttatgactggggtttggttggggttggttggtgaagaagaagaagatgaagatgatgatgtgattcgattctcggagagattggaaggtcaaaatcaccatctcaattcttggagagactttggaacaagagaccaggaggaaaggaatcttgagattggttggatcctcgggtttctgaagagggagcagggaaaaaggcagggaagcagagcaggaacattcagacaaaaaagaaaaagaaaaaagagatcatcttttagtagtacaaaaatcattcagaaaaaagctgttatgatcactgctggattttattcttggattaactagcttgcttgattgcagattttacaggtcaacattcagaaagaaaaaaaagaagcagagcaggaacattcagaaaacaaaaaaaaagatatcatctttactgcagaaaatcactcagagaagctgttatgatcaagtgctggattttgcctttggattaacttgctttgattgattgaagattatgcaggtcaaccatggctagata

SEQ ID NO: 61689 - DNA, 3326 bp, Oryza sativa
cgccaaccaccacccgcggtcctctcgggtggggcccacttgtcagcttcagcgagctatccttcaacccgtggaaatgggccacagatgctggggcactttctgcggcccagaaggaacgagcccatgaacgattggagattacggcccggcccgtggagcgccttcttcttcccagcctggaataagtctatttatctccctcgtgtcttatctttgatcgaaacgcatccctccaccgcaaaaccgggtgacagccaacattatcctctctagatatgtgtcgaatagtaaaagtgtcaagcgatatttaactatatctagacattggtccaaataaccattcaatagttcataaaaacacttaaatagctgttaacttgctcaaccactgaaggtgaatcgccaaaagcatgaatatctctctcaacttcaaaaaaaagtgcaaatctagtctttagtgtcctccaacttcaaaaccggcgtaaacatgatccttcggtgaacaccgatttctgaatatggaagaggcgttatagccagttttgtgattgatggacacggttcgatatatgatggaggcaaaatagacttattcctcgtagcctcatgggtgctcaagttcatggctgatctgagagaaatgttcgtggacctaagaagtagctctatgatccagtgttcatcgatcctccatgtgagattcgcgtgagagttcatcgtctttgcttgctcggataatcaatcaccaatccagcgggcggccggccactggcttgtggtttggttttgggggagagattgagattttgcttactttgagtgagatctagttcttcttgagttcttcctcatcaagaagaggaagcagctcgcatgcccatctcccctctcctcgcccacctcgctccgtcctcggttgctccggcggcatttggtgcccgtccggcgcggcggcgcttcgttggtaaatccgaattcgcgtctccaagctctgctatctttttgtgctttgggttgttcatctcgtgcaaggtaggagttgttagggttaagctagagaaatggtttgctagctaatgatttttacttgtacttatgattcagcatgtttctgaacctttgggttttatgactggagcagagagtgaagagtaatctggactagttttttttaaaactgtgtgcacttgccgtgttgttcgctgcagcctacagcatagtttcagctcaaatgacttgaattatacagtacatagaaagatgaaggaattggaacatttgttaatctgtgttactcataatattgtggagcttctattgaatgcattacagtagaaaaaaaaaggtcaactatgatatttatgttgcaggaaagtgtctgatgtttttatagtttgaaactgctgctagctgaaaggaaaacaggcatgggcaatagaagttttgacttgagttgttctttgagaaaagaggaggaaaatggcacaaatttgtcgccatttgtccgcaaactttttaaagaggtttgtattgttggctcctcagtaacatgaatttaatctagcccatctttgatgatagtgctaaccggagtgaaacatggatgattgttatatagtgggatgaccgcaaggcaaggggtttgtttcaccatgacatcagttcctgcgagacaaaggtgttacattcttctccaaatagatttatgggcactttctggtgaattgattgattctttgtagctgaatcccatataattatgcggcaggtactacctggtgaacacaattttgtggcgacattaatagaaggacgtgaccagaagaagcggcctactcaatttggaatgaaccaagtcctgcagccttttgatagcgtgaaattcaatttcactaaagttagcccagaggaagtgatcttcacattcaaagaatctcagaatgactctgtaaagtacttcgacaatgttcctcatgctgttgcagcttctcctactgccattttgatcaatgttagtgagtgctacacccctctaacagttatgcctaaatcctaatccaatatggtgcacacatgatctgtttttgccattgtttgtttgataggtgagtccaattggctactgccatgtgcttctgatccctcgaatccaggattgcttaccgcaaagggttgataaagagagcttcctacttgccatgtatgttgcaagtgaagcaaaggatccattcttcagagttggttacaacagtctgggtggtttcgcaactatcaatcatctccacttccaggttggtcatgtcataactttttcccgtgtcctaactctaaatttcttatgatgtcctgctgttgacacattaattcgtaggcgtactatctgaaagtgcaatatccagtcgagaaggcactgacggagaagcttacgactctggggaatggtgtcagcattattcagctggttcagtatccagttagtggttttgtatttgaaggaggggcatgcctggaggatttgtccgatgttgtttcaaaagtctgcatcttcttgcaagagaataataaacctttcaatgccctcatctctgaatctggcaagagagtgttcctgctaccacaggtactaccctagaacacttattgcataacttctgaaaataatttcacactctatatcacagtagcaatggataacaaacattttgtctccgtctgattcgatcgatcagtgctacgccgagaagcaggccctcgggagagtgagccaagaattcctcgacatgagaataaacccagcagtctgggagctcagtggccatttggtactgaagaggaggaaggactacgatgaagcatctgaagcaaccatatgcaggtttttggtcgaagcgtctctgtctgaatcagaattccaagaactgaagagctgcatcttggagttcctgtccagtgcagctcctgaagaataaaggaggccaaacagttattcagagagataccgatttgtaaccgtaggtgcaataaaaagttggcccgagtctgttcttcagactgatgtacaattgaaacctctttgataaattttatataacagatgttggtgttagatcatcgggacaattgtcttcagccttgagttattgttgttgaaggtatctcaaggacagtaagtttaattatttatattatgactcgcttctgttcaacgtggcctattagctcagctggttagagcgtcgtgctaataacgcgaaggtcgcaggttcgagacctgcatgggccaccttttgcttttatttttatgattcgatttcatctttatt

SEQ ID NO: 61690 - DNA, 1454 bp, Oryza sativa
  unsure (1)..(1454): unsure at all n locations
aggccgccccngtttgacatcgattgannatcctagctcggtaccccggcgcgaggcagcaacctccgcggcgccgcaggcccaggacctgcaggccctctctccgcctcaccaagtcactgcctccgtctccgatgcatatcacatccgtacgtacagaaattttcaggttcgcaacatttttttagcataccatgaattcatgatacgaatgcaatactatctcatctttaggattgtgagggtattatgccattatactctcacgcaggaactctcctccgtttctgtctatttgattcctctatggccgcattcagttgattgactgataccgccatccgccgctgctcgggtgctctgatcatgtgtactgcactactcctgtctgtctcatatggcaaatgtacattgatgttagcactggccactaatcggtaagatctagattcgtttcaattaatatgttgcttttctagctttgtaatttatatgagtttagccattagtatattaattttctcaatcatcaatttgttcttttatcacaccttctagaaagtttaaatggtttgccattttatacattgagtaaatgatttagatgagattgacattcataccatctttagtaactatgcatttcaaacaaattttaagctgatatatatgaagttttcaatatggatattgattttggaatgaagtatttatatatttggtacatatatattgactattatttagatgtttatatcaggggcccctgtttttaattttgtcccgggccaccaaaacctcaggacgggccctgccctctattaagggaattcgtttcattttttgttccactaaaaatgtttcatcgagtgtacttataatgtttcactatgtatggatcaaatgttgcagtgaactgaaacattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactcagaagaattcgaaatgtgagaggcccaaaaactatggatatgggccttgagaagaattcgacatgtcagatatttgggcctttagcca

SEQ ID NO: 61691 - DNA, 1172 bp, Oryza sativa
gatgttgagcctgccaacggaagtcaaatggttcaaaaaagggcttcaagtgatttaaaagttaccctagaattattttccatcacaatgtttttatccccttcaaaagtaaagtgttccttttaacatgagaaagttttaaggaatttccatcaccctcttgagaccaaccttcaaaaattttaagttaaaataatagtttccaaaggatttggttttggaataaggattaaaaattggaccatataattgcctatatttagatgttatatcaggggcctggtttttattttgtccgggccaccaaacctcaggaacggccttgccttctattaaggaattcgtttcattttttgttccactaaaaatgtttcatcgagtggacttatatggtttcactatgtatggatcaaatgttgcagtgacctgaaccattatttcgctatttgctgaaacattgtttttatataaggtgaaacaacgtctgatttaaacgattgaaacatttccgatttacttagtgaaacaattccgatatatctggtggaacatcgtgcaacatttaaaaataattcaataataagcttaaaaaaattcgttggaatatatccatgtgtggttctgttttgaagatttaattgcaacgaatttaatggtgcaatcggatcatgatttagataaataatttaagagaaaaaatagtttaaagtgtttttgtacacatgtgtggcgctaacgtttttcccccacccacgatcgggcgcccgatttgtagggggatccttttattgttggagttggagggtggttatacttggtttgaaggttacgaattagactttttccttgccggaagcaaagtgcgggccaacactgagaagaattcgaaatgtgagaggcccaaaaactatggatatgggccttgagaagaattcgacatgtcagatatttgggcctttagccaagatgggctttagctttccaatttcggctcggagcttgggattgaagatgaacagagatgggattaggtaagcatgaaaaaaaaatatttattaatgtactgaagatacaagttggatgattcattctgatatatcaatatatcatgcattacagtggtgagatatcagaaccgacaacacaagtttgatgcttcacttttctgcact

SEQ ID NO: 61692 - DNA, 3130 bp, Oryza sativa
agcaattccgataaaattttacctataaattacttcctccgtttcacagtataacatttttttaccattgtccatattcatttagatgttaataaatctagaatatgtatgtgtttatatttattaacatctatatttatttagataatgttagaaagttttacattgtgaacggatggtgtattttttattcctaaaaaactaaaatccgggtaaccaacgaggatatctgtagttctgtactgtacccgactcaaccactgtgcgctccgtccagtccccggctccgtggaccgtgcactagtacaaagcctaggatttccgccagccacgtctccaacatcctctcctctgttcgttccccgccgcgaacggaatccgaatccccaatggccgaccgcgcgccgcctccgcctccgccgcccgccgggatcgactccaggagcggcttctgcgcggcgacgcggatcttccacagcacccgcgccccgggcgacctcccgccggagtcgctcccgatgaccgcggcggcctacgccttctccctcctgtcgtcgtcgacgctccccggccgccccgcgctcgtcgacgccgccactggcattgccatctcctacccgtccttcctcgccgccgtccgctccctcgcgggggggctctggtgctccctcggcctccgccccggggacgtcgcgctggttgtcgcgccctcgaggttggaggtccccgtgctcgacttcgcgctcatgtccatcggcgccgtcgtgtcgccggcgaacccggtgtccacgcccgaggagtacgcgcaccaggtcgcgctgtccaggccggtcgtcgcgttcgcggcgcccgaggtggccgccaagctgcccgagcatgtgaggtgcgtcgttatcgggtcggatgagtacgggaggctggcggcgtccgacggccgccgcgcggcggctccggcggcggtggcggtgaagcaatcggacacggcggcggtgctctactcgtcgggcaccacagggcgggtcaaggccgtcgcgatcacgcaccgcaacctcatcgcgctcatgtcgctgcacgccgacaaccgggagaaggtcgcgagggaggccgccgaggccggcgaggagccgccgccgccggcggtgacgctgctccccatccccctgttccacgtgttcgggttcatgatggtgctccgctccgtctccatgggggagacctccgtgctcatggagcggttcgacttcatcgccgcgctgcgcgccatcgagcgctaccgcgtgacgctgctgcccgcggcgccgcccgtgctcgtcgccatggtcaagtacgaggaggcgcgccgccgcgacctctcctccctgctggtcatcggcatcggcggcgctcccctaggccgcgaggtcgccgagcaattcgcttccgtcttccccaacgtggagcttgttcaggttaagcaaagcatccatccaacaatcccgtgcactctctctgcagcagaataatctactgaatctcatcaaacttacaataatgttccagcagaataatctactgaatctaattaaactaacaatgttctgtacgattgcagggctacggtttaaccgaatcgtctggcgcggtggctgccacagtcgggccagaggaatcgaaggcatacggatcggtcgggaagctggggtcgcatttgcaggctaagattgtagatccctccaccggtgaggccctcggaccagggcagcgcggcgagctttgggtcagaggcccaatcgtcatgaaaggcaagtagtgactatgcattttttgtttacttgtttagataataatacagccaggaaatttcaacattacatccaacaatgacgattcatggcctgaaactttccatacataatattatgttatcgtttgattctttctgaaaggtgcatacagtcaattatttgtctgaaaggtacatacagtcaattatttgtcatatataggtcttgtaagaggtccctcgtatcacgtaaatgttgtggtcaatagttgtttgggtaaagtgtaaatgattagctcgttttgcctgcttgtgctttgtggcacgacaccttcttctttaggctgtgtttagttcacgccaaaattggaagtttggttgaaattggaacgatgtgacggaaaagttggaagtttgtgtgtgtaggaaagttttgatgtgatggaaaagttgaaagttcaaagaaaaagtttggaactaaacaagggcttagttatcggtgtagtttcagaaaatgagagtttgtcagaccaaatagtgatggaccatgtggtagtaatagcatttgcaacagataattggacacttgttcagctacttgacggctagccagcatgccagtaggagtaggtatgctctcaagttgtttatttgtatggaggcatcacttactggtcctacatggattttgatatctgatatattactaaacgtcatccatgctttatcagagagactagaaagttagtgctggtctagacatcaagtttgttttcgactatccaattgaacttctggaattgtagtgttattagtttaaaaagcgcttaaggatatagaaatctgaaataattaaagccaatatttagcttgttgatggatttgaccttttggtagtaggccttcccagtgcagcatatacaaggacatctagcatatctgtgctttgccttaatacttgagccttttcttgattgtatcatttttggggatgctttttcaggttacgtgggtgatgatgaggcgaccgcagcaacggttgactcagaaggctggttgaaaacaggtgacctctgctacttcaatgaagatggttttctatacatcgttgatcgactgaaggagttgataaagtacaagggataccaggtaactgcctgccatagctgcacagctggttcaaaactacattcacgccagccacctgggtaagttgtcacaagtttctgtttgcatgatgttggcctttaaattttttctcaggtacctccagcagaactggagcatattctgcagtcccatcctggaatcgctgatgcggcagttatcccgttagtatcttaagaaaaaaaattgcagatagcttgt

SEQ ID NO: 61693 - DNA, 564 bp, Oryza sativa
  unsure (1)..(564): unsure at all n locations
tttcttgtacaccacttgatcagaggaacgcaaaaaatggtcatgagatttgcacaagttccatgagggaacgaaagaaactttgccgtcgtacatgggcttttagaaccgtgtaaggggggcccaatattttatgggccaaatctcacttctggaccaatgctttctcctttcaggcctagttttcaccgggccgtcacgggcccacgtcgcagtctaccccgccgaaatctttaccgcgcgggaactccaatttccaaccccgcccaattcccctccctttcggccattccccttccccttctcggctcctctcctcttctcctcgcctttccaccaccttcccttcccaacccgatcccccattccgccggcgttcggcggcttcgtcgtatcgaaccggctagcgaccggaaagaagaaaaccctagtcctcaacacaaccatggctccacggaagcggacggggcggncngcnggggcaactttcaagaagccgccggcctcgcaggcgtcgcaaccggccagntccgcattctccactttttgagcgccagtcccagg

SEQ ID NO: 61694 - DNA, 2578 bp, Oryza sativa
tcacttgtaaaagtgatgcaattcctttctagacactgaactggaggcatttgtttgagttttcacgtttgtgaattaggtcaacttgcaattcactaacaaatgttgtgctagtgagtgcaaaaaatggaattcttagtgtcgcctagggggtttgtagtttaaaatgtgttgcaggaaataaacatatcgtgtcatgctatttttgatactggaggtagtaattagtagctgatgttgcctatgctgtccagatgttgatgccggagactgatcttggttacaaggtcactcatttatcacttaataccgacggttcatcgctactacttgctggatcacataacataagtattctgtatgtgcatgagagggtttctgaagatggtgataaggtcatatgcaggtacataagtccactatagctttatcttatgttattagtattgtactggtatttttcccgaccatcttgcaattatttaagctgcaataggttgttgcatatatacatgcagcatattcatagccgtgaacactaagagtaggtttctctgagtactcttatcatcagggtattgaagaacgcaactccaaaattttatttcaccttgctctttagatttatgacctgaatcattatttctcttcctttttttaatatcattactcatatcttctttctttcattgtattgacttgtacatatggaccttacaacaggactgtgccagttgcttctcagatcttacctagcaacaatgatggcatcaaagtactgcaaacatcgtggcacccttttagcagtagtcattttggagtcttgacatcagatgctgttttcaggtttgataaatgagtatcgatgctagatggaggaattccactttatctatgcttccttgctatttattggatttgattggaatggaaatacgtcttttacatccacacttaaattaattgaagacaacacttgcttttaaaaataattattgcatgacccttttatagaagttttgttattatttctgcaggttatttgatctgtcatttgatttagagcaaccagagcaggagttctatttgcaaccaattctacctggcaaatgccagaatgcttcatcaattttccagtggcattctcatatgggagtgatcatctgtgggatagattttcggtatgtttcttgaatattgatcccctaaatattgtagaagtcatctggaaaaaaatatagtaaatgatctacagtgtctttattagctgaaaacaaaaccagaatgatttttcatccgatgggattgttttgtaatttagcaagcaatatcatagcatagttaatattaaaccacaaaataggatattagagtcctacccgaattagccttatagaatctactccctccgtcctacaaaaaaccaacctaggtggtgtcccatccccacctaggttgcctttttttgggacggagggagtacttgtttgcttcacacatgggattaaccttgtagtttctttatttacatctgtagcaagatttagggtgtcacaagtcatattactacataaatgaacttggcagctgattgcatggtttctacgcccaaaccctttttttctggaacatctaataatgtttgtccccactattcatgaaagagttactggaatacttttgatactttatgcatcactttctttcatgtcaccttttcaattggttgtttcgacatatgtaatatttttagtagtttcggcatacttcgtatgtttaatggctcatttatgtgcttaatttcacatgtaagcctgtccttttacaggttttcatcttattcagcgatggttcaatttttgtgctctgccccattgttccatttggaaggtaagtattgcatttatttctgccctcccccacccctcttttctctctattgggaagaaggcttacaacaatttgacagcatgatggtcctaatttgttaaaacaaaaaaaatactgtactaatttgtttatgggaaataaattatggtccctgcagtttcacactttcactttgtagtcttgtatttatgaaatgcgaccttaatgatatgatcatatggtgccctttctttatctgcatattggttttgactttattttttttccctgtgatgcagcgattacaataagaagcatattcaagaaatatatgaagatgttaattcatttggattgaaatcctcaaaccaaaatgttgtcaccaactcacgtttggcaattgcttggttggaagcaacgtttcctgacttgtcacgtcagccagctgataatagtgcattgatgtctagagctcatccatacgcatcattagatgattctctaactttacaggtctgcttctatttgacttggtgaaatattgttcgaaccaaaagctagtggactatgctaatgcaatgaccagagaaatgtgaatttggtgctcatgcagctggtcataatcaatccattgttttttagtatatgagatttattgttttgtaggagttaggagctgattggtttgcgaccagacatttccacaact

SEQ ID NO: 61695 - DNA, 774 bp, Oryza sativa
cttcttatgtgtgaaagatgcatcatggcctgaaatcttctcgcgtgtaaaatcagtacagcagttacctgaaaactgttttgcaaatgcagtggatcactatcttgttcttcttttgaggccctggtgtagcagtaggacgactgcattatgactctatgagtcgatgagcagtttagatcgaagcagatatgtacagtagctgctgtgaggcaaatttttcatgatatgtgacggttcctcttactttgaagtcttactttgaagtcaagatgaatctgtgaagtgagttgaccgtgaacccacttaaacaaaattacttaaacaaaattagtgtacccacttaaacaaaattagtgggcaacctatgaattaatccacgggttacttactaaccaacttgacgacgggaaccggccgtgggttgcctatttatttaatttaatctataaagcttcgcgggtgatccacttgtatacctacatcttttatcaggatcctggtgcaagaaataatacggatttgctgttgtgtgcgtacgcgccaacgggtcaactcagcgcgcgtttcggacgttcgcaggctcattagtaaagcacgtgcaggtgccaactcatacaattagtgtgtgattaacgccatatctaacgtgattaacatgagtacgtagcgctatgatctcatacttttttttttcttttttccagtaattagctctattattaacatgaacattttcaaatttaagttgaaagtttcgaattttaagataag

SEQ ID NO: 61696 - DNA, 2724 bp, Oryza sativa
  unsure (1)..(2724): unsure at all n locations
tttaaaatctcaatgccaataaagaaaagagacagtggacgggccgtagaggagtataatggcaacgtttgacgggacatctagaaattataaaaatgaaacacaacgtgacaataaactctaaaaactataaaatccaatttttaaaggttccaagaagaatgaatagaaatagtggtagatcgagcaagcaaataaagaagaagatgacataaggggtagcaactggtgtgactttaaaaaactatataattagaaacacgaggatgataaggtttagtctttcaaagtcttaagacaatgagatatctattttataaattttaagtaatatcataaaaaatatatgattttgtttgggtgctagccgcgcaattgcgcgggccacccagctagttagttttgaagtcatcaatagtgaacaacaaaaatataccacaaaaattaaggcatgtgcttcacatgtgacatatcgcaacaaaccaattgttaaagttaatgactgcagtaaaacaacaaacatgttttacaaaaatatgttgtttttatttctctgttcaggacaaatttgagttaatcgccgaagcaaaacaataacctgcactgcagcaatagtacaaagcaaatctcactcaaacagagaaccccttttacacaagaaaccctttcttttagcaaacatatcttgtttgcatcatcctttcttttatttttgaaaccaaattatactttcatttagcttaaaattcatagaactaggcaaacaaataagcatggaaaactaatccaaatgattcgtttggcagtatgtagccttacccttctaactgagcatcatagcccatttggacattgacattgctcccgacccttgtagcgcaattacctgcatcgaagaaagaggcaacaagtcagaagaccataatgccacaatccatattggcgcgcgcgcgcagacccacccacccacacacacacacacactcttaagctttgaaaaaaaaggaaatgagctgcaaaagaacctggtatcaaatattccatatcgatttcagcatcgaggtgaaagaaatgaattgaaaaggtgctgggaagagcacaaatcaaagcaccgctttccatatgcgcaacgcagtgcatgcatgtacactgctctgatgaatgattgtagtcagactggttcaattcatcaggatactcatctcccaagagagggttatcgaacaaaccagatatctcagcacaaagctctaattcctgaacatagctctgaattgccagtaccctcctcaccttctccctctgctcagtgacaccacacttctcttgcttcgaaatgctgagctcaagcatcttcaccatggcactgaaactgtgcccgagaacgacgatcttgccgagctgatctggggtccagttcaaggtgagcaaattctcaaagaagacgcgatccgcgtagggcatgaagatcagagttggctgttcgaccacaaggcagagcgcaggcgacgcggtgacaacgcagcccagctcctccatggcccggcgctccaccggggccacggtgggatccaccacctcgacggcgccgaccagctcggggaacttgtcccgcaggaggagcagcaaggcgaggcggaaccgcggcgcccagctgtaccccaagccgccgagcctatacgccacgacacggagccgctcgtggccacgcccacggacgcgctccaggccctcgaggcacgcggcatcggaggagaagagcgcggagagcttcgcgaaaagcggcgatgacatggcaagctccatggcgaaccacaagaaggacatgagccgcgcgtggtcgcccatcacgaactcctccttgatcaggttcaaagaacgcggaccacctgggcacgccgcgcgcgcggcacaaggaaacaaagatcgcgaaaccacccaagtttctccggaaaaaatgacggcttccaaaaaaatcccaaacacgcaacacatcatgcaccttttttaaaaaaaaacgtgtaaatatataccatggtccattgaaacaaaatataggaataaaaatattagcagaaaaatattggagtacagctggaaaatatctttaagatctagcaattccttctccccactgcggcacacccctatcaccccaagtttctcaaaaaaaaaacacatcttgcgtcttggaaaaaacaggtcaacatatactatggttcattaaaatgattgtatgcatcccaacacatcttacaaaatatcaatattagaaaaatcgagatatctatatatctactactgtaaaagtaaaatcatcctccttttatgccatcctccaccacccgcatgccttccacccacatttctccagagaaaccaatggcttctagaaaaaatcgaacacacaacacatcatgcacctctagaaaaatgtgtcaatatatacattggtccccatgcgtctctagaagaagagccaacattaacagacccaaaaaattaagcaatctatattgcgaaataaaggggttgtttgcatgctatacaacaatcatttgtcatacttttgtgccacactttagctaagttatggccaataaaatgtaagccacactttagctagcaaataaagagtgtgccacacatttttgagttaatgacgtgtgagaccatagaaagggtaccgagaacgaatgatcaaaaccaannnnnnncaccatc

SEQ ID NO: 61697 - DNA, 4069 bp, Oryza sativa
ggaggaaggcatcagcatcaggcatgggacgatgggagatcacatcgaccgcgttcgtggtgctttacactacacgtgcgtgcttggtttagcattgagctaagggccggtttagatcctctaaaatgattaaaattttaccgttttagaacattttttagcaaaataaatgtaaaaagtaggcaagttggcatttgtcatttgatagtaatctgaagaaaaaaaaatcaggccccgtgcataagagaggcggcagcaattaatggcaaaactttaccatgcatctaaatactaacttataaaattgcaatgctaaatctttttccatcaaaacttataccaaaaaatttaccgcagcaagttgatctaagcagacaataagccagtttttctgtgtatgatgtgtctggtaggaggtggcacaagcgcacaacacaaacgggcaaagggtgaaagggtttcacctacaaaatgcttttgattgcttcgttttttttcactgtttatcagcgtacagtaacaacaaaggttgaactgtatatttccagtttttttaaagaaaaaacctgtatatttccctttccttattctatgggccgacaaatccctcatatacggcccatcactataagcccagatttatgctacaaggcccatagcgtcacctcgccacgaaacggaataagatcactttgacttcctcaactgaccaccgaatctaaatcgtatccctcaactgcaataccaaaaatcttgacccccccccgaacttgcaaaaccggtgcaatttgactctcttagtggttttggatggcggtttcactgacgtggcgcacacgtggcagtgttgacctgttctttgttccacgtagcattgacgtggcgcttatgtggcattaaaataaaaaaaatatatgcggggcccatttatcattcacacaaaaaaaattgtgggacccactgacatgtgggttccacatgtcatcttctctctcactacccttcttcctcctctctcccttatttctctctctctccccttgacatgagccggcggcaggcgggggctcggtggtggcatcggggagcgggtgccggagtggtggctgcggtgggcggtggacctcgagcgacaagcccgggagcagctcctccttgaaatgggggtggacctcgggcgacgtgcgacggaatgcgtcgggggagatgggagcacgctcccaaccgccgctcctcgtccccactctgtgttgtgggtagtgaggagggcggcggccgcggcgtcgacaacgaggtgggtggtggccgcggtggaaagggagcaatagctcgcgcgccccaacgcacggcggcggactggccttgagcgctccagtgtcgacctggccatgatgcggagcggcgattggagctcctcctcctcctccaacacgggcccccttgtcacaccctgaaaatcaaaatatttaaattgttgtttaattggaatttttagaaataatttaaaagtcttgaaaagaaaatctaattttaattaataaattccaatataaaatggggccagattaaatttcatttaatactttgcttaattctataattcctagatttttctgggatttatttgagctaaggaagtatttttaataaatggaattgcatttaaggaataatttaaattgaaaaaggttttaaaaagtctcttttggctttgggccgaaagtcggcccaaaaccgctctctctctcctcggcccagttcggcccagtccgcagccgtcgcgtgcgcgcgttcggacgctgacaggtgggtcccacctgtcggacccatcgtctaccttcggccgccgccgcccgaaaccctagcgcgccgccgccgccgttcctttccaaatccggccgttcctttccttctccggccgaattgtttgaggggaaacaatctccgggatctcctctaccttttctcctttggaatctttggctaaatcgttttggaagttcgtggaatcgagttcgtttcggatcggtttccctctctccaagccgagctttccttcgccgttgccgccgccttgggccttcgccgccgcctctgagcccctttaaaaggacccccggtgtctcctctacccgttgccaccttcgccttcgcctctcgtcgtcggaaaagccctagcgccgtgtgccctagctttgccgtcgccgccgccgctccagccgtgcgccgccgtcgttttagccgtcgccgtcgctcgggaagaccaccgtcgtgctcgccaagtcgtcgccgtcctcgtccgccccttcgccgtcgccggagatcgtcggagcttcgtcgccatcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcacgccgccgttcgccggcgagcgtgcgccgttcgagccgtctcctccgccgagccgccgccgctgtcggtgacgtcaccgctgacgtcatcggggtcgtccgccgtgagccgccgtggacccgatcgatctcggccgtccgttttggattggttcgatctcggccgtccgttcgtgtgaaccgccgccgtgcgcccggtccaccaaaccctagcccgctgacgcaataaaccctcttttccttttcaaaaataattcattattgcgtcataattcaattttaaccgatataagtgttttaatccgatggaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctactgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcagttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcagtggattgtgttatgcgaggggtattgtcacaactcctttccgagatactgtggtggtattgaggcacatggtgacatgatgtggggttgtgtcttgtgggtacagtggtacacctctgatcagagtaaaactattcgaatagccgtgcccgcggtatgggcgggtctaacaatgtctttcgtgattagtttcacacttctcaccatagtaaatgatgcttaaattggtaataatttgattagctcctggtttggaatggaatattcctggtgtggagatagaactgtgcagccggggtggttgttcagaatggttgggcctatacaacagggtatgttgtatagcgttggattaatattgtttaattacttaactgttttatcgaattctcaaatgtttgctaaatgctgcttttgcaaatgcaaccctactatgccatcctt

SEQ ID NO: 61698 - DNA, 1553 bp, Oryza sativa
  unsure (1)..(1553): unsure at all n locations
cgggaagattttggccggtggaatcatttatttgaacccttaatagggatgggcttcctccccccaaaaaaagatggggttatttattttaacagacctccataaaaaatgatgttagatcggaaaacaaaccagattggtgggggggttttcaggaaaacaatttgggggcccctggtatatagccccgaggcctggcacagttttgcctactcgttagagagacggggnnnngnnnngggtcaggtagaactccaacaaaaaaaaaacctttaataaacccttttggnnnnnacgccctttaaagaaccccttgtaagtaccaccccccagtgggaaaggggacggccccaaaagagcctggcacgtctgtttaaagacggaccaagcattggggcgcctcaaaaagaacattttttggaatagtttttataggggtccactgcgaaaataagtttttcaaaaggaccaatatgtgaaaaatccagggccaagacaggtgccccacttgcgaggtgtgcttcaagcgcgggcataccgcagcagactgttggtatcgcttcgacgaggactacgtcgcagatgaaaagcttgccgctgctgctactaactcatatggtatagatacaaattggtatattgatacaggtgctacagatcatattaccggtgagctagagaaacttaccaccaaggaaaagtacaacggcggcgagcagattcacacggctagcggagcaggtatggatattagtcacattggtcatactattgtgcatacccctagtcgtaacattcatctaaataatgttctttattttcctcaagctaagaaaaatcttatatctgctagtcagttagccgctgataattctgcttttcttgaacttcactcgaaattcttttccataaaggatctggtaacgaaggacattttgcttgaagggaaatgtaggcatggtctctacctgatccctaactcctttggctgatcaaccagcaaacaagcccttggcaccgtcaagctatccttgtccaggtggcatagccgtctaggacatccgtctcttcctattgttaagaaagttattagcaaaaataatctcccatgcttagttgagtcagtcgatcagtctgtgtgtaatgcttgccaagaagcaaagagtcatcagttaccttatgttagatctactagtgtgtctcaatttccccttgaacttgttttttctgatgtttggggccctgccccagagtctgttgggagaaataaatattatgtgagttttattgatgattttagtgctaaaatataagtctcaagtctttgagaagtttaaagaatttcaggttctagttgaacgaatgtttgatagaaagattattgccatgcagactgattgggggggagaatatcaaaaacttaattcctttttttgcaaaaataggaattgatcatcatgtgtcatgtcctcacactcgtcaactgaatgggtcagctgagagaaaacactggcatattgttgaagtgggtctctctcttttatcttatgcat

SEQ ID NO: 61699 - DNA, 3386 bp, Oryza sativa
cgatcgctcttgggtgtggtttggtttcacacgcagttcaggtccagtgacaggagatgtgatctgaaaattactcttggttttagcctagcgatttttccactagcatccaaccagtcgattagtactagtacaagttcttacatcagcttcttctggagactgacacttcttatctgaagttctgaacaattacaggcacattctcttcagacattttccttcaaaaactctcttcaaacaagaaaatccgtttcaaaaaacagtaaccacggaagaaacaagtgtccaatctagccacgacagttgagtcatttgacaaaggataaaacgacccgttcaaactttcaagcttgtccaaattcattatcagaaattatatttcttttcctgaaactatggaacaaagcattgcaaggtggctagctatcaacttcatctgcctatctcttgtagggtttgactgtgcaagcattccctaactaatttaaccgtcaatagcttgctgcatcggcagagtcgcagttcccgatactactagcgctgttcctctgcatccaccggccattgccggtttggtttggtcagtcttttgaccggccggccgcgaatctcttcagtcttcagtttcactgttcttctggccagggctgcagaggtaaccgtacagtttaggtgtgtttttttaaaccgtaattaggagtgttaattaatgttataggacggttactgacagtacacgcgaggagattaacttaagatataaaggacttgaccgttggcagttttggcatttgatcctgtgagcggcagagaccggatatactagctgatggttttctagcgggttgaagcagattaactagattattatagtatattatcaacatgattataaatataacaaattaaatagtttgatagctcagaacaaggaatctatgcaatgcagtaagtttttttagaaaatttatttttagaggcacagaataaataattcgcgacaatcaaccggtgaaatatcttaaaaagaattcagcttgtgttctctatgaactgcttgtgtgtgtttcttgtacaatggagttgactgaaaattacttggaaaatcttgacagacttgtactaactgggcggccacttggtcagagctgaagttggatatcacaaacacattttgcattccacaatgtgacaatggtttactgctgtactcgatctcaaaatttaagatcaagttagagtcatagtccagaatgttccttgtgaaatttggtgacatgttttagttcagctaattattgttttgctcggagatgtgaatgaaataaattaaataatcagtggcatgactcgcatgacactgtactaaaaccataatgcaagaggattttcacatgacaaagcctgcaagttgtacggtttgtgagaaactccccagagtataacctgtgatttagtcatgttcattctgatccaagtagagcttgctagcaagaacaatgtttttctttaatacatccatgctaatcttaatcgtagattctttctacctagtggactagtatgtgccacaagtgtcatgttacaacctgcaacctctagaaaccaaaagagatgctagatggcattgcagattttatggttttcttactgtctagtttatgttcatgatgaaggtacaacaacttgtacttgtcgaacagtactcatcgtgtttgttaattgtggtttaagtgacaggagatgctctcattaattagtgccgattatactggagctttcaagtatgtcacgtgtataccagggcaaattgcgagtattatacaggtgaaaaaacacactcgaaaagcttcagtccatgacatgcctgagaagcttaattagactaacagaaacagccacttgtcatcaaccaagtgtgcatcgtgttaatcacttaattagctgttgtttaaggacaacatatgcttttaatttcacctcgagtcaccttaattagaagaagcatatcaagtcaaggatagcttaattagtgatgagcaacagaacaagagaaagaccaaaatttcaatgggaaaaaaagggaacaaagaagttcagagaatctgccgctactgagcaaatgatttgctaccggtttgatctttcagaaaaaagaagtatttgctaccggtttggttctttgtcgtgatcgcaagtaatcttaccaaccaaataatcagctcatgaaccacaaaaaaaaaacctatatcacatttgcaacctaccataattcagaagagacaatgctctgaacctctttgccatgaagaataccatacgtttcgcctctctttaaccaccacgttgaatgaaaatccatgtgttaattaggcgacaagacgaacggtatcaccgatcggtgagatggaaaggacgatgccgtagatccccaaatctgaaagaaccctgccaaaaactaatcaagtcaatgctgctgctgctcctgccattgccaaccgccagaagaaaaatgattagagcagcaatcacacaggctagctggttaagcagagctgaactgatgcagaaaatggagtagtttataatgcattagccggtacagcattattgttaagtgcgtgatcacatgttagaaggctcaacagccatgttctgatgtgaaacctatcctctgctccatcagccattgacatgctggattcctggccgtccaaaactgcaaaggatctgaaaatgtgaactgctgtagatctgtttcagaagcagagaaaattgtcaaatgccaactagccattgatttgaagcaataatgattggcaatggagtttaacagatttgtttgactgaatattttcaggtgaaggcagtatatgttttagatccaatttcttaggatctgaaaatctccaacccatgcttaacagactttttcagttatccgaaacagaaaaggcgaacagaatcgcctcattgactgaatcacgtaacactatctactttccataactcctaaaaatcatggtctacttaagctgatgaagataaagaaaaaaggttcactgcttaaccatttaaagccgaatgttgaccgtctcaattagcaaagatatttgttttctgccactagcttgttcaatcatctcatatttgcaaaattaattagtcatagtgctctaataaacatattgttttttttgccacttaacttgttcaatcatctcatatattccaaattaattagtcatacagctctaataaacataactgtagccctatgattatatataaaagaaaaatgaatttgcagggctattgctctgaagatctgcattaagccagactctggccagcattttccccaagatggcattagcaatcag

SEQ ID NO: 61700 - DNA, 14772 bp, Oryza sativa
acgagattctgtttaaggggggtaggtttgtcacatcccaaaaatcctaaatatataaattgatgtttaattggaatttttagaaattattttaaaagcctacaagctaaaccctaattttctaggaaaattttcaccataaaaatgagctagataaaattttattaaatactatgcttgctcctttattttctagaattttctgggaattatttgagcaagggaagtatttttaataattgaaacaacattttataaattgttttattcaaaaaaggttcaaaatctcccccttcttggtctttgggccgattccggcccatctcctctcttctctctcttccccgcgcgcggcccaagccggcccaagccgcccgcgcccgcgccctctctcccggaggctgacaggtggggcccacctgtcagggtcgtccccgacctccagccggccgccgccgccgagccgaaccctagccgccgcttcccgctccaaatccggccaaatccgattcgatctcttccaattgattgaggggttttgttcctctcggtctcctcttccttttcccccaagaatcaaagcaaatggttgaggtttggatgagatttgaattcgttttcgagtttatctccaaaaacgagtccgagttcttcccgattcaattcctcccgtttgtgattcgatctcttcaatccgagctcatataaatgttccctgtgatctcctctttcgtttgccctctctcccgagtcctcccgtgcctcctagcgccgccgcgacgcgtcgcaagtccgccgccgtcgcaggccatcttcggcaacgccgccgtgccgtctccgccgtcgccgccgcctgccgtcgtcgccaaaaggtgcgccgtgaggagaagaagcttggccgcccctccgttttcgccgtcgaccaccggaggttgctcgacgccgtcgacccgagccgccgccgccttcttcttcgtcgccggccgccgtcgtgcatcgtctcgtgtcggggtgggtaccaatgagttcgtctcgtcgcccgctacgcgttggtgccctccaatctcgccgccgatgtctctagcgccgacgagctcgcgtgcccgagccggccgccgtcgctgacgtcatgctgacgtcaaccctagggctgacgtcatcagggcagggctgacgtcatctctctctctttttccttttttcccgattttctaatagattaaaactttgaaaaatcataactaaataaccgtagatccgttttaggtggttcaagtttctaaatttttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacaaccctttgagcatgttgatcctgtttaaagctattattttatttcaactatgcattgttttcgaatgtcatcgggtggtgaacctttcccagttaattagtggccgaagatgactttattttcctatgggttataatttgattagcatgaaccttatatattggattggttcagctaaatgctataaataggtttgcttagccatgcttagaaacattagttaactaaaagggttaatggtaaattatactttatcattttatgttattaattatagttatatttaatggtagctcacgatggacaatcgtgtgatgataattaattgataactaaaacctgaccaaggtgggttgtgagcatatggttttgatggttgtgctcatgacaattaaggaccggttcgcgagctactgttgtgaaacatttatcgtgccaaccacaagccagcgtgggcaacggctttatctgttgtatagcataattcattatagtgcgccagactgagaagtggcgagaagtccatgggggtcgctggggagtccatgccttgttttaaagggggtgattatgatccaggaaaggtgcactgtggtgagttgtgttatgcgaggggtattgtcacaattcctttccgagataccgtggtggtattgaggcacatggtaacatgatgtggggttgtgtcttgtgggtacagtggtacacctctgatcagagtttaatctattcgaatagccgtacccgcggttatgggtgagttgagcaatgttttttcgtgattagtctcacactactcattaatggttttaatgtggtaattactttagttcctggtttggaatggttaattcctggtttggagggttcacttgttcaaccggggttggttgttcagatgtggttgggcctatgcaacacgggtgtgttgtatggtgtttatttaatattgattaattatacaactgttttactattctctgaaatatttattaaatgctgttttctgcaaatgagctatattttgccatcctttgctatcttgtgcacttgcatatttgctgtgtggcttgttgagtatgttatatgctcattcttgcaatattcattcatcagaggaggagtacttcagtgaaggtgacgatctggaggattaggcttgttctggtcaagttgcctgtggagtggagttgccatagttgttccgtcgtttgttttagttttatctttccgctgcgtagaatgtttttttttgagagggactatttacctctgtaataatttataatttgcgagtattcaatagttaattatttgtactctattatcaatgttgtcattgtgtgcctcggttgattcctggacgagggtttaacacacatgtaagcgtttggaattttggatagaaattccgggcgtgacagaatcatcataggccttgggttaaggcaggttcgtgtgggttcacggccttgattaataacattgtatagttctaggatcgcgtttacaaaatagctttgagcaactaaacgtctttaaatgctgtttactgcaacgctaacccttattataaattcccttgtactcccttgcatttattctgcatttgtgggtgtgtcttgttgagtacggtggttgtactcagtcttgctcaatttttcccaagtccagaagaggagctccttggagatgaaggctttggtgttagctcgtgcctgccgtcaagcgcctgtggtcgtcgccctagtcttccgttgtttcccatttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacaaccgacgccgtgacctggaattcgcagtggatgactttgtgtatcttcgggtcacgcccttgcgaggtgtacacagatttcagacaaaggggaagctcgcacctcggtatgtgggtcctttccgtatcattgctcggcgcggagaagtcgcttaccagttggagttgcccgcctccttgggcaacgtgcatgatgtgttccatgtgtcgcaactcaagaaatgtcttcgagtgccatccgagcaggccgactcagagcaaattgaagttcgcgaagacttgacttacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatccatcctcgaaattgtgcaaagaataattaaaattcaatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagtggaaaaggtttataaaaaaagaaaatcctaaaagaagttctttttcccccccctcttccctcttgggccggctcggcccacttctccctccctctctctctctcctcccccgcggcccatcggcctcctcccagcgtgcgcgccgctgacgggcgggcccgcccgccaccctcgctgacgggtggggcccacccgtcatccccttcctcgcgccgctcccgccgcctcgcccgtgccctagcgccgccgccaccgcgaatcccgccgctcccgtccgccctgcgcgcaataaagagggggaaatcactccccgtgatcccctccctctttccccccttttttccctctctctctccctcggattcgttcggaaaatcctcccctaacctcgccggcgccatcaatggcggccggatcttccgcgccgctttccttccttccccggccgccctctctcgccccgaccctatttaaacgctccccgtgcctccctcctccgtttccgccgctcaccgctcactctctccgtcagaatcgagctcgcgccgtcgctctctctctccgccgtcgccgccgagctccggtccgccgccgtcgtcgccccggacctcctcccgcttcggcgtcgcttccttcggcttcgccgcgtcctcgccgacctcgtccacccctccgtcgacccgagccgcgccccgtcgacccgagccgcgccgccgcattcccccgcttcggtcgccgttcccgtcgtcgccgtcgaccggggtgagccgtggaccgcccacttcgtttcccccttccctcccctctctcggccgccgctccgccgtgcctatggccgccgccggcgaccataggggtgcgggcgcgccgcctcccgtcggctgtgccggcgaggccgccttcgggcgcgccccgcggctgccatgtggcgcccggccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccgattttaaattaaaatttaaatggagaaattcgcaaatatccatctaaagagcatataaacttcaaatggccataacttggccatttgaactcggaattggaccgttcaagtctctaatttttccttaagaagccaagaaccaatttttgtgctttgtttctgcttgttatatggagtttattagagttaaagccttttcttttccgttggtatcttcggggatgaaaagagaaagataattgtcacgaccggaaataacccaacgggcgttccttacgtgcgtgcattaatccttgtcccaggaggcaaggtacaccaacagttgatacaaatcagagtttaacaagcggaagcgtaaatatatttattacacgggcagcgaaggcccagcacacaaagacaaacgggaaacaacggaagactagggcgacgaccacaggcgcttgacggcaggcacgagctagacaccaaagccttcatctccaaggagctcctcttctggacttgggaaaaattgagcaagactgagtacaaccaccgtactcaacaagacacacccacaaatgcagaataaatgcaagggagtacaagggaatttataataagggttagcgttgcagtaaacagcatttaaagacgtttagttgctcaaagctattttgtaaacacgatcctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcacccctagcccagcccaaaaccattttaggggttttgaaaggaaggagcggtgtgaaaccaattccacaatagtccaccattccaaagtatccaggtgatatgaatatttcccaaagtctatagttgtaaaaccacctaatgttacctaattaaattgcgaagcatctacctaaaattaaactagtggtgtcatgagtggagtgtccactagttggggttttgtttgtctagggtgaacaaggtaataataataacaataacaataatgatacggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgctttcccaaacgtcggcttcaacttccacgaagagcggatcctccgaagctgcagcgtctacacgaccaacggaaaagaaaaggctattactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaatcggattattgcgtcagccgagggagggagcgcgcggaccgggtccacgggagtggggcccacgcgtcagcctctcggtccttggtggaccgggagcacgcggctggaggcggccggcgccgtgggtcccgcgcgtcagccgcacccgcgggcgcgggcggctgacggccgggcccacctggcagccgcggggcgcgcccgaaggcggcctcgccggcacggccgacgggagcggcgcgcccgcgccccgatggtcaccgccggcgaccaccggcgcggcggagcggcgcccgagagagcggagaggagagggaagcgaaagggcggtcctcggctcaccccgggactacaacgacgacggaaacggtggccgaagcggaggaaggcggcggcgcggttcgggacggcgaggacgacggcgttccggcggtcggcgggcgaagcggaggagcggacggggtcggcgacgacgcggcgaagccgatggaggtgacgctgagacgggaggaggtccggggcgacgacggcggcgaaacggagctcggcggcgacggcggagagaaggtgcgacggcgcgggctcgattccgacggggaggagaggcggcgagcggtggaaacggaggggcggagctcggggagggattaaatagcgccgagagggggagagcgcggccggagagggaggaaacggccgcggagatctcggccgccattgatgacgccggcgaggattgcgggcgcgatttcgaaggaatccgagggagagagagagggaaaagacgggggaaacgggagagggaatcacggggagtgatttccccctctttattgcgcgcggagagggcgggatgcggcggattcggcggcggcggcggcgctagggcacgggcggcggcgggcgtggcgcgaggagggagatgacaggtgggtcccacccgtcagcgagagtggcgggcgggcccgcctgtcagcggcgcgcgcgcgcggggcaggccgatgggccgagggggggggaagagagagagagggagagactgggccgagccggcccaagaaggaaaaggggggggaaagaacttcttttagggtttttttctttttacaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaggtggtatgtggcacgtggctacacgtgaggaagatgtgtcttgtgggtaaagatgtacacctctgatcagagtacaacctattcgaatggccgcgccctcggttatgggcaagccgagcaatgtacccaagttagtgttttaattcttaaaacctgcttaacaactaaaatgttgaatggttggcctgggttggcttgggacgagctgggacccagggtcgggttgccagttcggtctaaatcatcgtcggccttgggttaaggcaggttcgtgtgggttcacggccttgattaataatattgtgtagctctaggaccatatttgcaaaatagctttgagcaactaagtgtcttttaatgctgtttactgcacaccctaaccctttatattgtgactcccttgtactcccttgcattttattctgcacttgtgggtgtgtcttgttgagtacggtggttgtactcagtcttgcttaatttttcccaaacccagaagaggagcctctggaagatgaaggctttggtgtctagctcgtgcctgccgtcaagcgcctgtggtcgtcgccctagtcttccgctgtttcccgtttgtctttgtgtgtgctgggccttcgctgctgtcacatcctgattttcgtttcaggatttataaattatttaataaattattaatataatttatatgaaatgttcattaatttactagtgaagttaaaatgtgggaaataaaatttcctaaatataaagcatggaaggatttaatttttattaaattcttcatggttaattatactctctggaattttctcagatttttcggagctcaattcctaatttttaatcatacaaagaacatttcagtaataatccacatattaaattaatcattaaatggtctgattataattttgttaagtactttgagtgtccaagtattttcaagatttttcttggaattatttgagcattggaagtatttttaacaattcaaagatcatttccgtgattaatttaattggaaaagtatttaaaaatcccttctccttttcgggccgaaataggaaaagttcagcttcagtcctcggcccattctcccttcctttcggctggccttatccctcctccaaagtctgctttgtgtccctctttcaatcgggccaagaagtgaaagcccagccaaaagtctattttgcctccctgctacagtgtcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccacctcgtcgccctctttcgtttgcccccttccccgtggtctcccgtgcatcgtagctcgccgtcgacgccgcttagtccgccgccgccgccggccgggttgcagccgcgccgcccctgccgtcgccgccgcttgccgccgccgccaagaggtgcgccgaggagtgaggaagcccggccgcccgtccttcttcgccgccggtcgccgtagctcgccgccgacggtcaacccgaaccgccgcccgttccccgtcgttgccggccgtcgtcggacgtcgtttgtcgttgtggtgagtaccgttgggttcgtctcgtcgtcctctacgtgtacatgccctccaaatccgcagccggccactctatctccggcgaggtcgtcatcgtggttcggccgccatggatgatgtcagcatgacgtcatcatcttctccttttccagttttttctaatagattaaaacttcagaaaatcataactaaatcatcgtaactcggttttgagtggttcaagttgctaaattcatctaaaatcatgatctacatgtttgtttactttatatgtattgtttatttggtttttattagtctttttcttcgttttgcgtgttagcttgtcgtttccgtcgttgcgaagtttcgtgagtgcgccggaagtattcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaacctattcctttgttatggccaatttgcattgaatgccctattccttgataccttgggtaataaattgattggcttgaaccttatgtattggtttggttcagctaaatgttatatatataattgcttagcaatgcttagaaacattagctcactaatgggatgaatcatatatactacattattatttatggttatatttaatggtcgctcacgatggttaatcgtgtgatgttaattaaatgataattaaaacctggttaaggtgggttgtgagcatatggttttgatggttgtgctcatggcaattaaggaccggtttgcgagctactgttgtgaaacatttaccgtaccaaccacaagccagcatgggcaacggctttattctttgtatagcgtgattcattatagtgcgccagactatgaagtggcgagaagtccatgggggtcgctggggagtccatgccttgtttataagggggtgattatgatccagtaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttaagcaatgtttttcgtgattagtctcacacctctcacaataattatggatgttatttggtaataatttgtttagctcctggtttggagttagatctgtacagccgggtatggttgttcaggatggttgggcctgtacagcatgggtgtgctgttcggtgttgattaaaattgatgattaattactctactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgtttctttttcttttcttttgtaagtatgtaacgttattattatgatggatttgtatattaaattgtcagtttgtgtacctcggctgattcctggacgaggattttatgcacaaattagttcggaaattactagtgaatttccgggcgtgacagctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagccccccttgaccctaggacgagccgtagatcccaagccttagcaatattttcaaaataaaaatcctttgttatttgtgaaaatcctctagtctctctctgtcctgctgcttcatttatcgccaaaatctgacctttaaaatgttgcatttctttttgtttttgtttgtagatggccggcagcatcaaccgtcatggtctggacctgactggcttcgttttggagctgcggggcatgtgcgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgtggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagttgcatcagctcaagatcgcccagggagaggtctgtcgccccaagcgccgccgtgtctgccgcagccagaagatcaccgcccgcaagagtacatccaggcccgagcttgttcgccagtccttggcatggacctgcttcgtggagacccctcgtgccgagcccgcgcccgtggttcctcaggagggggaagcctccggcgttggtagcacggaggatgcgctgctgctcaccttccgtcctggccagtcgcagcggtagacgagcagttagtaggcttgcgcgtgtgttctttcttgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtagtcgtgggtggctagctttaattgtcagctctctctgtttgctggttctgtgtggggttttcagatggtgacgaccaggagaagtgctgctaccggtgaaggcagccaacccgaaggcagcaaccacaacaaccagggcagcccacatccacctcctccgcctccaccaccaccaccagacaccaacgccattctcacccaaatcctcgcccagcaagccaacatgatggctgctttcctccaccacatccaaaatccgccacaacataatgctccaccaccacccccacaacactctaaactcgctgagttcctccgcatccgtccaccaaccttctctagctccaataaccctgtggatgcgttggattggttgcatgccgtggggaaaaagttagacaccgtgcagtgcagcgatgaggagaaagtcgtcttcgccgcccaccagctgcaggggcccgcatctctatggttggaccatttccaggctacgcagctagaggggcagcctattacttgggcccgcttcaccgccgctttccggaggacccatgtgcccgccggagtcatggcccttaagaaaagggaattccgaaagttgaagcaaggcaaccgctccgtgatggagtatttgcatgagttcaacaacctggcccggtacgccccggaggatgtacgggaagatgaggaaaagcaggagaagttcttggctggaatggatcctgagctgtccgtccgtctagtctccggtgactatccggatttccaacatctggtggacaagagcatccgcttggaagccaagcacaaggaactggagtcgcacaagcgtcgcttggcgaatttccgcaatcaacagggagctaaccaaaggatccgctacaccaatccctatccaggaggatcgtcctcgcagcagcaacagcagcagcaacctcgctccgcgccccgacctcaattcgtggtgcgtgtcccacagccgctgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataatggaaaagaaataaacaaagttgaaatggttttataaaaagaaaaatcctaaaaagtcttctttccccccctttccttcttgggc

SEQ ID NO: 61701 - DNA, 1105 bp, Oryza sativa
  unsure (1)..(1105): unsure at all n locations
tggggctcnnattgatttcaatgcggtgctccttaccccaaagagaaggggagagatactcgagaaatgagtactccaccttatatctctttttttaggatgattggtggcccacatatcagcattactcagaaaataaaaatgcaacaaattcaactgggaattgtgtcgatgtcaaaatttggagtgattctctaattggttcgcttaaggaaaggagtcgattgatggattgaagttaatcgagagatcaaatttatgtaggaatcgtaaatattacgacatgacaaattaattttatctattaattagacaagatttagaaactttcctttttatctttggtaagtttcatctagtgtccgatgacttgtatatttccttttacttttacttttaggaaacttgtgtcgtgtttcgatcacgacttatatcaatctataagggtataaatatatacacttaggatctatagaaaatatttctatatatcaatacaattatttttggcacaccatcatcttttgttccagcgagttcttagttttgagttgggatgtatcggttttgatctccggcgaggatgttccgtcaacttcgcttgtattggcgtggttaagtccgatattctattcaggttgacgcaaaacgttgcctatttgatatattagttctatctttaactgtattgctgtttagagtcgtatcggcttagatatgacttttttaattagattcgatattctgactaagttgatatttctctaatcgtattgttgttttagataaacatattgtattttttataatattgtataataatgagataatttattgaaccttatttataaaatcttacgtccgtcattaccgcgaaaactagaggcatgacaagaaaatgttttcaatactgtaatagcctcctgaaaagaagtactccactacactactaaagaacagttaactaaatctcgagggagatcaaatcaaactagtcaggatgtgttcatcgccatacccaagactctttgctggtgttctttttttctgaaaataaatatgaagatgaagattaagtttttttaaagtaaaacgagatggtatt

SEQ ID NO: 61702 - DNA, 2461 bp, Oryza sativa
agaagtggcgcaagctctccgtcgcgccgaaagacgcggccgccaccgccggcaatggcggcggcggcgagagcaaggcgaagaagttcctgaagaggacgctgtcgttcacgacggcggcgcgtcgccgggggggacgccgccgccgagggggcacctggcggtgtgcgtggggccgacggcgcagcggttcgtgatcccgacggactacctgaagcaccgggcgttcgcggcgctgctccgggaggcggaggaggagttcgggttccagcaggagggcgtgctccgcatcccctgcgagtgcccgccttcgaggccatcctcaaggccgtcgagaagaacaagaaggacaacgccgccgccttctgctactgcagctacgagtacgccgccgacgaggtcgccctcggcgcccccaacaacccattgtgcagatgaagaggaacgtagtagctgctggtttttagcatggctgttgttcatccatccaaaagaaatggattttttttctttttcttttcttttcttatcgatttgtgtttttaagtgttgtggatggtgagggatgatttgatagtatctcccccctaagcttagaattactgcgtaatattttttttcttattttgttgagttgagctgatgatctgaattgggtaatgcagccctcatggatgaaattaatggaaaatatttatggttgatatggaaatggagtatcttcgttttgatttgttgaagtgccagagagaatttctacctctgccggtgattttttgatctgttcaaatggagaatgccccatcagtaagaatttctacctctgcctttcagtgcttttgctgttattgttcctctatagtgatagtggtagtaccgtagtacatctcaccgccattgtttatgtcaatcttgactatatagtgctcgtgcacgtctctgtaccatccttttatttttggagagaggctgtactgtctaatggaatcaatgcttacttttggatcatttgttatagtttgttcaaacgctgaaatttcattgtatcagtttctgaaaaaaatatcagagtagtacctttgttttgccaagcactgttcaacacctaagtgcaaagaaacatacaatcagcaaacaattgtaggctactgtagtaccttcaggctatagcactgtgcttgtggccttgtgagtgtactcgatgaactccataccacaaattgcatgagatttcagctgctcccagattctgactctgactcatagccattgtcctgcactccactctgaattttaaggattttccttctgaaggaaaaggttggccgcgcaatatcttcagacttcaggttctgatgccctctggattcctcttttatgttgtggttttcattagacaatgtgagcatgcattagtgacagtttttatctagtaggaatactcatgtgatcctatttatccattacgtaatgcagctatgagagatgatctgttctctgatgtctgatttgtctcattgtctgatcgccttcttcctttcttgggagactgaacaaaaagcaaaactttttctttctgcaaggaacaaaaaggaaaaacttgagtcgcttttatgaacagaaaggagcaaccaactgattccaaattggcatcagttttggctttgttcctttgttgctcttgcccaacttggtttggtccaagaaatgtggggagagacctctttaaaagatgccaagtgatgcccatattactccaagaaaagcagatgcaatggatgcatcgatctgatcactcaccgaccttatatcttcatctttctctgaccttttctctaatccagcaatttactagcatatctcgatcaaatgttgcctcgcactccaatgaataccaagcataggttgaaactctgactaggaacacaagattgttcaacccaatgaggcattttaaacttagatgctgatcccctgaagtccaccacgattaccaaagtgacaatgtgatgaacaattcaagctgctttgtcaagaacatgacctcagctcgtgtacacgctggtctcgatcctatgcattgcttcttgatgcaatgcatggcttgtgctagtcaagatcaagattgtgacaggcagaacaaaaacccctgaccactcactcagcacatcaccacgttccacgtccagtttcggagagggttgtactcctccgttcctaaatataagcatttataggttgtttaataaagatgaggaataatggaaaatatttcctttgagttacctcattgattaaaattcaaattttgaattttgaattgtttgaattcccctcctaagcatccgattggctgaaaatggttggattctcgtgctttgaaatcggtgtcctagaaatgcttatggctatgtttagttcatttcaaaattggaacgatgtgacagaaaagttgaaagtt

SEQ ID NO: 61703 - DNA, 1262 bp, Oryza sativa
  unsure (1)..(1262): unsure at all n locations
atttataaagcacgtgagggtatttacagattttccaccagaggtgcaataaattccgatttgaggatttccaaacccgtgtgaggtaccttgtaagaggggttcgagacattaagagaataattggcttttccacagggaataatgcccttccgaagttttttgtgagaggaatgccctgagagaaggtttacaaactccgcggcccttagagaaaaacaacaccggatataattggtggaagaataaatcaatattacccgggtggaaaaaggttttgaatccatggtgataatatgtaaagggttaacaccttgtcctcgggccggtatttttgttaaaaagtggtaaaaacaagctctacccggggcttaaaatgttcaagtacaaagtattaaggagatagacanaatttgaaaataagaacctatccctacaaccttattcattggataagttattacgggtgtgaccagttgcgccataatggaaggcatgcgcaatgcccaatgcgacccccacgacacggacactgtccaatgcttgtcgcggtggtagcacaccgactgttgagccacgcccgccgaaatggcgccgtcatcctcgatctctccttcatctgtcgcctctccgggaccgcccgacgacagccatcggtggcgtcgccgccggcgcatcggccttcggccctcggcgcgttgcagttcatgacggcggtggaggagatcgcgcgtaggcgggcgacgccggtgctggcgccagcgtggggccgcgacgcaatcccgtgcctgccgtccgccgccgtggacccgctccccgccccgacggagctccgcctccagtacctcaccgtggacatctcgccgccgctgccgccttgctcccctgctcccgcgtcgtctccgccgccacgtcgccggccgccggacctcctctcccacctcgcaccgtcgatctcctccccacctgtcggccggcggcgccgggctacccagagtcaccagagagaagagcgagagagagaaggggaagggagagaagagaggaaagaaatagaggctgactggacaagctgacatgtggggcgcacgtgggtcccacgctgactcattagacacgtaggataaaaccgggatcgaaaccgccaagggacctattgtgaccagttttatatagttaagggatcctatatatctggttttgcggttcgaggacggttttgtatcccgttgacaagttgagggaccttcggtgtacttttt

SEQ ID NO: 61704 - DNA, 856 bp, Oryza sativa
  unsure (1)..(856): unsure at all n locations
atgagacnntnnnnattganatccgatctcggtaccctattatatgaaacttaataaactgcgtcaaagctgtggtcttcttttctgttgttgcacatcgcaagtttaagcctgaaatatgttatttttccatgttgcccatttctcaataatggaagctttattaaaactcagtcaaatacaacaagatgatacattctaattgagcccactcccgacctctgcaagaaatgcacacagccacaaaacatgacctatctagacccccattgccttcttcatgctcttaatttctgtaacatactgttcacctgtctggctatctgggatttttcaaggtgtacacctacggtcattttgatggaaggtgaaggggaattacctcaactgaacagaggatgctggttatacagaactactaacatcgtaagaacattctatgattctgatgcagacatacagtacagttttaatctaatcaaggaggacgccatatgtgggacaccgcagcgaagtgtaaggagtcctagaacatctaccttaggagttaagagaatctatgagattgtatgtataaacatcaggtttctgcaaatactcttatctaaattcctaatgcctgtattgcaaatactataatcgtagaaaaatagttaatgtagacccaaatatgcactatatgatgcatatcacttcaatttcccatcgaacgagcccctattctacggtggtgtggggattaaagaggattagaggggattgagagagaataattccacatcacaataggtgtggaataaatcccctccaatccctatctcgtanggattaactgaaccaggccttaccggggaga

SEQ ID NO: 61705 - DNA, 9811 bp, Oryza sativa
gcccgccccatcggctgatgcaataaatggaatttttaattaaaatttaaatgaagaaattcgcaaatatccatttaaagagcatataaacttcaaatggccatatcttggccatttgaactcggaattggaccgttcaagtctctattttttccttaagaagtcaagaacccatttttgtgctttgtttctgctgttatgtggagttatttagtgtttaagccttttcttttccgttggtcgtgtagacgctgcagcttcggaagatccgctcttcgtcgaagtcgaagccgacgtttgggaagacgagcaaggcaagacacatcatcttgatcatattggatcccagtttataaaattatgttgatttaaattattgcattatcgctttgtttaaattcccgcgttatcactgttttatttagccatgcctatttacctttgttatgaccatatcattattgttattgttattattattaccttgttcaccctagacaaacaaaacctcaactagtgggcactctactcatagtaccactagtataactttaggtagatgcttcgcaatttaattaggtaacattaggtggttttacaactatagacttgggaaatattcatatcacctggatactctggaatggtttggttattgtggaattggcttcacaccgctccctctattcaaaagtccccaaaatggttttgggctgggctaggggtgcatggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggtctgaatcatcataggccttgggttaaggcaggttcgtgtgggttcacggccttgattaataaaattgtatagttctagaatcgtgtttataaaatggctttgagcaactaaatgtctttaaatgctgtttactgcaaccctaaccctctatattataatccctttgtactcccttgcatttattctgcacttgcgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcctgtttgtctttgtgtgctgggccttcgctgcccgtgtgtcgcgtcccaaatcgactctaaaattcatcctcaaaattgtgcaaaagaataattaaaaatttattgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttgaaaaggttttataaaaagaaaaatcctaaaagaagttcttttcccccccccctttccttcttgggccggctcggcccaattccctccccctctctctctcctctccccgcggcccatcggcctcccccgcgcgcgcgcgccgctgacaggcgggcccgcccgccactctcgctgacgggtgggacccacctgtcatctccctcctcgcgccgcgcccgccgcccgtgccctagcgccgccgccgccgccgaatccgccgcatcccgccgtccccgcgcgcattaaagagggggaaatcactccccgtgattccctctcccgtttcccccgctttcccctctctctctccctcggattcgtccaaaatcgcgcccgcaatcctcgccggcgtcatcaatggcggccgagatctccgcgcccgtttcctccctctccggccgcgctctccccctcccgacgctatataatcgtcccccgagctccgctcttccgtttccgccgctcgccgctcgctctcgccgtcggattcgtgctcgcgccgtgcacctctctctccgccgtcgccgtcgacctccggttcgccgccgacgtcgctccgggcttcctcccgactcggcgtcacctccatcggcttcgccgcgttgtcgccgaccccgtccgccccttcgcttcgcccgccgaccgccggagctccgtcgtcctcgccgtcccgaaccgcgccgccgccttcctccgcttcggccgccgtttccgtcgtcgttgtagtcccggggtgagccgaggaccgccctttcgcttccctctcctctccgctctctcgggcgccgctccgccgcgccggtggtcgccggcggtgaccatcggggcgcgggcgcgccgctcccgtcggccgtgccggcgaggccgccttcgggcgggccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccagtccgcgcgtcctctctcccggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagatgtaaagaacccattttttgtgctttgtttctgctgttatgtggagttatttagtgttaaagcctttttcttttccgttggtcgtgtagacgctgcagcttcggaagatccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagacaaacaaaatctcaactagtggacactctattcatggttccactagtatgaatttaggtagatgcttcgctgattaattaggcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacatgctccagggcaaatgaaggctacacgagctgcggcccggtagtcgagatgtcataaagcacagggttggtgccctgctgcgaggggctcagttccgtctgcctgtcccgggggttccggccgtaggcggaattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatatggaatggttggcctgggttggcttgggacgagctggaacccagggtcgggttgccagttcggtccgaatcatcgtaggccttgggttaaggcaggttcgtgtgggttcacggccttgattaataatattgtgtagttctaagatcgtgtttacaaaatagctttgggcaactaaaagtctttaaatgctgtttactgcaactctaaccccttatgttataattcccttgtactcccttgcatttattctgcattcgtgggtgtgtcttgttgagtacggtggttgtactcagtcttgcttaattttcccaagcccagatggggagttccttgaagatgaaggctttggtgtctagctcgtgcctgccgtcaagcgcctgtggtcgtcgccctagtcttccgctgtttttcgttgtctctgagtgtgctgggccttcgtcgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaccgtgtaataaatctatttacgcttccgcttgttaaactctgaattgtatcaacttttggtgtaccttgcctcctgggacaaggattaatgcacgcacgtaaggaatgcccgttgggttatttccggtcgtgacacctattaaagagagatcccgcactgccttcgagttcgatggtaagaatgaccccaaccgtgaagatccagagtctcttgagttcaagattatgaaggagaggatgtacaaaatcttctcaaacggtattgtggttagctattcacaactactgccagtggtgccatataacgctttcaaccctcctccaccggtatgtatcaaatatttcggccttccttatgacatcattttgtcttttgtaatgttggtcaaaaacttcaataataatgcataggaattttctttgatgaaatctgatcctccaagcgctcaacgccgctcgccccgccgacaagctggtcaggccagtggcgggccaaaaatccagtctgctgctcagccaagcatctcaaagccaactaaccaatcgggctcttggaaaaggaaattagttctgagtgacgacaaaggtgacaatgttgggaaagctggcagctgtcacatcctgatttttgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagagcttttccttgtttaaaaaatccttaaattataaattgttgtttaaaaggaataattagaaatgatcttaaaagcttaaaagagaagatctaattttaatttgctaaatctcaatattaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctctctctttctctctccctccccggcccagtcggcccaacccgccgtcgcttccttctctctctcggtgccgctgacaggtggggcccacctgtcggacccgtcgacaacctcgcgccgtcgcccggccgaaccctagccgagtcgcgcccgagccaccgccgctgcccttccaaattccgtcgcccctctctatttccggtcaaattgattgagggcaaatgatccttgagatctcctcttctttttctcttttggaaacatcggctaattttctttggaaaccggtggatttgagttggattcggattcatctctctcctctaaccctaacctttccttcgcgtcgctggtcgccgtgggccttcgccgccgcctccttgcccctttaaaaggacccccgagctctcctctatctgccgccacctttgccttagcccgccgtcgcgtctagcgccgcctccgcgtagccctagccgtcgccgttgttgccgtcggttcagccgcgccgcgccgccgttgcagcagccgtcgtcggtcgccgtcgccaccatcgggttcgcgaggtcgtcgccgtccccgtccaccgcttcgccgccgccgaagaccgccggagcaccgccgtcgtcgtcgacccgaagaccgtcgccgtttcttcctcgtcgccggcgccgtccgttgcttttccgccgttgttttggtcaccggtgagttcgccgcgtcgccctctacccgttggtgccctccgttcgcgtcgtcgagccgttgttcgccggcgagcatgcgttgccgagccgccgccggtgctgacgtcatcgctgacgtcgtcgctgacgtcatcgtcgctgtccccgtagacccgtcgtgaaccgatcgatctcggccgtccgttttggatggatcgatctcggccgttcatttccgtgagccgtcgccgtgcacccggttcaccgcaaaccctagccgctgacgcaataaacctcttttccttttcaaaaataattcattattgcgtcataattcaattaaaatccatataagtattttaatccgatttaatctttaaaaattcataactaattcattgtaactcagtttaatgtggttcaagttacaaaaattatataaaataaatatctacatattaaaattatccataaattgaattaaatttatttaattctttttaaatgggctttaattagatttaatcttgtaaaattcataataaattcatatgaaatcggaatgaggccgttcaagtctctaaattcatctaaaatcatgatctacatgtttgtttactttatatgtactgtttatttagtttttattagtctttttccttgttttggcgtgttagcttgtcgtttccgtcgttgcgaaggttcgtgagtgcgtcggaagtaatcaagaagattaattgaagaccgattattgcaaggcaagtcacacagatcttaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataatttgactagttgagctttatatatattagttcaactagatgttagatataattgcttagccatgcttagaaacattagctcactaatgggatgaatcatatgtactacattattatttatggttatatttaatggtagctcacgatggttaatcgtgttatgataattaattggtaattaaaatatgattaatggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcagagcaccagactgagaagtggcggagataagcccacgggggtcgctggggagtccatgccttgttttataagggggtgattatgatccaggaatggtgcactgtggtgagttgtgttgtgcggagggtattgtcacagcctctattcgggtactttccagtatcgcgacgcatggtagacatgatgttgaggctgtgtcttgtgggtacagtggtacacctctggccacagtaaaactattcgaatagccgtgcccgcggttatgggcgggttgagcaatatttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttctgattaattactctactgttttactactcttaactctttgctaaatgctgcttttgcaaatgagcctatattatgccatcatttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtgaagccggagcttcgctagattttatttttccgctgcagttttcttcttggtgaggactaagtgcctcttaagtaagtatttatcggtttagttaatatgatggatttgtatattaaattgtcagtttgtgtacctcggctgattcctggacgaggattttatgcacaaataagttcgggaattgctagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgctgatgtggtcaacttatggaggtcagtcaagtggatcgaggaagaaacgaagtgcccagatgtcaagatggaatgaagtttggatcctaccttagaacctatgccgccaaagtgtctttgaagaatagttagtagggtagaacgctgttgattgctttgtgtgtaggtatggttgcattcccgtcattggagtagtccagtgatgagcgtgtacctatactaggttgcttgcttaatcaacttgaacaatataatggtctacacacatcagatcagtgttaaactggttaaggtcttgtctttagtgtaacccctctcctcctatcttttctaatctgcaacagatggtgaacactcgcgccagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccgcctaccttctctagcactaccaacccagtagaagcaggtgattggctgcacactattgagaagaagttggaactgctccagtgcacggatcaggagaaagttgttttcacttcacatcagttgcaaggacctgcatcggaatggtgggatcatttccggatgaacagagcagaaggacaaccaatcacttgggcggagttcactgaagccttcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagtttttggaaggcttaaaggatgagctgacagttatgttgatctctcatgactatgaggattttcaggagctggttgataaagcaattcgactggaagacaagaagaacaggatggacaatcgtaagagaggaaggattgttttcaggaggcacatgatagtagccagaggcagcgtatcaagccact

SEQ ID NO: 61706 - DNA, 1160 bp, Oryza sativa
  unsure (1)..(1160): unsure at all n locations
cccaatatgtggtaacccaaccttttttgggtgggaatcccccaaaaatagggggggagcgggtggtttcaacaacccgcaaaaaagccctcaatttccctggcacaaataaaagaggttaaggccaattttgggggaaaaaggtgaaataattccacacaatttttttaaggctgaattgcccaattaggccggggataccagcccttaaaagctaaactttaaaaaagagaggaaattggctgggaatttggaggttgccccctgaacaccttcattttttgggggcccggcatttaattctcaaaacacattgccgcaggcattttatgggaatccttttacngctggacttgtttgtctgctctgcaacatccggattgctcaagatccaatcttcactcttcccgacttgctttcagtgtttgctcaaggaaaagtttcaggtgatagggtggccaaatacctccaggaagaagaattgaaatatgatgcagttattgaaatacccaggaatgacacagaatatgatattgagattgatcatggaatattcagctgggaactcgagacaacatctccaactctgaaagacgtagaactaaaagtaaaaagagggatgaaagtagcaatctgtggaatggtcggatctggaaaatcaagtctattatcatccatacttggggagatgccaaagctagctgggactgtgagggtcagtgggagcaaagcatatgttcctcaaagcgcctggatcctgtctgggaacatcaggacaaacattctgttggaaaatccatatgacaaagaaaagtatgacaagataatacaagcttgtgcgctgactaaagatcttgagttgtttgcaaatggtgatttgacggagattggtgaaagaggaattaacatgagtggtggacagaaacaccgaattcagatagcaaggtcagtatatgaagatgcagacatatacctttttgatgatcctttcagtgcagtggatgctcatactggaagccaacttttcaaggtttgttctgtttgtttaaaactttcaataaatgctcaagtatccaggttatgttttaactccattcttcgtggcattaactccattcttcgtggcataacgttaataaaaaaaagggcaaaacctattt

SEQ ID NO: 61707 - DNA, 5207 bp, Oryza sativa
ccccaaatttagtggtcatcttcttcttcttccgccctctcaccttttcaatccaatctaacaaccaacgaaacgaaggagtctttctctagctctagggttagggtttgcggtcggaacggaagttagtcgaatcggcgcaaatcgatccgatccgatccgccgtcgattcgaccactccgccctccttccttccttccgacgcagacgcaatccataatactactactctagatcggatcccctcctctccctccctccctccctgcatacgaacaacaagagactactccattactatattagattgattgattaggggaggggattgctgattaatttcatctctctaaccctagcagcagatccctctctcccctagcaactagcaagcagagagaagcagccgcctccatggatcctaatcagatgatgggccgaagcttccccatgtgggccgccgccgacgacccttccgcccagccaccgccgttcctccctccgcccaaccgcggctggaagcgtaagaaccctagcaccgccgccggtggctaccagccccccgccctcggcgacctccaggtgcagaaccgcgccaaggctcgccgctggttcaagaaccaaagcggaggcggaggcggaggcggtgggccccgcaagcacttcttcccccggcccaaggccgccgccccacgcaacaccacctccttcatcatccgtgccaagcgcgccggtggcatcgcctccctcgtctccccctcccctgttacccccgccgttctccccaccccacgcctctccccctcccgcgagggcctctccgacatggctcaggcgcagtggggcgtcgatggctatggctccatgaagggcctcatccgcctccgcacctcccctcaccccgccaacccctccgatgacgacgatgatgccaactccagcggcagtgacgtcgaggagcatgtcgaggtggagcgccgcctcgaccacgatctcagcaggtttgagatggtctaccctgccaggggtgacggtgtcttcttcgaggaggaggatgactatgagtatgaccaggaagcccatgtggctcgcctcgaggaggagaacctcaccttgaaggagaggctctttttgatggagcaggagcttggcgacatgaggcgccgcctggaggcactcgagtcgcgttttgcagggactgatggtatgcctattgagaattcagatgcagttgcagttgaccatgacaaggagatggctcatcccatacttgttcagagggatgatcttaggactgagattgctgctgatgcagcagggtcagacaaggctagtgcacaagacaatgcagaggaggttgctgatgcagcagtgtcagagaagatcgtgcaagacaatgcagatgttgtagttgcagggtcagagaggactggcgaagagatcggggttgatgcttcggagatggattgatgggagatggacactggaatgcaatagcggttatcagtactgtacatacataattgtcgatgacagattgaggccgcgtgatgtggacttgttttgggaggcttacaattgtatgttgtcgcataacaagtggatcatcgtatttacaatgtaatatgtttctaccattctgtgctatctttggtgtttctttgcgtatttgttatgatgataccacacagcacaacttgtagtagttcttaccttctgctgctgctgctgaaagaggtagaagcgactagatgaatttgttactacatcaactattaatgtcattataatggtatcagatggtgtcatgaacctgttacttaattatagatagcactcatgaagctattccttatttgcagatagcatagcactctcatcctggtcacttgtagttatggattctggtcggggttaaactatcttttttgtcaatgggggtggtcagttatgcttgttgggatgatggtttttttgatggtatcatgtgagcactcagcactgtatctgtatgttgttttgtcgtggtgaaattgttgttagtatgttgctgctggctccatggatagagagatcattatgtattaatccaatttattggtatttggctgtgtgctttcttctttgggctcagtggatcggtaaaatggcatttggctgtgtgctttcttcagtcggtaaagcgaaaactagtcgtaaggacatttcaggcgggagggagggaccatccgatccgattcgaaactgaactgacagacagtcccctccattagatggagggagaatattgttgggcctttgggcttcgtgtgacaggcccattagattagacctagatctgtctcgtgacgagggagaagactagaggagggaggaagatggcgatggatgagccgcccaagggttggaatcccaactatggcgtcgtcggcagcggcgaccggcgactggccttctcccgccagctctcctcctccatgcctcgcctcgcccgctccgactcttccatctccatgccccccccgtccctcgcccccaccggagccatcaccttccgctggctcgccacccgccccatgcgccgcctcgccctcctcatcgctctcaacgtcgcctactccgccaccgagctcgccatcggcctcctcactgcccgcgtaggtcggtaatactaatactactgctactgctactgctactcattactcatctcaatcacactcttctccattcgtttcaggcctagtctccgatgctttccatctcacctttggttgtggaatcctcactttctccttgtttgccatggctgccttcagaaccaaacctgatcacctctacacctacgggtgcctccctccctcaatttactcctcttttctttaatcttccactcccactgattcattgctgcctttatcaagctataaaggattggaggtccttgctgcctttacaaatgccgtaagcttttcaacatgtcattgccatgcccatccttatacatttctctaggactaaatagaagttaatggtgttttcccccatgcatataaacgggggcatagaaatcggaattttaatatgcggcatatctctcccattacactacctatgtaaaagaccccccaatcgtaccaaatatacaatttgtcatagcttgataaatgtttggaaccctcaagcaccagatgaatgcctatttgacattcaaataactcgtgtaaagtttctaattagaaaaattgagtccccaatatacgttataaggtccttggtcacctggtaatgaatgtcagtatatgcctattccccaagtgacttgttgacattgctgtccagtatggacatcttgaaaaacgccaatccattgggagagaaagcaaaaagaataatggccagaaagtattggccatctctatcactataataaaaaaacattatattctttctagaatgatgcatttaacataattaattactaatattttctggggaacacacaaattaaactgaagagcaataatcatatagcaccaaacctgtcagatcagttgtatataatctataccacaagatttcaacattatcttgctagtgacatttttaattttgatgctaaatctacacaaataaacataataaattgactttaaggaaaccaacctacaataaagctgacccatagaagccacacaaatgctatgtaaaaagagattctgaatatttcttgtatttttttctctcaagatagtgctctatacctgcgctaaaaggttttttcctttctgaacatttatgaacatttatagtttcagcaacatcgtcttggataggaaaatgtcttgcacgtgtatatacagggcttcataattcaggataaaaagagcgtgggatgtaaatatttgagaatagattctcactatttatcatgggttatattttaattcagatggcagagttctcagctgctaacatgagcaacattattattccctcacaataatatatatctccagaagcttctaaaacttgggaaagatatattggtttgcataaatgaccaatgagaaatgaaaatgctttgcagagctcctgccaagaaaaaaaattgtgccatcagcaaattaagaaacaagagctttatttgatgaaaagcaaatacatccagcgccaatagtccatcaaaggcaaaatctgtagcaccatttactaatgctgaaaattttacatctacacaaattgtggttccatgttatttccaatattcagatggtgcttaaacatatatgcgtattgagctgcagttagcaacaaaattgaaaattaatgcagtagttatgggtaaggtaattgacatggaggattatatgacactccaaggaaaattgacaaagtatgttgtaggaagaagttttgtacaatgagcagattgcgtatctcaggaagcttggtaatcagcacaattcaagggagctcaatggtgtacctgacctgaaaactcaatcatgcgtcaaattggtaggaaaacaatgtaggtccaatctgaataaaacttacaatataaattgatccatttatgtacatctatgtactttcaaagggcaagtcacaaaggcaacacgatacatccaaaaccctattacagcctacataacatttcagcaacagacatgtaatcacaacatttaatgggctggaaaaaaatgctaatgaccttgaagcaaagagcaacatggaattgaatctcagcacatctccttttataaaatataagtaaaatgaagcaccacagattcaaagagaagctcactccacctatagacaaagagagagagagaggacatgatctttgtacatccaagccagagagatatattcatgtatggattaatggacattgctgctgattttaattatacatgcggtaagtttgtagctatatataagttcacaatgtgtacacaaactcaggaagacaatgtgctaggcatattatctttccaaggatcaaaacaaattcgatagagaacatcagtattgatagaccacacaactgagctctgtatatcagataccttcagatgcttgttggctgcttgaatgccaatttacagaatatgcaagcataaaaaaatcagaacagattgttccccatgcaaactaagaaaatacataagccggaaagaagcagtttgacatttaat

SEQ ID NO: 61708 - DNA, 6228 bp, Oryza sativa
tcaaacccctttgacacacctacgatgatgttgtcagtcagggtcctgcattgaatatttgcagcagagtccttagaggaataggcatagagaaaggcacatcaagatcataaattcataatttcttatcggcatatcacacctttcatcactcgatcccataaaaaatgtactgagtacgccttaaccaagctgggtattctcccaattcagattatatgttgctaaacattcttatctactggaatttcttttcaaccctcaaggtttattcaattatgtttgatgcataccggttaagtgtatagcttacttttctaagatccagaacaaagcaagatcatcaccaatattgattacacgaacacgaggtcagagaacagcaaacattaaaggaaaaagctgcatattgcaatgtagagttcacatccttgaaggagctactgggagtatagggccgcggttatctatcccgatgtcaaaacatgttgagatgcaaacatgcaacttatttaaggcactggtaatatgacaatcaaaatacacatggcccatgtgaattctatgctcatggtgctctccactgcaagaagcaatggctcatatatgatgctttgtgacaaacgctgacagatcttaagtagctgacttctgaaataccaggaaaaatatatagaacacaaacaaaaagatacaccaggaaaatatatggaacacaaacagtaagatacaccaggaaaatgtatggaacacaaacaataaaatagtacagtacattatgaacagtgaaccagaggaaaatgaaagcaaaattgtcttacctgaaaaggccatgcatctggtttgcccttttggtctccacagtcttggaaactctcagcttaccagattcttctttcaccacttttacttcacctggatagtttagtgataattctcctaatggacccttagccttaataaactgctcctctaacgtgagggtcacatttgatggcacttcgatcggcttctttcctattctagattctttgcactccactgttgttctgacaaaaccaactctgccagcagggataacacgaagacgaatcccttgtgtctttccagcaaagccagtccttgaattgctgatttaattccgacaaataaacactcaatcaaaactttcatattaaattgcaaataaataattgccctttacaacaaaaaccaatgcattattttagtttgacagattagtaaaacattataattcaaatccatgaagtagttactagctagaaagataggattcaaagaccaaatgagaaacctacaatttctcctgcctgaacttgtatcaacatagctctttgtttggtgttcagtttatgagtgatagcataatgccataatgaactaattaatttaaaaagttttttggcaagttaaatctttcagttaatagcacttcggagctgattttctgaaacaaatctagaccctcggtattggcccgttaacatggccatgatgtttttgaagaataatgctagcaagtaaaatttcatggttaatcattaccacaccactgatgttaagttataaggtttcagatattgaaagggtatttgcatacttttccaggttctcaactagtgatcaaagcaagaaaaaaaaaggggtattatatccaaagtgctgccgcattgcactaactgattggaaaattttccgaaccctcaaccaaacacatccaaaactgcaatccttcagctacaaaatgaccaagcccctgacctgtctgtgactcgtgtatcactgcaaattgcaggcgcggggagactcaacttactgcactcaatcgaaactctcctaggaattaaatacggcctattggcatactcctaaagccaattgcatccaaatcattgaattaaggatgatgggcaccatctccaaatcccccatttcttggcggagcaacaagaaagcaactaatgccggttcttggcagcgcaaaaaaaaaaaactgaagcagcatcgacggggtggaggaggcaggatgaggaggaggaggaggaggagggggagttaccaagggaggtggagggaaggggagagggacgccatggacgcgctcgtagacgcagccgcaggaggaggaggaggagacgctgcctccggtcactcgcagtgtatctccctgctgcgcggcgtttgctccccgcattatccacaacgatggaagggaggaaggtggcgaagaagccgtcacggactcatgggcttcaggcccgatacaacacgggcttggtggcccatgggccacacgataaaactacagttaatttgaaaaaaaaaaaagttctaaaaactgggtgaatagctcactgtcaagtgtgactcgagagatactataccatatatatgtagtcatttatttatttatttttaccaattccactgtaggagaggtctccagttaaaaatgttattaagagaagaaataattatagggtttcaagccaagaagttataatagtttgtttttacttttgaatatatgtttttaaaaataataacaatataagccatgcttttaagtacacgtaatgataaaataaatcataacaaaataaacaataatcacgtgatagcagtccaaaattcaatggagtcaataggtattgcatcatacgcatggtgtgtagtgacagtaatgtcaggcatgttcgtgatggtttaatgcgacacacatcccgaatttctatgaatttacatacatgaattttctaaaagagcattttaaacctaattttttcagcttttatcataatagaatacttcattactataatttgcgtcgattggattaatccccgtagaaaaatcttataaagttattatttatatgttctaaagcattgcgttttctttataacaggctattataattacgagaaacttgtatgtacgaccaaacagtcataatttattcaaatttacaacaacagtgttgtgtcaacaggggagtacacgctaccatctcgcacatgttccattcccatccattgcgcttaataatgtttcaactaatcgagccacccatcacctgcaagttgctactacactacagctgttttcttgaccactcttgaataataatcagaggccattattcctaaaccacgattaatatcactgtcaaatactactcctcgccgtcgtcatcgttaactccgattcacaaaaatacatagctcacccaactctccctccccttcctctcgccggagtcgccgcggccctagccatcgaccggcggcggcggcggcggcggtagccgtgggatggacgaattcggcggcggatccgtcgggccgttctccaagaagccgaggcacctgtcccggtcgctgacgtaccaccaccaccaccacccctaccagggccaggggcgctcgccgtcgttcaacgcgcggcgccagcatcatccgcagcagcaggaccacgcggtggtgctgtacacgacgtcgctccgcggggtgcgccgcacgttcgcggactgcgccgcggtgcgcgccgtgctgcgcgggctccgggtggcggtggacgagcgggacgtgtccatggacgcctcgctgcggcgggagctccagtcgctgctcgcggcgcggggccgccccttctccctcccgcagctcctcgtcggggcccgcctcgtggggggagccgacgaggtgcggcagctgcacgaggccggcgagctgcgccgcctcctcgagggcgccgccgggcaggacccggccttcgtctgcggcggctgcgggggcgtccggttcgtgccatgccccgcctgcgacggatcccgcaaggtgtttgtccaggaggaaggatgcgcccgccgctgcggcgactgcaacgagaacggattggtacgctgccccaattgctgctcttgatcgcttagctttgtgcaacaataaatcttccatgttaatataaggattatagcttataggtaatagtagtagatagaggcaagaagggatgaacacttcttgatttcttggcctatggattgtatgtgattatgaccaatttgggtgcttagtgttcggcgtttggggattatagtgtatggatttgagcctatatgggtttgtatgtatcaaatgtaacaaatattctgcagtgcgtagtcctgctggtttgatcaatgtaaatagttgggtttggtatattcagaatacagttcatgtctcctactagtttgtcttttaacttcaaggatgatagatagatagctgcttcaaagcaatataatgcgagctgatttaacacatttttagctcctagttaatattaaaacattttttttggcaagaagtgatatgcgattcaatagcttcattctaactaagccgttgtataatcatatggtagtgttatccccttttccccttcttctaagatggtagcattgttgtttgcaaatgcgcagttcacggaacattgtatcttcagcaataccagttcagttcctccagttgtttgatggaaacttcatgtagtggcattcagccagttttgacaatgctaatcctttgaccatgcaacatctgtctccactcgacaagctttgtgcgaaggcatagatgaggtatcattcaagataactagaacagtagagattgtacatgtgtctatccgatttctagtgtgtacaaaacctaataggatttaaacctaacgaaattagtgtacaatgaaccatacttattgtttctctcatcaaatatgatgtacatgattcacgactgtaattagcaggctattgcaacgctgacatatgaatcacgatgatgcatgtgagcccaaattggcgtcacttgtgtgattttagcgtttgttttggtttgttgctaaaacaaactctaccaaagccaatccaaatattgcccaaaacagcctctattaacaaaatttggttattctagaaacttcctcttgcaaaaatggggcaaagaaaaaaaaatcaaaaacacttattgagttaacaataccaaattttggtagagttgatctgggcatcaaagcaaactactcccttaacccttacttccatgagcaaattttgtgaaatccttcagataaggtgccacgtccacgacacagtagtacgacgggtgcagaggtgcagacaattgaagggaaggcagtaacgtacgggcacaacattattgctcctatagcgtacaaacagtactactccggacatgatgcagatcaaattattgattctagcgcttcaactcttgttttttctttaagaaaaaaaatcagcacttcattttatcttctactaatatttactctgggtgctcaaccccgatttaatcttgcacaccaagttgaaactttattcggaaaaagcttacaaaatcattctggtattcaccctccaattcaaaagcagcatttaagataaaaggaaatggtacatgctacatgacatttcaccatgatttgttacagcatatccgattcttaagaactttcagatcatgccttaacatagctagaaatatgctgaaagaatgaacaaacaagctagagatatgctgaaagaatgaacaaagaagctagaaatatgctggaaacatgaaaaagagttcaacacattcatctcatgaattgccattagatttccctataccacagaatggcaactcaacaagcagttcaaggcaaagagaagtttgccaggaattctacaatagtgccactctggtctacatgactgtcatctagtcatccacaggcaccaatctaacagaagatggtagctaaaacaagctaataacattacaagtcttcattttagagtcactgcctatgaatggctataattctcgcactgtgatgatacataggttcatgcaagggttaagaacgatgaacagatcatttcacattttattttcactgttccttccaaattctcccagtgacccgcaatttgagctccttcctttctccaccagagaagaacaaggccatgttccgttggatgataagcccatcatagctatcccggaccttccgatggctgtctctgatgctccggggaaccccttgcccgatcattttgcggccagtgcctcctacctccaggctgtagctgtagttctttgcttccaagtcatcacccatgaacctcaggaaggcgatgtacacagg

SEQ ID NO: 61709 - DNA, 1219 bp, Oryza sativa
  unsure (1)..(1219): unsure at all n locations
atacttattaattatttttgttaaaactacttgctaattaattggagcagaaacagattctctgtgatgaaatagatcttcatagctcagatatgatgaactgaagacagtactcgtttgtcagacagtgatttagttggaactgcacttgtactcgttttctgttccattttagtttcaggagttggcagacggtgcatgacaaagaaagatgtcgtaatgatgccaaactatcacctaaaccacattaagagaaaccataattttgactcccaagtaatctggcacacatgatctttcatttctgaaaaatacattatacatgggagggaagtcagcattaacaagctaaaagcccttgtataggtaaaatataattgggtacagaagatggtgtatagatacaagattacaagaggcaatccaccttgttttttttaccattaattaatcatccgccgtcagtaatatgatgttgagaggtgtgaaacttctaactaaatgacattacaggcaaatttcttatctctataatataatttcatccaaagaaaatatgagaatgcggctggatggatggatgacccaatcacggtcaaatgaaacgctcaaccgctcgcaactaattaatacagacagaggaaaaagaacatgcaagtgaacaaacagaagaagaaatnngaccggacagattaacaattcaagatccaccgtcattctctggncagctctncccaaatctcatttaacaactncaaagatgcatttgccgttttgaaaaattaaaacttcttctgtctncncanaaaaagggagaagaagaagaagaagaggaanaccgaaggggatangcnnngccagtgtgttctctttcattacgttcttgacaagtgcattacaaccaggtcttaagttaattcctgtgaaaatgcaaccttataatcgnccaatagattggctcagtgcacgcccaatgaatgtgtcttgccccaggaaacaaagggattaaaaaggttttagtcttggcaaaatctgaataattgatcaataaaataagctttagtagaaaacaagcttggtaatcaatcacggccaatcttaacctaggttatnatttggtgcgctgcacaggccctttaagtgaagccttggaggacggtacttatttgccgtggaatttggatggggtttaccaccaaacgagcgtgaaattatcaag

SEQ ID NO: 61710 - DNA, 14650 bp, Oryza sativa
gggctcgatgtaaattacaatttataaagaaagaagtatgtgaaatgaagccgatttaaaagtgtggataccatgtacaatcaaagatacacacctgggcagaaacagctaaagcatctgcaagcaaagataccgcaagccatacttgtaagcatatctgatgagctgccatagctgttgggccttgtcgagcagccattgatgtccctatggtcatcgttaataaaatcgagagggttcttcctaacagcatgccacctaagcatttcaaaaacagatgatggaattatagatggtggtaagtgcaataaaaggaaaaacaagataagaagtatgaaattataacatggaggttctcaggatgcatatcatagacatgcattatctttccaataatatgacagcaaatatttgcaaatcctagaattgagcacattttactacatataaatggtaccacgaaacaatatggagaatagaagttccctgaacagcccattcattagtggacagaatgggcatggcccatgaatgaaagctctatcaatgacaagctgatcaacatatctgtaaaatatactagcagtaaccgtacctacaccatctactctacgatagtctttcctttttcttgcatataaagttatttcaaaaaccaaactttacaattaacttgttatcgataaaggtatcattgttaaatgcatagtggatccagaattggaaattttgacaaattaacccaaagaactcaaagccccctgggagagaaaatctgaacttcagttaaccgcacattgtagaatgaacaaaatgaacagacactgagatcaatgaaagtgtaagaactctgatttagcatgcacaacaattgaatataatgagagagggggagatagaagaacgaaaaagacaccagattttagatatccgctaaactctaactggtccagccttggaggaagtagaacagctcttttacttagagactggagaagcaaaattgtaataatgtacctatgtcatggacggaataaagttagaactccacttgtaagttgtaactagcaaaaatgcttgatatgtaacatatgaataaataaactgcataaacatcagatgatgtgctaacagccacaaactgttatggcaagaccagaatcacatatggtaatttaaatgtgtgtgctgaattgctgataaatgaaaaacaaaaggaaagctaaagtttattttctgctgcatttcattattttagaaacatgtctataagtaaaaacagttggtatttggaaccaaactgagttatttgctgctatattcatataaaatattccctttttttacctttgttgttttacttggattccatggggctaggtatcaatatagaacttactgtgatgcaactgtagaaattgcagctccagttatgccaagccgaaagacgtaaataagtaaaggaagaagcactacagctgaaagatttcccaaacctacatgttttaaaagaacatggtacagacatcatatagtgtaatatgagagatatttgatatcagagaagagtctggaatcaaatgaaactggacgtaaagtatgccctttattgtggaaaatggaaaaaaaagatattggaaacattattgtgattccacaaaatatttgctaggactgctaaaaggaatataactaatgcaaaccaatgtaatcatgtggttgatgaagagtagttcttggaagttacctataaaaaatacaggagtcttagtatccttgaatccacgaaatattccctgaactgctaacataatcacatttgcaggtgctcccaaagctctcaatgaaaggaaaagttttgcaggtttatgcattggtgaggcctgcaaaagcactaagttgagatatcctgacaattccaacaattgaaaactaattgttgaatcaaattagtgacccattgtccaaaagtgcacataaaaacgacagtattccctacaaaacaaagatcgcagacaagaataggcatcgtaatccaaaacatacaggtgacacgcccattagtttaagaaacaatcctgatcctaggaacaatgccaatgcttcaattgtaccgattccagcagctaagaccaatgcagaagatacagatgacagctccaatttgcctgcaacataaccacaagtcaggttttattgcttgaatgttgaagcaagtgcacaaaaaaaatttataaatatgtgagaaatggaatatttatttaatatatgctgctgctacctgaacttgaatgcttgctagcattcttggaaatgtcttctgccacaaatgaggttgcaatgctcaacagtggaatgttgaaaatcttagacacgatattaaaaaccgacacaccaataccagctgatgctagctccagagccccttcagaatatatgaaaaagaaggatgaatggcaaaagaagggacagcttgctttcatgcagtaaggatggctataattcagcactcccaagagctactttatgaagggcaagcgccataatacctagaacatcatttttggtgctgtttgaattagttacataatataaaagaaacaaacagcatgaattatagagtattagtgtagacaatgatggtgcaggtatctacctatttgccgattgataaaccattaagaaaagaacacttaaaaatataggatatagcaggtccagtaggtacctacctaatctaccaatatatgcagtctccatcaattgcgccaatggatcaatagcttggccaagaactgctggtagagctagaagaattagctcatttctgacacccccgggacgcaagtcactggttgtttattcgttggatggttatgaaagggtaaaatatgtcatgcacctccgaaatgtaaagattatagtaaatgtagacagcaaatgcaaagggcgcaagcatgtgggtaggcaagtaaataaaagtaggaaactggaaattacatgggaggctccgttggcgttgcattagcaaaagagatggcgccatcatcttcagcaacagcatggggagcattggtggcaagaggggtgatgtgtcgccggtttatgagcaactttggcaggtttgatggggaggagactctggttggtctgctacccaacagggctgaggaggaggaggaagagataggccttggacagcgcgcagggcgtgccgcgtgatggtggtgcatcatcactgccttcatctcgatctcgaaatctggatggaggaatcaattaaattgaagggggaggcagagcaagaagagagatggagctggaccagccggcaggagaggacagcaagttgcggtgccggtggacgttggtagtgggaggatcagactcgaggggagaaaggagaaatcagaaatggatgaggcagcgcatagagccgggagggaccaacaaaaggcaagcctttttttttaattgggttaattgttgtcaacttggcattggcatatgtactgtatgtctgcatctgtatggtggtgcttcatgtggcggtgcaggaggtgcagcatggcgtacacctccgctcgccgtgggtgcgctccgtcccaccatacgaaccgctcgcttccgccggcgtgctgcaccacgctgtggccgctctccaccttcactcccttctccctcatcgcccaccgcatccctgccgcccaccccttgcctaaacccatacccatggacatgagataccccgccgacttgcccggctccagctccagcacgcgggccgccgcgcttcgccccacctcgccgccgccgccatccccgcgcctcctgcacgcgctaagcagcgcgctccacgccgccgggctgccaccgccactgctcctcctcacaatctccgccgcgccgtccaggtcccccgcgcgcgccagcatgtccaccacgcacgacacgtgctccacccgaggctgcagcgactgccgcgccatgctttccaagcacccaatcccctcctcaaccagccctccatgagcgcatgcccacagagcggccagcatcgtgacgccgtttggcctcacctcatcaccttccgcttccatcctgtgcaggagcgcaagggcgtcccgtgcgcgcccgttcatccccagcgccccgatcatggagttccaggtgagcacgtccttgacgggcatcgtgtcgaacaccctcgccgacgcgcccagctcgccgcacttcccgtacatgtggaccagcgcgttgcccactgccagctcaaaccccaatccgctcctgacggccacgccgtgggcgcgtctcgacgcccacatctccgcgcagctgccgcaggcctccacaaggctcagcaccgtgatcgagttggggcgctccccagtcaccagcatcgccacgaagcatgccatcgcggcgtgtggccgggcgttgtgagcgcaggcggcgatgactgtgctccaggttatcacgttcctctcgcgcatcccttggaagagcctcagcacgtcctccacgaggccgcacttgccgtaggcatccagcaacgcgttcagcagagccatcgacaagagccgcctcctgatggccgcgccatggaccgacctggctgcctgaccccctagcctcttcttcttgcacagctgcagcagcaccgcaagcgtcgtctcgtcgcccaccaccccaatctgcaaggccagcagatggagcgcctcggggtagctgccagcgtgcacgaggcctgagagcatggtgttccaggacaccacgttcttgacggcgataaggtcgaacaccttcctcgcggaccgcagatcgagacatttggcgtacatgtcaacgagcgagttgtccacgaagagatccccttgcaagccccggcgcgtggcgacggcatgcacggaggctccggccctgacatcctccagcatggcgcacgcgcgcagaaccacgacggccacgacaccgtccggctgcagcgcgccgtcagcgagcatctccctgaagaggcgtagggcttgatcggcgtagccggatcccaggcaggccccgatcatggaggtccaggacgcaacgtctcggtcgggcatttcgccgaacagaatcgcggcggaggcgaaatcccccaaagtggcgtagagggagagcagggagttggcgacaggcgtgtgaatggaggcgggcgtcttgagaagataggcgtggatcatgtggaggaagtggtcggaataggaggaggaggcgcggaggagggagaggagggaagcgatgttggggtggaaggcagcgtgggcgtggcgcatggcgaagcggaagaggcggaaggtggtggaggaggaggaggaggcagggaggtggttgaggagggtattgtaggttagagaatccctgggcgtggagcggcagcgcaggtggtggagcgcgagatcgaggcgcgaggagcggaggtagtagcagaggagggagttggaggcggcggcggagagaggccgcttggcgacgtcggcgtggagctgtgaggccagagcgcgagcccagcctgatgatggctgctgcctggacaggagccccaacaacgccgggaggagcgccgccggcttgccgcccgcgtaccgccggaccgcctcctccaccaccacgcccgccgtcgccatatttttcgtttccactcctcttcttacttgttacactacatgggcagcatatcttggtaccaaatacaacttaaattaaattaattttgatccctgtcaaatttattcgattggagcattggagggagtactaaaaagcaatgtataatagtttgttaacattggagggagttctaaattgaaaattaatgtttttgtttttgtacctaaaaatgtgtacaagcgagttgttaaaggttaatatatatacatgaagagcaactaagaaaatgatgaaaatcaatcagtgaaatcacccatggccttccaaattaagggggaacataacatgggaatccaaccaagagagagagagagagagagagctaggcaactagtagctagaatgagcagatggaggaattaaggttgggagttgggaggaggcgtggtggtggtggctctttgcttgtcttcccatggctgggactgggaggcgacgtggtcgagggctcgggtgacgtctgtcatggaggggcggaggttggggttgtcgcggaggcagagcgaggcgacgacggcgagctggtagaaggcgcggcgggggtagcggccctgcaacgccgggtcggccagggcgaagcacctcttgcggtcgccggcgaggtaggggcgcgcccagtcccggaggaggaggaagcgctggtggtcctccgactccgagtcggaggaggcggcgtcgaaggccctgcgtccagtgatgagctcgaggagcacgacgccgaagctgtagacgtcggacttgacgttgagcttgccgctcatggcgtagtcgggcgcgcagtagccgtaggtgcccatgacgcgcgtggacacgtgggtgtcgtcgccgacggggcccagcttggcgaggccaaagtccgacagcctggggttgaggtcgtcgtcgagcaggatgttggacgccttgaggtcgcggtagatcaccggcggcgtcaccacctcgtgcaggtagcgaagccccctggccgcgccgaccgcgatcctgacgcgcgccgcccaccccagcgccagcgggggctcctgcggcctcctgccgaagaggtgcgcgtcgaggctgccgcgtggcaggaactcgtagacgaggaggcgctcgccggcgtcggcgcagtagccgacgagggagacgaggttggggtggtgcagcatcatgagcatcatgcattccaccaggaactcgcgggttccctgcgcgccaccgtggcagagctgcttcacggccacgagcccttggccgccttcctcgagacgccccctgtacaccctgccgaacccgccctcgccgacaacgttggactcgtggaacccgtccgtggccgccgacagctgcgccagcgtgaacttcttcgcaccgcccgcccccgccgacgccgcctgcgcggcctggctgcacgggctgccgccgtcattgctgccatgccagcaccgcaggctggggttccacgagaagcagctcatcccttccttcattcatctatcctatccattcatgtcatcaacacaaaagctttcatcctcgactcgacaaaaccaaaaatttggaggacacacgaggctcttcttaattaagcaaccagacagcttaatcgatcgatcgatgcttaaactacatctatatttagatacagcccaggacgcgcaattcatccaggacagagcacagggcattcttctgagtgttgttagctggcatatgtacatatatagatacataaatttcacaagaacattattatgtgttcacggcagaatagatcagattatttttgtaagctatatatcagtataacaataacaaacttttggaacagagttataaagtggaggcgagcttcatcccctgcttcaccaaaaagaacatctgtcgcaaactcacaaggaaacacagtgatcatggggaaactgttttaatccctcgaggagatattccctcgttctttgtatgtcacttaaatggttataaaaaaatttaaaaaaaatgggaaggtgtattaacatgtgatataacactccataaacatacaggttcaaattcaacttctacatctcgtaacgaaaaaaacaaattgaataacagctagttaacgtatattcagagttaaatttatttttttcgttgcgagatgtagaagttgaatttttacttgcatgttttgtggagtgatatatcacatattaatacattttcttaattttttttcaaattttttataaccatttgagtgacatgcaaacaacgagaggatatcccctcgagagggatcaaaatcctcttccgtgatcatgccattgccatacaaaatgcatccaacaaggcgcaactgctgttacaagcgcaggcatcttataatacaccacttcttttaaaaaatgtaattcggtttcttataaagtcaccacaccaacggtttgtggcagggtagcaacacgatgcatacttattaaacacacacaaacctaaaggcgagggatatagtttaagggcagtccaaaccctccacctaatatggtgtctatagcgttaactacattgtcatgtaggacttttaacttatgtggcactatattaattaagagagagagagtgaagagtggaagaaactgggtctcatgcaagacacagcttcaacacgagaacctatgcactagacactatcaagttttgcattgggagagaataatgtcttcataataggcgaagaataaatatgattggcagagaagagagatgatgtatttattaatggcccactctaagaaatcatgggttgtggggtgtagtttctattgtgatgtcttattgacatggcactatagacattacttatagacattatgggttgggactgccctaagcatgcaaagtgaaagctaaactggaacacagctgctcaaggccagggcaaagtagatgcctggatcaaatagttcattgcctggctcgtgaatcgtgattttgtcctgctggcctcctctggggttgatgggaacagctccatgtaccttgtcccaatggtcatcttgtccttgcatatggctgtcttcgcaacccctgttgttgagaactccatagagggccttcccatctagacggtacgcggtgtgcacattttcctccgtcaactcatactctacaaagaacttgatgatgtcttcagcggtagtaaagtagggcaggccacggagcttgagcacatcaggtggtgttcttttctcttgaagatgaagattaagttttttacgtaaaacgaggtggtattaacgtatgattgattgagttttaattattataaacttgaaaaatagattaatataatattttagagcaactttcatatagaaagttttcgcacgaaacacaccgtttagcagtttgaaaagcctaccacaaaaatcttaatcttcatccgacttttgttggagaaaagaatgggacctcaatatattccatgttgctcgtcttcagctggtttcttgggccgtggaggaggtggggagtgacgatactttgagtcgaaaaagccgtcttggttcacctcagcagctattgagctgtaatactcttgcttcttgcatctaaacacctcaacatacctcctgcccatgttctaccggttgcggtgcagtgcaaactctccttgcatggctgatgggaagacgacaaaagcctcgtcggtgaagcagccattcttgtgaaccaagaggcagtccactatgtccagcccaacaaagaacttgcaaatgtcaagatcgccgcagtcaaaggggagccctagtagacggacccctgaaaagttctggatggcactattagctcctgcactaggtaagttggcctggtagggctagtagaaggcattggtgccatcagcagcactgttgcccatggctccaaaaatagagaggggttggttccatcatcctggccctctttgatacatccaagggactgcctgcggtcactgcgaagtatggattggattccatcattcgtagcctctttgatccctcctacccatccaaacccccctccccccctcccatcattgcccatcattgcccttcagataatccagagtcccaaaaagagaaaagaaaaaaaaagagaggagaagatccccccatctctcaatccccatttcatataaaataacccaaacataaagaaaaccgcgcagataagaaataccagtaatctaaacaggacttaaggctaaaaaaggtgaatggagtcgaaatgcgaacgcattagtggtcataaacaaaaactaattaaatgttgacagcttatgaaatgctcaaactactagataacacatatcattagaaaataatcttacaaaccacattggtgcagttatcaatttggatgtaagtcagctattactgcctctgatttatttattttttgggggaggggtttggttttgtagggagggggggacgtacatgtatcctaaatactaggcatatgatatcatatcatatcatattatgatagcaaagcaaagtgacctacttttagatggggactaagaaattgtccctaaaagaatcgagaaattgatgagatcgcataagcaagcaagtaagcgtggattcgtagtattgtagaaaaaaaaagaaagcaatggatgaatcggcgggatggaattgcagggataagagagaaggaagaggaggaggaggtgaccgtacatggcgaagcccgctggaggagggggtggggtggcggttcacgatagggaggggaggaaaccctagagcgagagggagtcgtcaagtcgccgcctctgcgattgtgttgcaatgcgcctcgcatcgcccaagtagtcgtctctaaattctaaatacaacctatacgctatatgcataggacgaggaggaagagctcatgaccgaactgcatttcttgttgctgggtctggattaggcctattacttctattttatttttttctctagaccaaaataaccctgcctaattctctcctttctcccacgcccaaatcgcgcacttcccctgttgaggagggaggcgacgtcgcccgtctctccgcgtcggctccggcgccgacccactcccctcctccgccgccatccatctattcgcgccgcaccgcccgctcaactcttccttcgcgcaggcggcggcggtggcgcaggcggcgtcttcctccacctgatccacctccacttcctccggaccgcacaagaataagaagaagaagaagtgcaggtacggtgcaggtgcagatccaattgcgagctcacctgctctgccctgcccactaccaagtagtagcctcctcctcctcccctttctccccaacatcccatcccaaatcaaaggctactagactagtgttgggggagatccaagagatggcgcggagcccctgcgacctccgcatcctcctcgtcgccgccgctgcagccttcatctacatccaagtatgcctatgcctatcacaatctgattcttcttcttcaacttcagatcaggatcccccctctcctaaccaccactctactactctctcactacacataatggcttctttctccttgtttcaggtccgccttttttctactcagtcccactacgccgaccgcctcgcacaagcagtcagtctctctacccccccccatctcaatatactccctccgtttcaaaatgtctgacaccgttgactttttagtatgtgtttgaccattcgtcttattcaaaaaatttgagtaattatttattcttttcatatcatttgattcattgttaaatatactttcatgtacacttatagttttacatatttcacatttttttaataagacgaacggtcaaacatgtgctaaaaagtcaactgtgtcaaacattttgaaacggagggagtatatatttttggtctgctcaaactcactaattgcaatttaggaaaaatccgaaaaccaatgcaccagtcaactccgctccttgatcgatcaagtcagctctcagcaggagaagattgtcgcgttggaaggtaccacacatttatcacactaatttaagccttgcctctactattcgcgacctataaatgttgtgtctctcatgttttggtaacaacagagatgaagatacgccaagacgaagaacgtgtacacctcaagattttaatccaagatctcgaaagtatgaaaatgacctttcttatctttcacctatggatttcagccacaactgttcctgctaccaagtgtttgctacgttacttgatttttctcgcgcctcctaatgtttccattaaaacctaaccttgtgatactcatactggagcctcatgcacatcgacctccatgtgacatgcatggttgacaacacaacaacatatgacccgatgtttcttcttgaaattcacatgttttttttcctataaccaatagaactgaaaattagtatgtcttctggaaatatttttacaactacttattttttttaaaaaaaaatggaactacgaaaatgatgtcaatccatcagttagtcagttgtttagttaaacaatcattcataaatgcccaaaatataatagtggaacatcaggaccgtacatatcattctagttgtcatcttcacgttgaatacaaaataatagtttcataatcctcccatctaccccaaatatagaggttatgtttctcattaccatttgacatgtcactggcgtgtggctctgggtcccacatgccattctcatatgtggtagtgcctttcagtttacacccattcgcaacgtgctgaactaattttctcaaacataaagatgacccatcgtatgatctcaatcctcccagctgccatctacatatttaacccgtcattgtgattttactttaccacatgctactttttgtttctaactatttcttcaacatttcttttggatgcagaaaggagcgtgcagaccttagtaaacaacaatgtggtttgtacagtgctaatattgctagcattcctctgctatatttgactaatatgatctgtttctataagcaggctcctgttgctgctgttgttgtaatggcttgcaatcgaccagactatttgcaaaggacagttgaatctatcctgaagtatgctttgtgccttcattcctttattttcagaatccagattttttttggtctgttattgttttttctaactcctaagttggtgccaaaacccactcagtcgatatcacctgtgaaagttatgcatggaatcatgctgcattgtaattgccacgctgctcatggtgcatgaatgcataatgtctttttctcagaaattgtccatgcgatgtcacaaggaaaattacacattttacttcctaatccatatatgaatcccattgtgagctccatgtagcttaagttcgtataatacccttctgacctaatgattcttaataatttttccaggtatcagacatcagtggcttcaaagtttccactatttatatctcaggtactggtcttagcaatttcagttcttgctctcagtctctctaagtttgtggatttttttccattgctcattgtaattgcaggatggaataaatggagaagtgaagaaaaaagctttgagttataatgaaataacatatatgcaggtgtggaactctttcttcctctacacttatttgcctaaaaataagaagaaatatacttctgtaatattgcaagcatagctggagtattgtctgaggaccttttccaagtaactacataagatgatatgttgcaaaagaggggttaaaaagaaaggaagaaactgtagcctgccaagaggttttaagtggacctagattgaggttgcccttgaactttaagatccatgagtcatatcagggaaactctaggtccaatggatataaactgagcagtgagaagcaaggccataatcataccccaaacttgtggatgtattgtttgaaagggaagcttgatgccactgtactgtagtgagtagtgaccctatgctgttctggaatggggcagtggaattggtccaatatgaaatagtatggcaaaggtaataaaatccatatatagagaatcaacgggaagggatggcagctcactgaggtgactgctcagttgacagtactgaacttgtatttagttgacaaattatcattacaatttagtttagataaaataacgggtatgctagctcctgaaaaaccaaatggccatatgtagagtaacaaccatgtcatggagtggaagtggtaggataatcatcagtgtatgctgtcataaagtgccagagtgcagattgaagtctagcaatgaagtgttattgcaaaaaagagaaaatcttgttctctgccttcagcgctaatagagaatgaaaccacgaatacaatatttcctgctgttatgaaatgattgtaaacatattatcacatgtgtacttttatagtgattttgaatgattgtagcttcccccctccacataacataggcatgcagcagtccgatatttgtaagaaacatgggaaatatttttcagctaagactctcagtggtatgtgttgcagcatttagatcttgaacctgtgcgcactgaaaggccaggagagttgatagcatattacaagatagccagtaggtggtcctccttgattgatgtatgctgattgaagatagtgatgataccactgatccttgtcctgataactttcttatttcagaacattacaaatgggccttggatgagctattcatcaaacacaactttgcgcgagtaataattctggaaggtgttacaccttggatgctcttataactattttgttctttgatctgtcttctttccatcccatttatggttaataatttgctaatagatgatatggagatcgcccctgatttttttgactacttcgaggctgcagctaaattacttgataacgataagt

SEQ ID NO: 61711 - DNA, 1736 bp, Oryza sativa
  unsure (1)..(1736): unsure at all n locations
tgggctatgtactatctgctgccgcggtcgacttaagatcccttttaccccggtaggcctggttcagttaatccctacgagatagggattggaggggatttattccacacctattgtgatgtggaaggattgtctctcaatcccctctaatcctctttaatccccacaccaccgtagaataagggctcgttcgatgggaaattgaagtgatatgcatcatatagtgcatatttgggtctacattaactatttttctacgattataatgtaactatgaaagtgcatatgcacacattactgatcgatcagtcacctttctttatgcggttacaagaaaaacgtgcacgctcaaaaaaccaaccatgcacaccatttatccacatctgtgattataagtgcaccaatacattggttgtgtacattggctttggatctaatggtcgggttttaatccattttctgaaaaaatcattggtatgtgctgaacagtcagatagacctgataaattaaataatccgtaaattttttaagtgcttactcgcatgtggtataattatagacatcatgcatcctcaacttcaccattgcatcttaggaaaggaagtatataatgggaatcaatgcgcttagttcagaattgcacctccattactaatggacgtggactagtggagtattatatcggaagaagtatcaaatcaggtgtattgccctctgctgaactcaagggcaaacttataagttataattctcctttaactcaaagagacacagctttgtggtcagagtattggaaatggtttgaaaagtttttttttcgcgaacgcaaaaaaaattgtacgtcaatatattaaaggaatagagttttttttacacaacgcaaaaaaatgttttaaaagtggcacgtgtaatcatctgccacgggtgcagaacgactttaagcatgcagacaagagcaaaaaaaagcatgcagacaataccaaagacagcatgaacgaaaccagcttcaattgaacacccaaacatactatagtttccacaatatattctccatcaatccatcatcatttcaccggtattttttatccgtcatcgatcgatcggtcgattgcatcaacacgcacaaaaggcaacacagcagctcgagaatccgggcacgtaagctaattattaacacaacataaagggctccacacgtgttgccaaagttgccacgaaatgatgctcagtttttttttaaaaaaaataaccatgtccgttggtgcgatgcgtacggctgaaaaggtttgcagcagaataaatataccgatcgaccaaatacaatctaagcacatgatattcacccaacacgaacagattaaaaattgacagcacataatttctcagcaactgcccgtcagctcagataacctttagtttactgccggatcagatagccgtgaggacagtgtcagaatccattacgaggcaccatttgatttagattagaaaaacagacttaccaaatactacgttcgtcctaaaaaaaataagggaaaattgtaacatgccattataattttgtaaaatttgagatatgccatcttgacccacatgtcattgactcatgtgggtcctatatgtgattgagatacggatggcatatctcaaactttaanaattataatggcatagtcctaattacggggatctcttagagtcgaggtgcgggcaaggagattgtcaatcaaggaca

SEQ ID NO: 61712 - DNA, 28280 bp, Oryza sativa
tttcaatttaaacatggtatggattaatctgatctgcttaactgatgtccactccatttaaatatattgaggtagcttaggtaaggcagtgaacgaatataaagtatcctatagacatgtctatgttaagaggaatgatttagtttaataaaagattgatttgagaaaggactcatattctagaggtggggtaatttttctttgttgcatcgattcttctctcactatactagcttgtacacattttcccataatttcttttcaaatgtgcttataaatgaaatgcggcatcttggagtagacatatttagagatccaatcatattacacttgtatatattttgtatatcttcgggttctttagaactggtagacaaccgagtggcttaatttactgttcatgctcattcatatactagcttgtacacatttttccataatttcttttcaaatgtgcctataaatgaaatccggcatcttggagtagacacatttggagatccaatcatattacacttatatgtattttgtatatgttcggattcttgagaacgggcagacaaccgagtggcttaatttatttgttcatgctcattcatatactttttgcatgcatgtacattatgtggttttgcctgtctgctcacgtctcttacaaacgttttaagatttagagttcatttatttgttttgtttcggtatctcttatatgcctctttcttgtaatagtcgggttataatcatcttttcttttgtttaatataatatatgcactgattagatgaaaaaaaaaagttctattgctggtgcctaactgtatatagacttccatgcgtattatgcctaccatgcaagactaggggttgtttggttccctcccaaacattgccaaactttcttgccaaacctagccaaatatgtggcttataaattgatggccacaacttagacatggtttggctaaaaaatggttgtatgacatgtgggcctttgaattaaaaaactgtggcatgtcacaagtttggaagtgaaacaaacatatatcttaaaaaatgtggcaaagtttgctaaagtgagggagtgaaccaaacagaccctagtagccggttgtttttcgtttttctttctcacctgagaatgcataaaccgtgttggctccatgtcaaactaggaaatgtgaatcgcattagctcatgttaaacaatgcagatttatccaggttgacaggctgttcataaagtcaatgtgaggaggctgttttgattggtgtatccagggatttgatattataaatagcaatcatatcgcgctctcgttttttcagagtttgagggtggagagatgttcttctcctaattaagttatgagagtgtttttgatggtcacgctgatattagaggccaactgaaaagtgcagattatgtcgtactgcaatccatccaaaacaagtttgcatagatatttatcacacaatcaaataaacacaacaaaagcttttatagattgccaaaatccatggtgggatgtgtatcacaatatatgctgttaaataatattcccaattgtttaactcacaacaactaaacttggttttggaattccaccaaaactaacaaactcataatttataatttgtgctcatggatggatgaaggaatataattgccaagggtcatcaaaaccgagaaataattaatttataatttgtgcgcatggatggatgaaagagtatacctaccaaaggtcagtatagtgagttcaaacttcatttaaaatattattatttctttacttatatgatgctagctaatttttttcattacctttacagactagaagcaagttgtttgttgtttggcacaaatctacatagcaagagaatgatgtgaaatcaatattcttaacgatgaacgaaagttacttcgttgtatcactaaatgtgttacaactagttaactggttatttgatatatatgtagaatgtgtctagtttggaccgattaatatccacagcaggttaatgaacccatcaacatatagtttgacatcttaatctgaattataattgtatataaacatttttgttgttatttacatcattataaatagttaatacatcagtacatacacatgcatgcgtcacattaaattcattttcccaaaatcacccacggtttgctaaatccgttaatgcatacttttgctaacaatatacctcatgtcttatacttattggaatatatgacactaaaaagtattaagtaaagtgcacagtcggtctctaaacttatgtgattatatcatctaggtcttcatattatttaaataagatttagattctaaaacttgttaaattgcttcatgctatacgcgtttgatgatagggtgctacgagtggattccacctatccattcgtcacggttaaatccacatgcttgtactatgcaagtgtagaccaagctccagtgcaccatggagtatgtatgggacgggacctgagttgaaagcatatgagccaggataaattttcatcgtgatctcgtataacaaaacaaaactaagagcctcctgttatacatgctctaatgcgtgttgcctctcgtgttatattttgaaacgaacagcacaaagacaatatgatgtttgcatgaaccctgaaagatagtagccagaaaaaaaaaacagaaaaacaaatcatcattgtcgacgggggataaccgtagatcggatatagagggtattggggtacgctggtacgaggatctacgtaatacgacatcgagcaggcagaaaacaaagattatactggttcaggccccttgataggtaataaccctaatccagttgatatgggattatatggtgaaaaccacagattacaaagagaatagtggaactcgatgataccgacgagatcatagtcgagttgattcgactagatctcccggcgacttggctcctgtaagctccggcttcgtaggctgtggtggatgtgttggcggtaagattcgatgccttaggtccttccggggggtcccttttataccgcaggtcaactggtctccaagtaggactcggagacattggacccgacacgatacaatgacgacccagttctatccgagtaggactccttacatctgtggactccataatggaattccttaacttatgccgaaaacgtccgtatacgcgcaagcataccatatctatatgtgacgtatatcgaagggtagagggtataccttacccgtaaccctgacagtagcccccgacttctgcttaaatgaactcgtgagaccgatcgcgacttctgatgtcgaagttgtcgtcgttctcgatgtgaggaccgagagacgaggagtgatcgacaacgtcgggtgaagctcaacggtcatgagtgaatttaaattgaagtctgaaaaactgctgcgcgtaacggacccataaatttccggcagccatctctctcctttccttggaattcgcaccgtcggaagtatccaatttgaagtccgcctgttgaaaaaaaactctccagtttccaagcgttcctcgtcctcttcgctcccgcaaaaaccctagctagctcatctcggtcctttttccggcaatctccggtggcaatggatctcgacaagtctacctccaccaacgcatcactgaagaaactgcaggaggatggcgcccttcccggtcgcgggaccgcggagagggaagtaggaggtactgaaccccagcctgtcctgggtcgcatggttgcgatcgaggactttattctctgcggtttttttcctccgccttctgaatttctccttttggtcttgaatttctatggtctttccttgctccatttgaaccccaactccatcgccttcccgagtatttttacgcatctttgtaaggcctacattttggtagagtcgtttcttgacctcttccacttttactatgagttacgctggatggaacctaaaaaggtgtccgggtgtgttggtttccgacttcgggatggcctgaagtcgcgatacatccccttccagtgcccctcatcacgcagcaaatggcgggggaggtggttctatcttcagatagaggattcggatccagtcttcgttgttcctgaggagcaaccagacaagattccatcttgggccaccaaacccacctagaccccatccctccaatctttcatcgatatcgttgacgacctccgagaacaggggttgtcggggtttgaagtcgctgccgacttcatcggtaggcggatccagccgctttaggctcgagcccatccagcctttgattattctgggccagagaacgcaacccgggtttctcctcggggtattttcctttttagttaaattgactcccttatgcgtgtgtccttcccaacttatcggattctggtctcgatctacaggcttggacagcgccaccgtggagcgccgcgtcagccaactgatgatcagtggcccgacaacggcgagcaacgtccccgtccccctttgcgagaaagaggcagccgagcgcgacgctgccatcaatgtaagtgtactcagcggtcttttcgcatttttcttccaagatcacattatgacttcatgaagcgtaggctctccctttgactgatatcatcgggctgctcgtggaccatcaggtggcggtgtcgctgaaggagaaagtcgccaaggaggcgtctgacactgctgccgccgctgccacaacgagtggcggcaacgctccgaaaaaggggaggaaattctcctctgtggtcggacaccgtcggaagacgcccaccccctcggtaagttctcctgccctttgatcgcgtagtcggaaaacttccacctcacatcatatcggttgtactccaggcctcggacgcgtctcccccacctccacgacggcagaggctagtgacgcttggcgagaagtaagtggatgactttgaggtcttgtctcttcgtcaaactgttgcagcctgtttcagttgcggattttcgcagggcggcatgggcgaaggcggcgcaagacgggtctagagggacctcgacggatttcgtggtcgcgcccaggagccgcgaggcgacacctagcggcccaactagcgatcttgcggctggtcggggtctgccggctgccattctcacctgggaggagctccaggttgagatggggcgcctcctcgaggctagtgctcgcgacattggccgcgagattgcggaggcgaggacggcggcggcgttgtcggcgaatgagcgcgccgaccggctggcgcacgatttggcggaggttcgcgaggacctccagaagatgggggaactggtggccggcaatgagcgacaacggcagggactcgagcaccgtatgtcggagctcgagaacaacttgtcggaaatccgtggctcgttgcgggtcacctatactggactgcaccagctcgccggggagtgcggtatcaagtttaccatcccggcgaatcccgatgagttctcgctgacgtcttctcttgcggagctggcggcggcaatggaggagatcccctccaagcatgcggccaggatcggagaggagacgtccaacgggatctataccggggcgtgccacgtccttgcatgtgtgagactggcgcacccaaaactcgatctgcggaagatcttggatcagggggcggctagcgacgcgtgcaaggatgtgatggaagaagtcggcgatctgggggagtctattctcccacttgttgaagagtaggattttgactctcttgtactctttagtcatgctttgtaaaactttcgttggttccaaccacctgtgtgtgtgcagtcagcgccttagctttctttagcattttgatcttgagtactttgttgtcgtttgtagagatgttgatgtcgaggatgtccagcagcgcgggcagcctgagctgccagtggtcgttccgttacttgcgtctgagccacacatgccggagggcgatgtagctcaaaattcgcctgtgggaatgagcatggcaacgactcccttaggttggttatctttgttttcatctcctttattcttccgtctggatcgacttgatttgctgtattctcgggagagaagagcagtctaacttagtcgtttccgtactgagcagacctcgagagtgcgcttgctgaccaggatcgtcgcatccagtattggaggacgaagtttgaggtcgcggaactcgagaggactatgttggaaatgaggaaggatcaggccgtggagacgctctgtggtcgcgaggtgtggttcaactcgtatctgaagagttgttgtacctccatgttaagagtctgtaaagagctccgagtaccccgtggggatcccgaggaatcggcggctggatacatctcgtggctgaatggggcctgcgcccagctcgagggcatcagccagcgtatcgacgaggccctgaagcaggagtgtcgtcggtcgagccgatatgccggggggcatgtattggcttgtatacgagatcatcgtccgtagctgcacctcgagttcctccacgaagggttttctcgtttttggagaactcctacggagatagatggcctggcgaagtcgatggcgccactggcggaaaaggtcttccaatctatggactggcgttggccttcctggtagtcttcgtgtcctgtgacaaatgtcttaggggaaaagtgtaatataattttggatttttatggaattgtaagaagtacttgtgaaatagaaaagaaatctatctaactaagctttcttactctggatgtagcgtgtatgagtgtcttcccagttcgcgacttcgatcagtcgtttgagttatacactctccctagcccccagccttgtcatcggagaattcttctcggaagataaggctcttggacctttgacctgcctcggttgaacaagcactgatcctagcccccagccatgaagttggaaaatttatttctgattacacggcttggttaatacgcacggcgagaactcttacacgactagatcttacatggtctttcgtctctacaggatccgacaaggccttatcggctctgggcgtccccagccgaagttcccttaggttcctcggaggccttgtcaagacgacgtaaagggacatgaggataggtttcaacactatgtgtcatttgggtaagggatcattgggaaggaacactttgatcgtagtctgtacctgaaaaataggctttattgaggctgtaagatgtcttacaagtatggatactattgacttatacatagaatttacgtaattgatcaatgttccaggaatttgccaactcgcgaccattgccgtctgcgattttgaatgcgcctggccgcagaacttgtgtgatcgtgtacggtccttcccatttgggtgagagcttgttgcgccctgcttggctttgaacccgtcggaggacgtagtcaccgatcgaaagcgtgcatgctcggatgcgcttcttgtggtaacagcgaagggcctgttggtagctggctgctcgaacggcaactcgttcgcgatgttcctcgagtagattcacatcgtcgtatcgttgctcctcctgatcctcatcggaatacttatgtactcgtttactttgatgtcgtagctcggtggggagcatggcctccgagatgtaatagactggtcgttgcaccttctctctctcgacaacaatgacagtgctaacggaatatggcgtggcggaaatatagagaaataattctttattaggttgggggcaacaagtacaggtggatttgataggtagcgcttgagtgcaatgaatgcctcttcgacttcctgtgtccatacgaatttgtcttgcttttttagcagagcgaagaaaggttgtcctcgctctcccatcctagcgacgaacctgcttagtgccgccatgcatccgattagcttctgtacttccttgagtcttgtaggcgacttcatgttctcgattgccttgatcttctcgggatttgcttctattcctctgccagagacgaggaagccgagtagcttgcccgatggtactccgaacgtgcacttctctggattgagcatgaggcgatatcgttggaggttgtcgaacgtttcccgcagatcgtcaatcaatgagtcacttgtcttggtcttgacaacaatgttatcgatgtaggcttcgacattatttccgagctggtcgctaagtgcaccttggaccgtgcgctggaaagtgtttcctgcggttattagtccgaacggcatcttaacgtagcagaataccccgaacggcgtgatgaatgttgtcttctcctcgtcctctttcgccatgctgatttggtagtaaccggagtaagcgtcgagaaagctcaacaactcacaaccggctgttgagtccaccagttggtctattcgaggaagagggaagtgatccttgggacacgccttgttgaggtcggtgaaatcgacacacattctccatttcccgttggccttccgcaccatgactaggttggttagccactctagatagagtacctctctgatgaaaccggctttgagaagtttgtcgagttcttctcgtatggcttgttttcgatctggtgcaaatctctgcagtttttgttttactggcttggcatcgggtcgcaccatgagtttgtgctcaatcacctccctgggtaccccgggcatgtcggacggctgccaagcgaacacgtcagcattgtcgcggaggaaggtgatgagcgcgagttcctatttctcgcctagtgatgccccgatcttgacggtcttgttggggttggcactggagagtggaacgatcttgattgcgccgtccatttcggcgtcttgtttgttttgctcactttcttgggtggctcagctgtggcgagtgggctgggtgtgtgctcgagcatgtcaaggctccgcttgtcgcattgcactgccagcttagcattcccttaaatagtgaatgttcccttcggtcccggtatcttgagcacttgatacgcgtagtgagatgcggccatgaacttcgcgagtgcagttctcccaatgatggcattttatgctgtatcgaattcagcgacatcaaaggtgatctgttccgttcggaagttatttgcttggccgaaagtcacaggcaacgtaattttgcccaatggtttagacgatgactgaggagtgattccatggaagggttgattggtgggtgtcaactctcttcgtgggatccccatcgcgtccaaagcgctggcgaagaaaaggttgattgagctgccgtcgtcgatcagaactcgcgtgaccttgatattccgaatagtgggttcgaccacgatcagatattgccctaggatgatggcagtattggggtgttcctcttctgagaatactatcttctgttcggatcacttcatcttgggcgcagccccctgccacatcgaacaaacttcacgtttcaccttcttgtattctcgctctgaggagtatgtcgtggaacctccgaagatgtgcgagacatggagatcggagtctggatatgctgagtctgattcctgagtaaccgcctcagcgtccttctcgaccacacgtattcgcttgcctttttcaaataccatatgttttacgagcgacttattgaagacgaggcaatcttctagagagtgtctatctgacttgtgtatagggcaccatattttcttcgcgtcgctgccttgtgggtctgggcgcttgggagggtccgcgtattctgctgcgagaacttccgcttgagctttccttttcccactcttgcgatttttcttcttgcttgactcgggtgcgtcctttgctggtttcttctctcctccggtcttcggtttgtcgttcttgcgtctcagtgcgtcgtccgcatgagcgcatcgatcgacaatttcgaataatctccgagtagtcatgacgcgcctcgttgccaactcctaagtagtatagcgatctctgacaccggacttgaaagcgcgaattacagaagcgtcggtgatttcagggattgtatttctgcactcgttaaagcgccaaacataatccctcaaggattcacccgggttctgtgtcaacgcatgtaggtcgtcttcgatcgcgtggcgcttgtacgttccttggaagttggcaacgaactgctgccacaggtctgcccacaaagaaatcgagtaagggggagatgcatcagccatgaacgtgcagagcctttcaatgcagttggcaagtaattcgccaatgcgttgtcgtccgctccggcagcgtagagtaccgtggagtagacctgaaggaattcttctaggtcggtgctcccatcgtatttctctattgctcctggttggaacctttcaggccatcggacatcttgaagtgaacgaccgaaagctctacacccagcgctgggggcggtgggttgtcggcgatcgtacgtccttcgcggatgtctatctgatgatgaggatgaggaagatgacgacaatgacgatggatcgcttggttccggcgtgcgattacgaggacgtcggccaggttctcgagaactctgtcgtcgtctctcgttgttgtctcggcgctgatctccatcatcgtcgtcattatggcaacgtcctcgaccagaatcgcccagcacccgccgctcgcgatcgtcgtgatcgcggcggttgtggcggttatctcagtctcggtcttcgctcgaacggcctcctcgttcttcgttatcgtgacgccgtgaagagacgcgatgtcaggaacggttctcgtcgactcgtgtgcgtcgcgcctctcggcggccattcaggtgatcgcggagatcaccggtgccgcgaggtggaggggtggctcgatgaggcgattcccgctgttcagggttttcaccattagcatcgccagttggtggctgtttcgggtgcgctgcagtggcggcctcttcgaacgcgttgctgaggttggtcactgattcccataaccgctttgtccatcgtgcgagatcgtcgttcagaacggggtcgtagggagtttccctcagtattgcgttgacggctctaatgtgctgggccggtgtaatcacttgattctccgcttccgcattggtgcatgctgacgtgccgacatcgtcgatagccaatacctcacgcggcatactcgttgtcgatgaaccatagtcttcgagcaggtgcaagactgatggttcgtggggatcgatgtcgattactccaacaaatcgatctgaaatcggcgtcgctccttgttccttgtcctcatccctgaagggaacgcgtgactgctggaccttaggaggtggcgtcttcatggcgctgagaaagaccttgcagctcgagaggttgtgattctttgtcttgtgaataggacaatagacatcacgagttggagaggtacgctgaattccatgctctttgcaggcacgaatttcagcatggacgttgaggaaaacccagcaggcttgcaaggtgtgttttctggttttgtggataggacaccaggaccttgtcacctcggaagtaatcctcgtcggctcatgattcctgtcgaaaagacaaggcttagccgcactaggatctcgaactcggatgttgtcgatgttccgatctccgcttcggcaggaggatccttcgacatggagtcgccccgggttgtagccactgcgttctcgtttccggtcattggcggactagctgagatcggcactgtggtgtaaaccggaaagacgatttcgccgacttgagtccacaccagtattgttgaagtaggaactctttggttgaggttggtattgacgctattgtcgacgaagctggatgtcatagtagtagaaccttgagcactaagtccccctacctggcgcaccactgtcgacgggggatacccgtagaccggatatagagggtattggggtacgctggtacgaggatctacgtaatacgacatcgagcaggcagaaaacaaagattatactggttcaggccccttgataggtaatagccctaatccagttgatatgggattatatggtgaaaaccacagattacaaagagaatagtggaactcgatgataccgacgagatcgtagtcgagttgatttgactagatctcccggcgacttggctcctgtaagctccggcttcgtaggctgtggtggatgtgttggtggtaagattcgatgccttaggtcctcccggagggtcccttttataccgcaggtcaactggtctccaagtaggactcggagacatcggacccgacacgatacaatgacgacccagttctatccgagtaggactccttacatctgtggactccataatggaattccttaacttatgccgaaaacgtccgtatacgcgcaagcataccatatcgatatgtgacgtatatcgaagggtagagagtataccttacccgtaaccctgacaaccaccaccacacatcgacaacatctacataaaatcaagaaaagagttagcaccagaccagccgttgctagacaaaaaaggagctacagccaaaccgttcaaaatcaaaccctaatagacgagcccctagccttctagatgttgtccggacgaaaaggatatagaaggagagggcaagagagaagaaagatccctctccctcggatagacccaccgatcggctgccatccagcggcttcgcatagactgtctaggaccagttttggcaaaagggggcctcctagatgacgtctccatagagaagagcgacactattgtccctcgtggtctctgtcagggttatgaataaggcataccttctatacttggagtcgagagatatacggatacggtataccttcaagtatacgaaaaggttacttttgggttaaggaagtcggtgggcttctcaggaaataatctctacaaattgaaggggtcagagtcctattcggagaacataaggattttttcatactgtgtgaggtctgttgtctccgagttctacttggatattaaggtgatctgtggtataaatgtaggccccccgagggtacagatcatcacatcttagtgcaatacacccaccatagtaggagcaatccagaggacttgaagccaactcgccgatagatctcatctagttgttctcgatagggatctcgtcagtaatctcaggattctattgttctctattgtactctatggttttttttcataatcccatataaaatggattaaggctattaccttacgagggggcctaaaccagtataatctttgtttcctgtgagcttgatgtcgtatcaacatacctcaatacccttagaatacggtcggcgggtatccccccgtcgatagtttcaaggagatctaagataaggttttcactaggaaagaagatggacatctcgacaactcccccaagagtgaatacgacgcctaaaccgtgtcgttgctgacccgacaagactgggctaggctttcacccacctcctgtcccctgtcgatctactgctaccgctccattgcaccaccaccagtcacccatcataagcgccaccgacacctcccgtcgaccatcctccgcatgcctccacatgctaacatgacacacatgccatcactagcctctcgccgctagtcatgcatgcatcctcgccgttgcccgtgtcaacctcccgtgttgctggtcttcctatcatcgttagagtcaacctccagcattcgtcagcctccctgttgtcacctgcattggccacacatgacctcccgctgttgccacgcgagtggtgtcggtagtgctgtagccactcccagcagcaacctccgggaagaggagcaaccactgccacacctagtaacagctgctcctccacacacaccgtcactagaggccatcaccatgtgcttctccctcaccaccgtcatttgtcatcaccgagagctacctcgtcgggggaagctagagggagctatgctggaggccgctggatttggcagctcccgctgccacctccgagtccacttctcgccaccctctgccatgccgcctagtacccccacccttctccaccatgccgtgcgctaaccttcacctcgccagatccgtgaaaagggctagatatggacagtgccacctccttcttcccggttgcttcagagcccatattaacgcgacgttctcgaggaggaaaagagttcggcatcatcttccttgcaaccacgtggcttgctgacgggttgctccggtggtggcaaggggcagaggtgcgggggtggctgcgtcgctcaattggttgtctcctgtgtcatcccggattatgatcacacgggtcctctacttagtgagccatatgccacttagagggtggtaagtgggctgcgagctagagcgtatattctggtcccgttcatttcttcaagagttggatgaagataaaaatttttgtgacacgtttttcaaaccgctaaatggtacgtttcgtacgaaaattttctatatgaaagttgctttaaaatatcatattaatatatttttaaagtttgtaataattaaaactcaatcaataatacgttaatactatatcattttacgttaataccatatagtagtagtttggcacgagaaaattgttccccgatcgtgcttattcaaatctacggtgagagctaacactacgtggaagaagaaccggacgtcggatgcggcgtcattgcaggatcggcggcgacgccgggggcggcgtgctgtggctgagccgcgccgcagttcgcggaccacacgcccccccaccccccgcctgccgcctggcccggctgccgccaagtgtccgccgccgcgtcgtgtcgcgtcgcgtcgctcggcccgcctcgcctcgcctcgccaccaatatctccccccaacctcgccgcgcaacgcgcaccccccgcgtcgaacacccgaggaccgggagcccgcgatggcgatggcgatggcctgcctcaaccctctcgcgctctccccgcgcctggcctacggcggtagagcggccccgcggcgctgctgctcggtggtggtgcccacatcctccgcgcgcgccgcggcgggtcgctgcagatggcggctcgcggcggtggcggaggagccgcaggccgtgcggcagcaggagcagcagcagcggacggaggggtcgggtgaggccggcgcggaggcggcggccgacgcctcgtccaagctagttctcgtcgtcggcgggaccggcggcgtaggtaaggagacccacatctctagcccttctctccatagcttcagtgtcaccttctctccattggagtgtcactactgtgtgagtatattttttttttcacaaaatatttcgtagcattttactatgccattatctgattatgtcaagctcatcatgctggtaattcttttagttaagcgtacatttgctctgcattttaagtgataaatatatgttctgcagttgtctagatattgattgagcagatctgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacaagatccttgcagggcagttggtggtggcatctttactgagcaggaacatcaagacaaggttgttgctaagagatcctgcaaaggcagtgaccctattcggcgagcaagatgagagcgtatttcaggtgatcttacatccagagagcttgaacattctatttccttctgtgtaaattttgctcatgtaaattgttacttcatggaaggcttacaaggctgacacgagaaatgctgcagaattggatccagaaatatttgaggttcattttcttgtgttttattgttttgaagctgaaatggtagagcgttatgggctttctatttatgcatgattgaataaagcaaaatatagggatctcttttcacagggagttacgcatgtcatctgcactactggaactacagcattcccttcaaagcgctgggatggggataacactcctgaacgtgttggtacgtactgagtaaagttcttcagttcttgttgaaaccatctatttgtttgttctacgtacgtaaatggaacagtgatggttgatcttgggggatggatgatccttgggtaaagtctttcaatcccctatggacaaactaagaattcaactgtggcagtcgcggagtgctaataagctgcttatgatatttccagatcttggcattcccattgacagagtttaatatgtaccttttgttgatcatgatcatgcacactacagttaaattcattccctgtgcattgatgttaatgatatttcttataagttataactgatataacctggtctatctttgtcacgcataatgagctagcaacatcagctatgtgcctatgtcttgttgtgtttttttttttctgaacacacaccattttccctttctagattgggatggcacccgtaatctggtgagcgccatgccacggacaatcaagagactggttctggtgtcatccatcggcgttacaaaatacaatgaactaccatggaggtatactgcagaatttcaacgaaaaactttggtatcttacagttgaacttcctgtcagtcatactagtctccaaagtctaaagttgcatgcattccatgagctatcctgaaattttactagagtttaatgaagaatttatatcctcaatatacttatgagtttaatttagcaatggtttactgtgagacaatgtacttgctgtataagatttgcatgcttatgcttccaaaacccatcttaatcttgaattttagttcattaagtctagtgtctgcttcctcaacttctattgcgtcacaattttaaccttcactcatgctatgcatttttcagtatcatgaatctgtttggtgtgcttaagtacaagaagatggcagaggactttgtccagaactcaggcatacctttcaccatcataaggtattgtgcacataaatccttttcatggctcacaacggatacatttttatgacccaatactagctgcattgcaggcctgggagattaaccgatggaccctacacttcttatgaccttaacacacttcttcaagctactgctggagaaagacgggcagttgtcatgggcgaaggtaacttatactagttgttattaatggatttctgttaagctatcttattcttgcaactcttcatcactacccctattaggtgacaagcttgtgggagaagcaagcagactggtggtggcagaagcctgtatccaagctttggatattgaattcacagaaggacaaatatacgagatcaactcggtgaaggtatttatgcctggtgtttgatatttcctcgtgcgtgtgtgtgtgtgtgttctttttgaaaaatggcctttggttacgttgaaaactaaatatacaaaagctgtctagttacgttcaaactaaattatttatcttttgactgaagtgtcaattatcacttcagggcgaaggacctgggagcgacccagagaaatggaaggagctgttcagagctgttcaatgaaattaatggcattagctcaccctcatcgtgatgtattttgttcatgtatagtgtactttagtggaattccattgaggtagtttagtccattgtagttaactagtagtgtacaattcatatcatcatgtaatgagattttagcaattctaatcccaagaccgcattggtggtaattagatttggtactaccactgtcccaaaaggatttcatttctagccatgcatttgggcaagtattaggtgtatattgggcaggtattaggtgcatagtcaaaagtaaaatcttttacgggcaaaggtaggtagtaaaatgaagtaataactttttggctatgtatcggatatattcttttccagacatatagctaaaagttgcagatggagagaggtgtaattggcattcacttctaaagggtcaagcaaatactccctccatcccataaaaatagctatgatttagatttatttttttatgggacggatggagtacatcattttgttcttagagttgtattttttttcaatttttgggtaacttctggtcggttctaacgggaggatttatgggaaaaaaaaactgaactaaatattataaagctaacaagtaggcataggttaaaagaaaagttatcttagcgatcctaatgttgaaaaataattttcttatagaaattatactttttaatgtaaaactattacaacgttagatttttattcctttcattctaacatgttaatttctaagccttaattaacatctaaagctggaggttccacgaagatggaccagtttggcacaacttcaagtctagctccactttttcgtaatctggagtacagccaaatggcttcagctccaccaaaataaatggtaagagtgaagcatgttgaaatattcttataaaataaactagagaaattaaattgggctttgcgaaattcagagtaaatttttaaagttaaatccttaaaaaacatgccctcaccactacggtctacgggagagggaagagacagaaaccccgaaaccccccaaaggttcccacttcctcccacccgcccaaacccatcctccgccgccaacgcgccgagagcaaaaaaagagaagcaccgggatgctgtacatcgtggggctcggcctcggcgacgagcgcgacatcaccgtgcgggggctcgacgccgtccgccgctgcgccaaggtctacatggaggcctacacctccctcctttccctcggcctcgacccctccgcgctctccaacctcgtgcgttcccccccccccctccccctccccctcaccctccatgcccgccacctgttcgaccaaatgcctgttcccgctcacgcgccatcgccccactgttttcttgcgcaggagaagatgtatgggaaggagatcacggtggcggaccgcgagatggtggaggagcgcgccgaccagatgctccgcgaggccgccgacgcggacgtcgccttcctcgtcgtcggcgaccccttcgggtaatggtttgctctctgagagccttctgggtactgtaaacctttgctcttgtgcgacagcttttcggtttatgtcctgtttgaatgacaaattgcagcgcaactacacacactgatctggtggttcgcgccaagaacatgggggtggaagtgaaggtgatccacaatgcgtccgtcatgaatgcagttggagtttgcggattgcaactttaccgctacggggagaccatctctatacctttcttcacggagacatggaggccggacagtttctatgagaagattcagaacaatcgacggcttggactgcacacactttgcttactaggtttgtcatgcttgcttgatcatttatttcagtgtagtcaaagctcggcattcttaaggagagaggcaattgaacttgaatggctgctagtggctgacttcttttacggttaacacttccttacaaattacaatcatggttatggatcttggttcttatattggcaaatacaattgatattcaaaatgtaataaccaaagtaaacttttaatttatatgacagaccctggattgacaggtaaccactatttcctgtaatttattgatatcaacagctgatcctgaactgtcaaatgaacttgtcaggtgtaattttgtacatgcaacacttcatacgtctagcctaaatttattgacgcttgataatctttatggtttagtactttcttttcaagattaatcttgtgctactttcactttttccctgttactgcaagcgggcttgcttgactgttccttattaaagaaaaactgtggtttgattatccaatgcagatattcgtgttaaggaaccaacgcttgagtctttatgcaggtaaattgcatgatttcctgtctagtgtcagtagtgtgcagtgcagaactacaatttcttcttagaattagctatgtgctagagatgcttcattgctatgttctttcttcaaagaattgatcaatattctgtgcggcacaagcagattcatctgttgaatttttatgttgccatttaggatatatctatcttttgccattatattttatttttatttctttcaggggaaagaaagtgtatgaaccaccaaggttcatgtctgtaaacaccgcaataagtcagcttttggaggtggaggaactgcgtgggggatctggtattctcatggaatctctgaattaatttcccaagttaaaatgctcttgaaaaacagctgttagtctgcctatctaagtttaatgtaccaatctaaaaagggatttcattatgccctgcagggtaactatagctagatttttggacgttgcttacatgttctacttttcataggccagtaggttttacttctagattagcacttaaaaatcacttgtttccagcatatggcgcagattcactatgcataggtgttgctcgccttggaagtgatgatcagaagatcgtcgctggacctatgaagaaactactagatgtcgatttcggcccaccccttcactgccttatcatagtgggagagacgcatcctgtggaagaagagatgatagaattccacatgatcaagtcatgatgaatgaaagtgcttttatgtgagtttcactcctttcttgcaatgaaaaaaaaaaagcaatacttgtatgctttcattcgttacaaagcaatttctacaccttatatcctgtggctaatgttgagtcaatactcatttgcctccacaattttgaatcagggccttgtagctggatacatgatcccaggcttatagctcccttgaaacgatacttcgatgcttccgcccgccgtgaaaggtccaccagtagtagtttactgctccaattgttgctcatttttaagttaaactgggatcagctgttgttctttttttggcctgataccgaatactctcaaaccagtattgaaccttgtttacattgtgtgagctcatatttgaatgtgttcgtgcataaatcaccttgagatcaatgttactcatcaagaaacggttaccggaacattagctacaattgtggagtataaactcgtatgaatgaattgtggtaacccgtagtacgatttcgtgtcgtccgatcttctgtgccgtgtttcagatccatcttttgttgtctcacagctcagtctgagtctgggaagccttccagagttccagttgaagaggatgaacagtcacagaaaaaaaaagcaggatttttttttttttgctttatcgttcgttgcaaattacatgcttgatgatgctaattctcttcaccggataggggtgtactgctccatctgcagctggtgcagcgcggcctcggagccgaagctgtggcgtcccggcgacctccgggaccgggacctcgtcggcgtcatgggccccttcacccgcggcgaccgctgcgccgccgccggccggctggacctcgcgaagacgatgtcgctggcgatggacgggatcggcgacatggaggggatcggcgacaggaggcggtcggcgaacgggaagcactgctccgagtaggcgtccgccgcgccggcgccggagcgctccttgggcgtgctcatggaccggaacttggccttggccgacgccgtcgacgccatgtaccccgggaacgccgccgcgccgccgccgtcgtcgtccctcgccggcgtgcgcctcccggcgcgggtgaatgaccgcctcgccgagtacccgagctgcctgtcggcgtcgtcgtcgtcgccgccgacgcaggcgagcctgtcggccctggacctggaccggagcaccggcggcggcggcgggcgttcgtcgtcgttcatggcggcgccggcggcgtccctgcttggagattggtgcgcgacggggatgtccttatcgaacggcggctgcgacccgacccattcctccagccagctccaccgctggttcagcgtctccatctcctcccggctcatcggctgcctcctgaccccgaccttctcctgcgccaaaaattaacagctctcgatcagtcaccgacgagtgggcccagacagccggatcgcgggggccccgcgctgtcagtggctgggggacgtgacgtcatgggggaggtgaggtgacgtacgctctggtggagcgaggcgtactggagcgcgcggacgcgcttgagggcggcctcctccctgctccggctcatggcgctcatctcctccttcgacagtgtgctgctgtcccaccccttgctcagctgctgttcctgcacaacaacaacaaccaccaatcgcccttcagattcttcagtaaaatgaaatccattcactggctcgcccaccgaaatatgccaagctctctctctctctctctctctctctcttttccctcttctttttactgttactatgagcattggcacttgcaggcatggatcgatggacagacaagtataggaaaagaagagccagattacagcagaaacagcagctgatggtgcaaagcaaaatgttgtgagtagtactactactacagtgctacactggacagtgctacattgggcgcaagaacagaagcaacgaaagaatcggggcatatgcatgtgcatgtgtcctggcgatggccgcgcacgacaccgacgtgacgcggccgggtcgccgtctgccgtgccgccaccccgcaccacatgccgcgcatgtgcccagcaaatcattcgcacgttcctactacctagctatagcagctagctggtgagagtgttcttttactactagtgttacttacgtggacggcggcggcggcggcgtagtacagctcccggcctcgccggagcagcgcgtccatgccgtcgggcgccggcgaattagcggcgttgtggtcgccgccggcggcggcggcggatgaggccctggcgcgctgccgcgcctggatcttcatgagcgactcgaggccgcgcagcgtcgccgccgtctgccgccgcaccgcctgcccccggatcagcgcctgcagccgcaccaaccccttcaacgctcgcaacgccctcctcgcctgtaaaaaaacaaaaagaaaaaaaaaaggattaaagcaacagaaaatgtattgatacgaagacatttttggtgagcgacatcaaattcactgaaaattggacgaattatcaaatcgctacgaaatccattgaaaatgggggctataaattttgaaggtttgaagcaaaaaattttagttgtttgttttacttacgaggtatccacggtagacggattggatcataagggcggcgtgttcgtggccgtacggcgtcggcgtcgtcgtcgtcgccggcgccggagccaatgcggccgtcttcccggtgaggcggaccacctcggcggcggcgtgcgcggcggcgacggcggcctctgcggccgccgcggtggcgagcgcgaccgccatcgcgtgcttgctctgctcgtcctccgcctgcctgatctgctcctcctccaccgccggcgccggcgccggcagcgcgaacgagtgctgcgtcttgagcttgcccgcgaacatccacctcttgctcttcaccttctgatcaataaatcaatcaacaacaccacctcctcgtcagctcaactcatcaatcaatcaaacgaattctcgcaaaaatttcggcaaaatttgtggcaagaatgaatcggtgcaaaccttgtccggcttgggcttctgcttcggctcggagacgaagagcctcttgatgcgctcgagccatcccctcctcttcctctccatgtcgcagctaagcttcgtgcaagcttagctactaactagccttactacacctcgtcagtgtctgaaccgagcaaaatctgaagcaagaaacgcatcgtcattaccagaaatgcagatgaaataatagaaatgaaaaacaagaattgggagtagtagctggcatgtctcaatcgtaagatccaaggaaatgttgactaaagcttcggcaggacgagggcactttgctgccagcacaagctactgttcgtcagtggtgacggtcacagtgtccgagcaaaacgaagaaatcaagaagcggaaaaaataaaattcagagcaggactgctgctgcattggattcggttgatgatttgccgttgcatttgtcagtaatctgaagttttaacagtttttaatcacgcagtgggagccatttagaggctaaagccaagtgagtgattagctgggtgctttcttgtgtcacctgctaaaattccaaatagtagtacaaatcaagcgaaaaacaccaaccggaatgcctagttttgatgcgacaaaccgcagctataagctgtaatgttcagagtgtgacgggtttctatctgaatcatctcatggcaactgaacaaagaaccaaccataacactactagacagctacatgcgtcgcatctgaatttactctgaaatgactgcaccaacgaaagaaggaagaagactgaagaggaaagtgaaaacaatatcgaatgaatcaaccacgagacccaaaagatgaactgaaaatcaagtgatccaagatgagagtaccttgcagagtaatggtagggatgctagctctgagtgatccaagaactctctcactttcagcagctgcttgtggaggaggtggtgatgacacagacaggaggctcatgtaaggcagatcatgctctgcctgccatatgagggaggaagaaccaatttccagtggaaagccagcaggtcatgcctcaccatctcagagagaaccccacatgatgacatgaatcaagagcgctctctctctctctctcaatttatacggagtacaagatgtacatttgcaaagagaccttcagatttggcaaggtgtgaaacgccctgcttcctctgccatgtctgattacctcaagacccctctcaacttaagtactcctacttaacatgtgagcttgccgctaaactgagttgttgacagtgagaaaagataatactccctctgtcccataatatatgtgatgttgaaggaaatagtactagaaaatgtcacatccctctaaaatcttttagattatgagacaggggagtactatcaaagtacatgtgtgatgtgtgtattccttttacattgtatacacaaagaaaccaaaaattaggtgatattttacagaaaccaagggctaaaagatgcactttttttttcagcccgttgatgcagcctgcagcgtgtggtacattggtactagaaaacaacaaacggaacgggatggtggccacttgagaagtaaacaaaaaacgaaattaaaagggggatcaggcaaggcaggctggtccgcagcagccgcagcaacgcatgaatgaaagtcgtttttgtgggcgcactgcactgccgccacagctgagcgctgtctgaatgaagaattgaagatccgatcaaagacccccaaaagccgaaaaacaacacttgcttaaggacacccatcagcagtggacctcccaaccacatgtctctctgcttaagcttaacactagtgcctgtgactgagagagagagagagagagagatttggaggaagtgacatctctccagtccaaacatcttttaaaaagaaattacgagcgtgttagaaattaaacataaaatcttaaagttgaaaccacacactctttgtcattgcactaccaagtgcatcttgtgactgtgatcaaacacacaacagggaatgtcacataaaacattatcacatttgatcagtcttcagaaaaaaaagtttaaaaaataagaggaaattcctactttttaaaagggcccatcgaaattatatatttttataaattatagacaccgttgtgtttcacggggattcgatggtttgccactcttaaaggatgatatggtccacatgttattgacttaaaggatcatacatgacattgtcatgcggtggtgatggtagcaatgtaaagggtgggctgggtggcaaaccatcgaatatgccttttattcgtccgtgtatttaatcgtgacttcgatttacgatcagacggtcgcgatgttggatcatcgcaaaaaggtgttggctacgtgggtgattattactctttatccacaaaagaggggaggatggcctcctggacggtcaggaatctgtgatgaaccctaaaggggggcactttgctcaattgatggcaagaaatagtaccatttgacctgttttccacaggacaaaggttggaccttcagatccaatccaccattggttgcatcttgcattgcatggaaagaaaggcaaggcaataatgccagcaaccatgtgggcaggccatgctcctccactgatgagaggagaggagaagaagaggagaccattagaccattgccagcctttcatgcacacaaagcctagatatctgaacaattattaaagccatcttaacattcagaaaaggaaaaatgctactactactactactacctctcactctctgagatgccatgctagtgatgctgccacaatcaattcaattaaccttccataagctcaactgtagatcttggattatgcagagcaagaggaagtaaagtaaacagtggaattgcataatgtggacagtgttaggtgaatatatgttatgtcctgctttgatcttgcattgctgcagctctgtgtagtgtactgctagtaggccatttaggggtggtcatatgagcttaccctttttgcacttttgtcaaggttaagctgtaacaattgttgcactcatcactcagatggtaacctactgataaacaatacattactgccacttaatgtaatgccagatcattggtaagtataggagtaaatactaattactgttgggtggccagatgaatcatcagcttcttcagaaagcaaagacaggctttactcacttatccctttcactactgcagtagaattcaatcagatcagtaatacttcagtcttcagtcactgtgccctgcacatgtttatgacctgcatctgcatgatatggatcacatatctcatctcacacaaacatccccaggaacatgttgcagtgtttttttttctgcagagatgagttgtttgcatgtgtacaggagtcgaagggaccaagactttttgcaggctccctgccaaagattctgcatatgcatatgcattgccagccaaaatgtgaaattcagccagggcatggaatcaatcgaagtggatagaatagaaatcggtctggttttttaagttggattggctccaagatccatgggaaaacttgggttgacttgggagctaattaagctggaagaagtgtttttacaaatggttaagcttgtattgagatcttaaccagccacagtttttttactgtgcgtctgcacaccctgcaagcaagcatgagtaataatactactaccatgcttgggctagtgatcttagtactaaaatgttgaggtaattacacagcctttgagtcataggcctgtgtattactgattgttaataccatgcttatatattatcctccttattgtgcactttctgttacagtctgcttggacaaactcccaaggattgcatgtaccttcacaatgattgtctgaataatgtaattagggagctactactatacgtaggcagcttagctgcagctcactcgatgtgagagttaatctcttggttaagaccgacctagggttcaaattcctcggcagactgcatggatctttagaaacaaacttgattaatttacttgagcaaatatccggatcttgtcttctcattgtgcccttgatctatcacatcgtttggcatatgttagcttatcagcgacaaaaataatttatggatagaacttctataatgtgttcttaacggt

SEQ ID NO: 61713 - DNA, 80688 bp, Oryza sativa
  unsure (1)..(80688): unsure at all n locations
ttggtgggcgtctacgtcttcaccgaccggcaccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgcttttatcttcacaactgcgcgtcttcactaccagtttgcttctgttgccgccgactcgtgttcacttcatcacggcgatgcaactttgtcatcatggtagagcgacttcatatttattatcttcggcaccggcaaactctattgctgctacttcgcaagttttgctacttcaccaaccacgacgtctttgtgaacctcaacatctcggcatgcaatgtcgtgttattttactacaacaagtggctctccaacattcatgatttctacttggacatcttcaacacatatcttcaatcaagcaatgactattcgacgacaagaagctacagttctcgactctatgttcagttgtttcccaactaaccaaagagtcgggggctacacaaatacaagactcttaaaattcgacaagctgaagcaatcaattaatcagccaacgagtcaattccaggagtcattatcttcgtctttgctttagagcagagttatcaaccaatcacctcagtttcgacaagatggacaacatcatctactttcctccaagtgaagcatctgcaacagctataacaccaatttgatggattattgtcactgacatcatcaccagcacctctgcttcatcggccctgacatcaactctgttgctaatggatgactatgtcttcgccgacttattatttcactttcacggttgctattgactggatcaccgacattgttatcttcatcaacatcctgtcaagcctcttcaacatagcccactctactgctattgatgggcaacttcgtcattatatttgatcatctatgattgctgcttatcatcattactgtcggttgcgtttgtcgtcgccgactattttctttatcttcatgattggtggatttcgtcatcacctttgatgcgtgtctacatcttcaccgtcggcttgcttttgtcaccaccgaccggtatcctcgccttcatggatggcttattatgtcgccactaatgggcatcttcatcttcttcaccagctgcatcgtctgtcaccgactgattatttcactgccatggctacacaactttattgctgggcgccttcatattcattgctggctgacctgactgttgccaactggtttcttcgcctccacggctatgcaactttatcacttttgattggaatcactatcttcactactaccaatatttttgccacctctggtgggcaatattatctctatgttggtcgtcttgtctctatgccaactgcgtcagctaccatcaatggacaattgtgactacgacagaaggacaagctatatgctcaggggcttactagttcaaacacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatccattttggagtatcccataagggataatcactcagatcagaagctattcatatgagttacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgccaataccttaaaatccttttataccgcagttactcaactttttaggagttggtacaatgcatcttaaaaggtgtcaaacagtaaagctttatatagctgtcccgctgacttttttatataagtcaaggtgctgtttgggtttttaagcaattgattggatacaatatcattgctttttgccacgtaagtgtgtatttttattgaccaatattatggcttaggctgattatatattatggtcattttccaggcggttggtaaatcctttatgagtttatttactcggattttacaccacatatgccatatatttccgggtgtggtgaaaccatgtgtcttttagggacttaagcacatctgttaaagcagtgtgcgcatggcgtatgcccaatactttggaaatttctttattcacagcattcaagcttctttatagttgttttgctatgtgaactttcaaaaatgttatcaactttaggttgtacgcattatattttgccaagcagtcggtatatcacttggatcatattattcggggattcacaccgcatatgctatatgttgatgtcaagtcacttggttgattacaattatcaaaaccactcggttggttagattatttattccttgactatatgtttggttggttcaattaaccacatagttgggggctacacctattaggtgcatctattcgatgcacctgactttatttttcagccctccacagtcttcaaatttggtaaaagtacccgggagaccatggcgaagatgattgaagcactcggctttggagtaatctagttcgagagaagattatattttcgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccaacctatataaggagggcagggagcccctctaggggcatgagacaacctgatcgttagatcaatacacactcggcggattcaaatccccaaacaggagtagggtattacctctcatcgagagggcctgaacctgtctaaatcctttgtctctgcatccatccacttttaggtctcgtgcgctacccccttttattattgccgaattcatgtttcgacaaagataacatcatcgaagggggcgatcacaatcgtcccctctacattgaaggaaacattggttctgctcatcttcgacggattctcattgacccaggatctgctgtgaacattctacccgttcgaagtctaactcgagcaggtttcacaacaaaagacttggagccaacagacgtggtgatctgtggctttgacaaccagggcaagccaacattaggtgccattactatcaagatccaaatgtctacattcagcttcaaggtgcggttctttgttattgaagccaacacatcatactctgctctcttgggacgaccgtggattcacaagtaccgtgtcgtgccgtctactctccatcaatgcctaaaattccttgacggcaatggagtgcaacagtgcatcattggcaacttctcaccatacactattcaagaatcataccatgccgacgccaagtattacttccctgttgaagaaaacaagcaacaacttgggcgaacagcaccggcagccgacatcattattgaacccggcaccgagacaacccctaaggtgagacgcctcattatgccatgctccccaatcattagcgaatcttcatcaaggaatcgcaagaatagtaggcggggaaattcttcttcagcaaccaacctcagcaccaagcttccatttcccgctgaaaccagcacgtctgccccatctactacaccaatattgctcaaagcaagacgctctacctcaacaccgatcaccttgggggcaacctctcgaggaagcaagaaaccgcccaaaagcaacagcgatgtgccaactaccatcaccttacaggcaagacggagtccaagcaaggaagccgcgcttgcacaacaaggagtggtcaagaagagagttgcagagatagagaaggtaaaagcgggtgctcagtgcatgcagcccccagccctctacactttagtttctaccccgttagaggtatgggcaattccagatccatcttcttctacatcccggaccattctctacaaggtcccacaggtacaagagtgtgattctataatcgaattccctaagccttattctgatacagaagaagcgtgcacgaccatgaaggctgagcctagaatggctcgcctattggagaaggcgggcatcaacctacagcgaaacaacaggttgccaccacctccagcagtatgtgaggactggtgggcacaagcggaagagtttatcaagaggagatgtaaagaacaaccaaagtacggtctcggctatatcaacgtagatgaacccgatgatgaagatgaagtatttgaagacgatatatttcattgttgcaccataagtaccactacaataggtgatgctttactccaacaacacccctttgaggttgcagctgttggggtagaagaggagctcgatgttgcaggggctcttaaacaacttgatgacggtggccaaccaaccattgacgagttggtggagatgaatttaggaactaaggatgatccatgccctattttcgttagtggcatgctgacgaaagaagagcgagaagactatcgaagcttcttgatggaattccgagattgcttcgcttggacatacaaggagatgccaggacttgaccctcgtgtcgccacccataagctggcgattgatccccaatttcggccagtgaagcaaccaccaaggcgcttaaggccagagttccaagaccaagtcatcgccaaagtcgatcgactcatcaacgtgggttttatcaaggagatacaatatcctcggtggttagccaacatcgtccctgtggaaaagaagaatggacaagttcgagtctgcgtagactttcgcgacttgaatcgtgcttgtcctaaagacgactttcccctaccaatcacggagatggtggtctattcaacaacgggttatggcgcactgtccttcatggacggctcatcaggttataaccagatcaagatggatccccttgatgccttcgacacggcgtttagaacccctaaagggaacttctactacactgtcatgccgttcgggttgaagaacgccggtgccacataccagcgtgccatgcagttcgtcctcgacgatttaatccatcattcagtggaatgttatgtcgatgacatggtagtcaagactaaagatcgcgaacatcatcaaaaagaccttcgcattgtctttgagcgactacgtcgacaccaacttaagatgaaccctctcaagtgcgcctttgccgtccaatccggtgtcttcctcggcttcgtcgtccgtcatcgagggatcgagatcgagccaaagaagatcaaggtgatacttaacatgccgccccctcgagaactcaaggatctgaggaaactacaagggaagctggcgtacatccgacgcttcatttccaacctctcgggccggatccaacccttctcaaagctcatgcagaagggcacaccctttgtgtgggatgaagaatgccaaaatggcttcgataatatcaagaggtacttgcttaatcctccagtactggcaactcctgttaaagggagcccccttattctctacattgcaacgcagcctgcctcgataggcgctctcctcgctcaacataatgatgaaggaaaggaggtggcttgctactatttaagtcgcaccatggtcggtgctgaacaaaactactccccaattgagaagttatgtttagccctcatatttgcattgaagaaactaaggcactacatgttggcgcaccagatccagctcattgcaagggcggactctataaggtatgtgctaagtcagcctgtgctcactgggcgactaggtaaattggccctgctcatgatggaatatgatatcacttttgtgccgcagaaagcaattaagggccaagccttggcagaatttcttgctgcacatccagtgccagatgactccccactcatcaccaatctaccggatgaagagattttcaccgcagagcttcaggaacagtgggagctttacttcgacggagcctcacgtaaggacgtcaaccccgacggcacccctcgacggagagctggggcgggattggtgttcaaaactccacaaagaggtgtgatctaccactcgttctctcttctcaaggaggagtgttctaacaacgaggcggaataggaggctctcatctttggtcttctcttggcgctctctatggaggtacgtttcttaagagcccatggggattctcagctcattattagacaaatcaacaatatttatgaggttcgtaaaccagaactggtgccatattacacagtggcccggaggcttatggacaagtttgaacacatcgaggtcatccatgtgccacgaagcaaaaatgcgccagctgacgctctggcaaaactggctgcagcgttggtctttcaaggagacaatcctgcgcaagttgttgttgaagaaaggtggctccttccagctgtcctagagctcatccccgaagaagttaacatcatcacgactaattctgctaaagaggaagactggcgtcaacccttcctcgattacttcaagcacggctctctacctgaagatcctgtcgagagacgccaactacagcgacgacttccctcatacatctacaaggccggtgtcctctacaagcggtcttacgggcaagaggtcttacttcggtgcgttgatcggagtgaagccaatcaagttctccaagaagtccaccatggagtatgcggtgggcatcaaagcagaccaaaaatgtaccatagcatccgactggcagggtactattggccaggcattatggcggattgcctgaagacagctaaaacctgtcatggctgccagatccatgacaatttcaagcaccaaccgccggctccgcttcacccgacggtcccttcttggccgttcgatgcctggggaatcgacgtcatcggcctcatcgatccaccttctccaagggggcatcgcttcatcctcgctgcaatagactacttctccaagtgggcggaagctgtgccactgcgtgaagtgaagagcagtgacgtcatcaacttcctcgaacgacacatcatctaccgcttcggggtaccacatcgcattacctccgacaacgccaaatcctttaagtcccagaagatctataggttcatggagaaatacaagatcaaatggaactactccaccggttattaccctcaagcaaatgggatggccgaagccttcaacaagaccctcggcaagatcttaaagaagacggtagacaagcatcgaagggattggcatgatcgtctttatgaagcactatgggcgtactgagtcacagttcgtaccccgacacaagccaccccatactctctcgtctatgggagtgaagctgtgttgccattggagattcagctaccatctctacgagtagcaatccacgatgaacttactaaagacgaacatattcgcctccgatttcaggagcttgatgccgtggaggaagagcgcctaggcgcccttcaaaatttggagttgtatcgccaaaacatggtgagagcctatgataagctcgtcaagcaacgagtcttcaggaagggcgagctcgtactcgttctgcgacgtcccatcgtcgttacacacaagacgaagggaaagttcgagccaaaatgggaggggccatatgtcatcgagcaagcatatgacggaggtgcttaccagctgattgatcatcaaggatcacgaccaatgccgccaatcaacgggaggttcttaaaaaaatattttgtataaaaccctgcgcctcttgttttcttgttttctttaaaaaaacactgtgagcttgccaacgtgcattggccattgcattgtctggtgctccacgttttgttttacaaaatggatgccacatcccacaaaaaaaatcaaaatggctttccacatatcacactgagctggtagaagaagacaaggcaaccttagaacacctctacaggattcaatggatgaccatgacagactgtgcttacaactaaacatccttcacgccaacacacaagtactacgggtgcatatttccgaggaatagcaaaaagacttgattgggttacttcctagtagcaaggtccccacgccttcgtgtccttcggtgtgcttcaaacctatggagataccaagccccagggaagactataggagaagagtaagaaagggctacctacctcaacacaagttgtggttcagtgtgcagccacttgccatccctgtgaggcatgtcaacaagggactttacaaaagaaatgggcctgcaaggattacatagcccacaaaggggaatggttgtcctccaagttctaaggatgccaagatcccagatcaatctcaacaaagtcgtgatgatctcaactcaagaaaacaatccaatatcaatctcaatgaagtcgtggtgtcatgaagccgcgaagcaaaaaaaaaagaagaaacaaaaagatccaagcaatcagtgatctccactgcattctgtcagaagtaggaggatagccattcaccatcctcggcaaaaggaaaaggccactctcacagccgttcccctataaccctatcttaattcagccatacctaattctctcggttcgatgaagcacaataccgggggcatgggactcgtggtggaacctagtgaactgaaaggctagagcatggattttcgctgccttctgaaagtatcaccatgtatgctactcctatacacaagcacactaggaagttaggttgacagggagcaatcgtcatggtcgttcggcgattcccgcgacacgttcttcggcaatcttatctgacgctaccacatagccagtgttcagtgggaaagccaacattttaaaagaaaaatcaacaaaatcattttcttgctaggtttctttctatcaactcacctggtttgctcgactctagcaaccatactctagttttttttctcttttcctctctctttttcctttttgtgatgcagggttttcgcttcacgtcatttggaggcaacataacactctgaagtcgccatcgggctatacatctttcaacctgacaggtcggcatcacaacagtcaagtggtcgcgtccggattgataagatgtttctttcttgggagcggggcggcgcaccaacgcggtcagcgccaagccgtgaaacccttcatgctgatgaggcaggcaccgtgatatatcaacggtctcaatcggtctgataaaatgtcttcaattgtggcatgggtctttttcgctgcgagtaggagacgatttcaagttattttgttggctggcacctatacttggtcccgacaaaattcctttaattattatttgaaggcatgaatcttcgcctcgagacctcaggaggacagcttatacctgaagtcatttttattcttcacctattctcaaagcgctagactttctgaatggtgctactaccccacatgggttgatctattatatgaagcaacttgtacagaaggcaaaccaggaattgatggaagagatcatgcatgcagctgcgtgagtacagaatttgtgcatgacactgtagcatggtgatgatgtgtcgtcctctgattgctcggccacattgccacaagatgggtttgttaaaaaggaattaacttaacaatgcaaactgctggctggccttggctcaatatgttgccgccgtgataatcaacagaagttcatatgtattcatgcacttataaattacagccatatattcccatatatcagctctcgggtcccggcaggatcttcggcgggttctatatgcgacggtggccacatgcacgcagtgccgagtattcggatacagaagggatgatacatattagcaagttgaaaaaaaaatgaagaggacaaaacacaagcactccatatatatcgatgaagacaatatgacagactcaaataataaaacaagtactcctaattaatgggtgcatgataatgccccaactttattcaaagattaaaaactagctagctgatcatctaaattaagagcgcttctaatgtgctttacatgactcgaaaaaaaaatcctaattaaggtaaaccaaggagaagcatatggaggctattctaattcttcgacgtactaccccgaggcgccgattctctacgatatgatagaatggcggccacctctggcggcacggccactgcaaggcgtttcctctcttcagcaagatgccccaaatagaccttcgcctcgtcacgacgctttatcagctgcgtgacgccatcgatggtactatcataaacttgcaggttcttggcggctgcctcctctgattccaaacactggtgctccttctccctcgcatctttggctttcagctcgtgttcctccgcctctttcttccaggtagcccctgcttgcttggacttctgaagatccgcggccacgtcttcacagccactcttgaggaggtcaaggtctggtagcacgtctgaacacgcactctcaagctttgctaaggaagagcgcgcctcgccttcatgagcagctaaagttctcccttcaaaggttaccgggagctctcccttaagacgttgcacaagtgcccccaagtaagacatcaacttctccaagtctgcggggcgtccaagctcgtaactattttcccatgcagcggtggcagcaccaatgtactctatggtgccctccttgttcaggggtttctccatcaaacaatcttggatgctaaatagatcctcctccaccatgtgggcgttgcgacgttcagtaagcgtggactttggaagctccagcgtcggcaattcgtcagtcgccgaactcacagagttaagttggagatagcgaccgcacgtcccgaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaaaagaaagcaaaggagaatatgacctctattaggagtctaatcatccttaccttcctgatgcttttgagtcgagggtcccggagctgaagcggcatcagccgccggcatcaccggagaagagcggacaggagcattagcagccggcacaactgaaggtacatcgtcaataggtaccggagcaacatcggaagaggcagtagctttaagtccacccaaagcagttgcatgctctatcgtatcctgagttgcaagtatattctaagagacaggttatcaaaccactatgacatagaattttaagagaaaaaaaaagaattggggaaacacggataccttgccagtgccatcagaagaagaagaagaggaggaggaggagtcgctcaactggacagcatcaagctccgtgtcgggaaccacagagcggcggcggcggcggcgatcatcgcttgaagactccgtggatgacaccctctcataaactacggggttttttcctcgcttctcacgcatggtgcggtctagctcggggtgtggagaatcttcaatacgcagaccctttttagaagatttcggcaatggaagtctgtcaggacgagcagttctctccttcttatgacgccagtcacgcaggaatttgattgactcgccgtggcatttgtatcctcctcgatcatctctacggaccgggatcttcgcgatatgctgggaagggtcgtcacccttggtctccatctattgcttgccgccggatcctcccgggagcttatcttcgacagtgtgtctatctcctgccgagcgcctgtcccatgttactcgcctgtcccccgttctctgcccgtctcgcgggacacgctctccgccgccccggtcgctggcgccacgctcgcctgcacccctggatgctccgtcttccctggccatctcaagatggttgcctaataaaaaagtacaggatgatcaagaagcgtcctaattccagcggctaaagaatcgacaatggatatatacctgtgatggagttaaacacctgaggcgccatattgcataatcgatgcacaggcatgaccagcaatatataggcttcatccaaattactcgtaactgccaaggatttggagtcctggccgatgacggtctagctttgtttttctttcgccgcacggccggagataagcttcagcatgggagtcctttcgtcgcatgactaaactctaccggacatgtattgcatgagccaacacgacaccaagttaatttcgctcgctccacgatcaaaatttacttggtggggggcatctgtttgatggtattttggcgattatatgtgtacacaagacttactcatgatggacaaagcaaacaagcagtttgtaagttggctagcttatcatttctatgcaatgctcggccatgtatatacacgcaaatacatgcatgcacaggcagctgggaatatatatacttggattagtatatgtgcatgtataattaaccaataactagccgtgtgaagattggctagtgaggcaatcacgtgcatgcatgcatgtactatagtagacggtcgtatgtgtgtgcatgcctgggtgattaagcaacctatgcatatccaagtgattaatcatgggctcggcccatggccgaagacggtagctgcctacgcaccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagctaagagataaaatcaaagaaggatatgaacaaataacaaactgatcgatcaagccttatctgcaacgaacttgacgcggaggaaacggcgcgcgaacgcggcgagcaccgaccccagacccctatataaggcgtcgacccctcggcagccaggggcattggcgaactcatccacacattcattcaccaacgcatctagcatccacaagccacccatcatcaacgcatctacccatccagcatcaacacatccatccatcaactctcatcggcgatctatccatcaactctcatcggtgatccatccatcgacgacacgcaccggcggcggcgagcgacttcggccggagtcccggtgtccggtaggagagggcgcgcgcggtgatccgatcatcagcaagcgcaggagaggagcttgatggctagtccaggtaaaagctagcaagattgtttcgttttctttcatctacaacacgcacacatccatgcatagggatccatctgcacgtatcgtcgtcgctggggaagttgcggtggccgattcatctacgcgtcacagaagcctcatcgatgccggtgtctgttcaagctgacgcagtgctacttgtccctggactcgacgctgctaattcaagccgctggtgatgcatctacccgaagctgcgacctcgtcgagataccagacattcttgatttgcaagcttcaccgcactggagcgggctaaccatggaggaggtcgtcgggaagccgccctgccggagcgcgccgaggatcgccggagctgccgccgactgccaagacttctatcagttctcatgccggaggtcaagcatcacgcatggcgtcaaaaccagcggatgatgatggaggcaagtatggctgcagtacagaggaaggacgacgggaggacggcgagccagtgctgttggatggcaacaagctaggtaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccgccgtctacatcaaccatcttcaataattcctccctgattcttctctaatctaatctcgacgcaacagctgtgacgtcaagtcgttcaagctacgcaactccatgcatgtcttcaccaacaatctacatcgacacgttgttcaagaccgacgaggctagacaacggagggtgggcaaccaacaccggcgcacggaccgacgaggccatggatcgctgccggcgctcacacacacacacacacatctacatcatcatcacaaccatgcatggagaacgcgaagcgaacacgacgagatgaccacaagcagcttaatcggaggttctcttgcaggcctagacctatggaggtaattaactgggagcttctcgaggccccaggaaccaggagaccacatcgcacaagtcagatctgtccaatgacatattatggagcgcgcatacatatatattacattgggaatttgtatttatgatcttttaagattaataaagagcatgttccctatgttttgtttacattgtgtatttaggtacactggcacgcccgcacatatatgtatctctaaacaaatgagatctcagatgttattttccaccctaaacagttatatcctaacttagagacggatgatatggaatgaattagaggtagcagtcacctctattataaacttgctcttaggtttgtctcgtttgcctaaaatgatttgacactagcaaattgaatagggttgtgctgaaaaaagaacaattgcacatcttaccctattttgaaggcgaactatcaatgtggtcatatttttttaacaactttacttgtttgatcctacttttcaaaaccaaagatatggtatgaccctattctgttaagaccatataacggtgctaactgaagcccaaaataccacttctgtccttgctcatttgaccatattttcccaaagcttttaattagtttgactagttttgtatggtggaaaattaagaaagatttttttataaattgtgcacttagtgtaggggtttacatatatgtgacaaatttgacttagatttgctagatacttcgttggaggcatcatcgtcaatttgtgtcaagcaatagctaagaagcaatccacattggccatcctccccaccccaggatctgaacctgggtcgttgttggcggttgacctcacctctaaaccctatcccacccctgtcgatcgtctccaccgtcggtgaacccctaggccaccaccattagggctcgatgctcttcctgttgcctagcacctctctgcacagattggtaggccgtcctcgcctactatcccaaccttctctgtgctcgcatttgtggatcttcatcaggccacccaccgctggcgctgtcctccacgcccctaggtctccaccgctcaaggacgtcacatgggacctcaccgatgctagcaccgttgggacatctccgtctacgtctccacccgattggctgctagacttcctccccgcgcactgccagggggcactacggctcatcttcgccacaactccgcttccttccgtgccggcgtgcagctcggcccccttcctcgccagcttgctcctcctagatccccgtcgcccgcgctgcacaacacccactatactaccaccagtcggccttgccactcaccgtttttctccaccagccctcatcgtcggccatcatctactggcggctccctctgctcgggagatgtccctctccttgcacctccgctggtggggacatttaactccatgccacttttaagacgtggcaattaattatttgccactcgttgtctgtctatgacatgtgggccctcatgtgtctatgacatgtgggtccagtggcaaataatttaacaccactcgtaagagtggacctaagctaatcgccacaactcggctccaccggccttacaaagcacccacctctttgccaccggccctgtcaccctcagggtttacattaccgtcggtaaccgcgcggggtacggtaatagaaaaaccacggtaacctccttaaattcaaataaatttaaaaagtaatttgaatttttgataaattttgtccggttaccgcgcggtaaccttgcccccagcggtttgggaaaccctggtcgccctactcggggcgcctctccgtgtcgcataggaaccgaacctcaccccgataatcaccatcgttgtctctcatccttctatgttcatgccgcaccgcctgtgctcctctcctctctctggtttagaccagttgagacagggatagggatagatttttgaggttgggttctattcccttcccgcatttcggtctttcttactccctccgtaccaaaatacctatcattttaagtttttgttgtagcgtttgaccattcatcttatttaaaagattatgaaattattatttatttttatttgtgatttgctttattatcaaaagtaagtatgacttaccattttttatatttacactgtttttttaaataagacgagcgatcaaacgatgtaagcaaaatgtcaaaacaacatctaatttgaaatggatgtagtatattctaattgcatctttttaaatttgttgctaacgtcgtggtcagaataaagtcaaataatagctttgatttttaaaaggagagtcaatcaaacaaagttaatagaacaaggtcattaaaataggatcataggcacatttgtcccttagaaaaaagtaaaggcatagtagccagtaatgcgcgttgggcccctagcctagactagtctccatgaatgcggtgccggtgtttttatttttcacgtttggacggcatttgactctagtgtctgccacctacttactccgtttttagaaactaatttagagtattaaatataactacttataaaactaattatataagtgaaagctaatttgtgagacaaattttttaaacctaattaatccataattagagaatgtttacggtagcatcacataggctaatcatgaattaattagtctcaatagattcgtctcgcgaattagtctaagattatggatgtgttttattaatagtctacatttaatatttataattagtgttgtctagatttattgtactataatatatcacatctagttggtttttatgggaagaagggagtacggtacacgcaagcaatgacacaaacacccctgtcctgtctcaggctctccctcgctcctcttgggctcaaacaagaagtggagcagcagagacaagaggactgattgatgaggccgcaaagcctggctgcctgcctgcttctttcccccactccattaatccaccaccattaatatttcttgcgctagctgcttgcgatctgcgagcactcgcactcgcagctgctgcaacaaaagaagaagacggggagggagggaggatgcgggagatctggagcagcttcggcctctggatgctgctgctgatgctggaagctgtttcccctgcaaagatccacggtcggtaaccaaagcttccatgcattctcctccgagtactcttcgatctactactcctatatcaagtagtactagtagtagtagtatgcagtagtggagtagtatgtgatgactaagtgaacgacgacgacattcagggaaccccgcgaacgacctggtggcgctggtgaacgccaaccggacggcgaccaagctgcctcatctgcgcaccagcgctggccttggctgcatggcgctgcagtacatctccgactgcattggcattggcattgggtgcgccggtgacaacacggtggcgtgccagccccccgaggcccacatcaccgaggtgtacgccgccaactgcggcgtcgagctccccacggtggacgtcatcacgggccgcctcctcggctgccaccgccagcgctccgacgcggaggccgcgctggaggccgtgctctccggctccggcaacagcaccgccgctagagcggtcatccgcggcaaggagcacacccaggtgggcgccgggttcgaccgcgcgcaccgccgcgggcccttcttctggtgcctcctcttcagcagcggcagcgccaactccaccttcctgctcgaggccgccggcaagggcgtccaccagtctcacggctgcttcagcgtccctgacaacactagtctctctctctcctgcagcagcgccgccgccgctgctgtgcctttgctcttcttcatcctcctcctcctcccagtactacaagtttattattagtacttaccggtgtatctcagtgcctgccggtctcgttcctttttctgattccgattaagatacatattttattttgatttgtgttagcatttttttaattattaaatgtatgcttagtaagaaaatggtttttttctaaaatatcaaataaacctattttctaattaaataaatcgaatcctgaggggtttgtcaaaaaaaaaccgattctagcaaaaaaaacgagaaactccatccaatcgtttgtgggccatactaatgaatacggagggtagtagcagtggatatagagggcaacgacctcccccgtttacacgcccaaaccttatctcttcccaagcaggggcgggcccagctataattcaagggtattcagatgtataccctaaaccctatacccaagatttttagacaaaaaataggtatatatactctatagttcatatatgtattcaaaaagttaaagaaaaagacttaaactactcatttgggcctcgttttgccatttctttctctattgggtctaaattttccaccttcctccccctttcactcggcccgtagtctacttgggccgcaactaagaccatttcgaagccaaactcacctgccaggcagctaacccaaaatccccaattcccaaattccctaacctaaccctagctttgcaaggagacgggcggcggggggcgctgcgtgcggcgtgcggtgcggcggcgggcgcggtgtacggcggcggcgagccggcgaccgcggggcagccagccaggcaggggcggctgccggctggacgcactggcgcagcatctcctagggtggcggcggagcgggcgcacggccgtggaggcgtcgacgcaggaagaggaccactcggcttggcgccagggcgcggggcagcggctgactcgtgaggcagcggcgcggcgcggcctgcggcgacagcggcattgcggcgcgacgcgcggcctgctgcgacagcggcagtgcggccatggacgacaagctctacccgcctcgaggcccagcgcgaagaaatcaagtcccgagccccgaggtaacgaccgcaccccccggcgatccttcctcctggtttggtttaatccctagctcctgtctcatgtgaatcccctcggtacttaggttttgcatcaagatttcagtttcgcatgattttctatgtttagcatccatgtgttcctgatcctgatgttggatgaactagtaatgggctaacaacctttttttaattgagattactagcgacttagcaaacatatttctgtgcatcatatatgctaatttgtgctttgtatcataatgtatgaacttgagaagcaagatagggcaacaatagttgaatgattgtttagttacattcattgaaagagaatttttcttgcaaattaaagacaaggacatcatcacttatttccaaaatatcaaacaacgaaaagttgatctccaaactgtaagatttcttcccaatttatcattttctaccctttatgtatttcatatgttggcactttgatatgtttactaattagtattctatatgttaaacaatttcaaatgatgatcaattctatcaatgtgtgaatttatgctcaattttatgctatatacgctatatattatataattattagtttgtgatactatacaagccaattagccaattattaggtttttaggtctatgaacaaattttttttacccctttctatttcgaatacacaagtttaaaatcctgggcccgccactgttcccaagcctctcgcatctctctctcgttctctcgcggcggcgtccagatgtggaacctcgccgatcctcctgccccttccacccctctccccctccctcctgcagtcctgctccacccctcactctcctctagccgtgattttctgcgtccgatgcggcggctgggatgtggcggctgaggcaaaggtttgcggggaagcaggtccattgaagccgacggtggcgtcggatggatgcagcggcagcgaagacagtggcatgctgttttcatggagaaggtggaggtgactgctggatgcggtgccgttggggatctgatgcagatttccttttttttctctattcttggttcttctatgttcttggtacttgctagttcatacaggtgaattaaaatcatttatttttttccctgattggagggatgctatcttttctctgacaaatgtaaaaattagttctttcatctgaattgagagcaattcttttttttttcagattgctgagatgtctcttctttcggcagtgcaaatattcgatttattttgccttttttttctgtcatagatgtctcctgtatgtgttttttcatattgctgagatgttcttctttcggcagtgcaaaaattcaatttattttgccccttttttctgtcatagatgtttcctgtacgtgctgtactagtagtattaattaatggatatagatagcggcagtgttgaccttaatgagggtactttggtattttcactttcgtcctacctcgggaatccaggaatcgatattttccgggacggagggagtacgtaatagacttttcactttacatgttcgtacttaatttctatcttcattccatctcaaaacagaccttcgtcagagagattattacccatcttatttatactaccatcttattaaggaatccatttatattaccatcttatttaaatgtagtagaaatattttgaaagtagtataaatatgaagaggtatagttgtaaaagaaatatgaatataaatgggtaaaattgtaatgtaacctagtacagttaaggtaaagtagtagaaatatgaaggggtataattgtaaaagaaatatgaatacggatgggtaaaattgtaacctagcactcaaacaacattcttgtaaaccaatcatcattggaggggccaccaccgccagcggcgacggcttccttttcctccgcaattccatttatttcttcatgaaatatatctgcacaactgccgctttcacgagaattcatttaaataatacattcagatcgacttgaaaggagagctgatagcatctgattagtctattataccatgaatcaaaatttttctactgtattaaccagaaaccatgcaactataaaatcatgaatcattactactcaacacattgtgcagtagaagtaggcgttaagaagccgaaagaagatcggcgacgtagtgcacgtctatgttgaggaagcattgatcgcagcagtccaaccttctccgtctcgtgtgtttgccttgccgtgctctcacgtcgatcagcaccgcaaaccagcggcgtctctaccgatatctacacgtctaaaggcggaatgccacgcgcggatgtgctagcgcccgcgtgtggctagggtttggctcgggagaggacggctagagtttcttgtgggacaccagtcacatcacctcaagaatatataagtaactgggcctggagacacataagaatcatactcggatccctatccgaattaagtacatattggatcttcatccaattctcttatttcggcctattgagtgtgtgactccgtaggttcatgtacactctgctacaacatggaaactccttttcagtccacgtgtcaacagcggctcctagcagaacatacataaagatcatatcgattgaacctttatatacacttgtatgaaccccttcgcctcacgatatcgattaagctcaaggttaaatatgtaccatcctttaatagctcaatcattcattcgatcttttgatagattatttaacatgtaattgactactcaatcactttggcatggctatgtacttctataatctataacattgaggggcccagagatatctctccataggaggggcacatccatcttgattattctatcccactacatgtttcatagcatacccgaagactacttttataactactaaatcacggagtagcgtttggcagtcctaagtaagctactacatatattgggaatcataataatctcaggtctaaggatttacactaacactaaataagatcactgatggcacgtcatatatagcctctcatgttagatctatccaacaacatgttttccaacatgtgtccacattattaatttggtgcctccataccatgattcataagacatgatcattcaatacatgtgttgatcattaaaccatatttgttccacatatgatatttgattaaggattctttagaaatagcaacatacaacataaaaaggtcacatgaataaatcacatattcattaaccaataatgagttatctatttcaaagttataaatatagtatgtgatgcaatcatctctataattaattgtaaggcatatcagcaacaataacaagatcaacggatgcctatatataccgatcgtttgatgtagccagtccagatgccgtgtgtgatcatgccaaggtcaactgcttttgcgcttttaacttcagtactgttctggatttcgatattacggtcttgtttagatataaagtttggatccaaacttcagttcttttccattatatcaatatgtcatatacacacaacttttcagtcacattatctttaatttcaatcaaaatctaaactttatccaaactttacgcttaactaaacacaacttacatatggccatgcaactcactgtgaaaaacaaagagggagacataatggcgatgccaaaatgatcctcccatcgaggacacggcaccaagcattgcaagaccgctagggaaagagatggagaacgatcggagagtagaatataaggttatgataaaattaatcactgatttaataaaatgctgatacgtcatatcgattcttactggtagcttattttaatcaacctagcaagctggagtggtagtagtatattgcaaacaaaccgacctttcccgtgcaagccagaagcccagaaacagggaaggtaaattccctttctcatccgcataactagcagaagcacaacactagcagatatagatagattgattatagatagaacaaaagaaaccaaatgcgtctggactctggagtctggacgaccttagagaccaacaccacaaaggcaggaggactatattatatcttctgccggtggcatctagcgtaattatacaaacaagcgacgattgaagccagaggctacaaatgaagggatacatcgatctgcactgcactgtctaccatttaattacaagatggcacatcctttctgcgcctttttcttcttcttcttttgctttggaggctggagaaccaccttaatcgcagcatcgaaaactgccttgatgttctgcagttgcaaaggcaaagcagcagcaatcagtaaccatgccaccgcaatggagctcaacgcaacaagtccattttactcccttcaactatatcaccggatcagcattgattcaaaaatcaccggatcagcaatcaaacccctcaactatatttgggctcactattttttgtttctctttataaaagttgtatgttaagtttgtgggatgataaatcgtattacaccatatgtctcaacctttttatatatttaaaagatcactgtttgcacaagttgcaagcacctaacactgattaaacatggagatttaaaaccgcatgtcaattgtcatgaaaaaactgtaaacacaggtcctgttgccgtatgtggagaataaaaaagtgaaatggtattagggagtagagtcccttttactagtttaaggggtgaaccataaaaacctaggccctttggcaaaataatttgagggagtaaaatgaaccctttttcaaaaaagaagaataaaatgtagtacttgctgtgtttttgaactgcattcaatgtatgccgctgcaccaatgagtttcctcagctcttcgccctacattgattagcaaaataattttaatgacttgtgtaacaatgctgggaagcaacaaaaatacaagcaaactaagctttgaatacctgagcagtggaaataggtacagcaccagggtgatctacgaaaaattgcttatcatcccgcagatctattaacagtaacttaatggttaagcaccgccggattacatcaagtacgcaagtgattaataaaagcacaatgaacagaaaagcaaaagaatattgcatttacatgctgaggctaggacatgtttctgaaaactatattgtgtatgattgtatcaggagcaaagtacaacttgcaccaccaaagctgctacatcgaacctgatttctaactccagtaatccaacttaagaacataatctaacaagagcccattttggtcagtgaggactaagtctctaaccacctaacttgcctctaaggccagtaagttgacaaggctgttagctgtacaggctttatctatttataacttgctgttagctgtacaggctttatctatttataacttgctccgctggagcagaaattcaatggtgaacatccattttgagcctttcaaatgttcgctagatgccattttaactgagcatgcagtatgaaaccgtgaataaatagcctacagaggatgtgttcccaggggacaatcctaaaagcccacctgccttgtgagatcaacagaatggaattctcatggtattcaatcatgcagtgtaaggtattggatcgggtcatatgtgcctttttattagcaacttagcatgaaaactagaaatgcagatttatcaacatttagcatttgctgaaggaacaagacaaaatatatttcagaggaattttcttttcttgatcataaatcaataagtgatatgtacaggaccaactggagtataggtcacaggcttaactttggagactagtaaagacccatttgcagggcaggatcgtcaaggtctcaatgaaatacaaacaaaaccattgcatgctcatttgtctctcaaactagctatgatactcaactgtcatagcatgtgaaatgttgctgaggtaatggttaacaatcaagcaaaaaaagaaagcattaatttcaaacattcttagataatggaaatgatttacatctccagctttctaccataagacagccataagtttgttcaaaacaggaaaatgagccataaggtgatgggacaaacccaggcccgtcaacgagggcgtgccaacggagcgtcagcgcagggccccacaaaaatttggggcccccaaatcagagagaccagtacaaccagccagccttagcatatacaactgatgtcatgtgtgtgttcatgtgcatgcatgcgaaccagcttctgaatccttgatcaatggttacgatgcccagagcagctggccgactacctcgtctatcatattagagtttctaatactgaattgttgatactcaattgttgaattgcatgcatgtaatgatcaattgaatatttcagtactcttcttttcaaatcaaattaccatgaatataattacgaatttaaattaaggaccgaatcaaaagtaaatttaggatctcaaattatatttcgctccggggcccccaattcctggagacggccctggacaaacccttaactctcctttattattgactagcattaaaccacatagattttttatccagcaattctaatggaactatgccacccatagtggaataagagactcttagctaccgattccccacaaaatctaaatttgaaaaaaaaaaacattcagcgttagtctaaggatgtcacccaccaaaaaacaaacattcttgatataatgcatgtcctgcaatcctgagggacaccaggtcaccaagcatctacaaatgtcccctgatagcatataacacttcatgtgttacaggtaacatgtttcaaggtataatgccatatattcagtcaaaacactgctgggcagcaatcatgctatcgtcgaattcaaatatcttgtcttccatgaaaccatgttcacatagatttccacatgcaaatattttacatttaaatatgattttcagatatcataagcatatggctttgctgtgaataacagtaaaattgaatttacatatacaaacatgctttcatagagtgttcacagcacacaagcactcaaatgatgagacaatttataggaagacagcaatcaccactcagttaagtgcaacgccaagctgctggtaagtgggagtgaaaatataatagcttaattctacagatatgtgatgctttgcacaaatgctatgcaacaagagttggaagggcataccaagctttgttccaacgagaattattggcacaccaggagcataatgccttaattcaggtatccactgacaacagaaatatatatgtgtcagtgcaagataacaggttgactaagctaaggtacttcatggagagagagcaaagaaagtgggcggcaagattttattgcctttttagaaacattctcatagcttgctttgctgatcagagaaaaggccagcaggaaaacatcagcgccacgatagctcaacgggcgtagcctattgtagtcctcttgtcctgttaaatttgtcaaatttttatttattttgatgaccgtgaaaggtggatgtatataaggaggtttacgcatgcatccattaaaaggaggggaaagtagaacctgctgtatcccacaaccccaagttcacagtgctcccatcgaccacaacatttgcactgaagttatcaaaaacagttggaacatagtcctgtaacatagagatgaagaaatgtcccattaaacatacagtctgccaattaaaaatgcaaagatgcaatacattagatttattttttcgcacaaaacgaaaaggggtagctgagttactgacggtgattgacagaggtcacggttagaatgatacagagctaaaacaaattcaccaacaaagagaaacgtctagaggtcaatggtggcgattagctacggaatgatggagccacggttagtaatagcagacaaaaagtcagacataccgcaacatatatttatgagtttattatttactcctgatagtaatacaacaaaatctggaggtgaagctaaagagtgtatatttagatctgtataaggagtgaatgttggcagctgagaaatcggcaatactatcctaattcctatacctggagaagaaggcacctggatcccgcagagagaaggacgcgtatagaagaataacgttatcataatcatcagtccccaaattttagcaagcaaaaagggaaggaaagctgatctatgtcttctctacacccagtccccagtccccagtcccaagacaagaaaaagaatgtttaccatggagtcgatcagatgcatactcgggcgggcaggaaggatcgagaagaagaaggggggaaagaacggattgcctaccgtggggaaggtgttggaggtgtaggagatgagcatgcaggtcttgcccacggcgccgtcccccacggtgacgcacttgatgaaccgagacgcgctcatctctactctcactcagcacagccagcgcatccggtaccctagatcccgccctcttcttcctcctcagtcctcactccaacgccacggacctcacctcagctgctgcttgctggtgggggtaggaactaggaaggcgaaccagaaccagaagcagaagcagaagcaaaagccgacagacactgagttgcactcaggtccaacaaaaactccactattacattaccttcctttcatccctactagtactagtagaataagataaaacattttgcagagaagcccctattcgatgaacatggtgtgatggcgatcataataacaacaattttcgaccctatttttttattattacatttatactatacgagcctagagaagtaagaatgattgagggattattatttcttcaaaaacatatttttttaataatatatttcattcctaagaaactataaccaattattacagaggtcgtacgatgaatggatatgaattacaaaatcacgggttgattaaaacataagaaagctatttaaaataccaccttaaagattgaggtttttcatctatggttgatgagaatctacataatcattgtttcttcaaaatgacatacattttgtatgattttttttattaggggttacaatctattaacatatcaaaataataaaaaaagagtctccatgttcgctctcacggcctaaaaattctcatattaataaaaaaaataaaaaacgagtccatatagaaatacaatttaaatagctaaaattagaaattaaaaaaatattggaagaagagtccataaaggaatacgatttagacttaattgaaatttaaaatttaaaaaataaaagtatagtcaaagtccatatagaaatacattttagaaataaataaaattaaaaattaaggaatatgggaagaagagtctagagtccatataggaatacaatttagagataattaaaattcataaagtttagagttcataaaggaatttaaaagaattgaaagttggaattaaaaataagaaaaaagtaaaagtagagtttacagtccatgtagaaatacactttagaaagagtttagaaataactgaaatttggaatttaaaaataagaaatattagaagaagagtttagagaccatataggaatacaatttataaataactaaaatttaaaatttaaaataaggcatattgaaacaatattatagagtttatatagaaatataatttacaaataacaaaaatttgaaactaaaaaaatattcaaataggagtaaataatggaacttcgaattaaaaaataaagaatattggaagaggaattcatagtccatatagaaatacaattcaaaataactaaaattcagaattaaaaaaataattgataactatcacgtgtatacaatacaatataaaaattatatattggttagtttgttctacttagtacataatttcaaattatgttgccattctaataataatatatgaaaatatatatgttatttatgtgagaaaatataacagtgctagccgagcaatctgtgcgggccaccatgctagttcagaacaaaatgactatactaacattgttttccaaaaaaacaacatcttgataatcaataggtgatcattatgtcgatcgatgagcatatatctgttaacgtcaaaattggtaaaatccaaagttatcattcgcctagaggaagtatcggcttcatatacctaaaatgggtcgatggatattatcagcctccaatagttggattttttatggattcagttaaggaaattaattaattaaaagaaggttatccagaagaggccgagtttaaggaggatgcggtatgttaatttatctattaattgagcatagtcagttagttttctttttatttcgaggaaagtgtgtttagtatcttttctttatctttaagaaatattgcgtcatgtcaaattaggactcttatcggcctatgggtataactatgtacaccctggatccctgtaatctatctccacaaatattctcagtgcatagctgccctcttttgcaaggttattatcaccaacagaacttggcacctgacgcggggctacatcggcttcgatctctggcgaagaggtaaaccctaagtttcattagccctggtcttgtcttagtcgatatatctctacaatcacaatatgattttaaatagatttgttatatctatcacattagatagattcatcgacttattgagtattaaattatcatgtacaatctcgtgctgcatcggttagttctaacctactagattggtaccgataatctaaatcttgttaagcaaataggtgcatgctaatgtttcatcagaggtttagtcgatcttatctgatgtattaaatttctctttgatggtttttctatcttagttaaatttaatgcatgacaaatttgatcggtatcatctcggcttgtttaaatctattaggcaattatcaatcttatgctgcatcggttaggctcgacctatgaggttgttgttgtaagttatatttatttaagtcagtaggcatcaatcattgtttcatcggggtttcagccgatgagttatttggacattgtttaagtgttctatcggcttatagagattatatacaagttggttttagctgattgcaacaaaagtttcattgattacttaatcatttggatttaatgacatcgggttttcagccgatatatactttaaccatcggattagtatttattcaatcatactattattggtccattggtttttattgaattatattgttgtattattataagttcactgcttgtccaattatctttgtatcatttattcaagtatcagaatctatatcggacatatagctgattgttcaaaactctatcgatatcggctattaccgctacatcggcttattggccaatcgactctttgatcatcgatttatctattttatcatttgcagaatcaaactggctagcacgctcgcatctcatcaataatttaggacctgcactaaaactaagcagatctacatacattaatgttttcagcatcaacaatatcatcggcagtaactaatgtcgaatgaaagcggaagatgacatagaagagtaacttagctataaacagtcatccacccagatttgacataaaacccagtaaaccaatctgataaaaacgcagccaccaagagtatcgcaccaacataaaacctccgatgccattactattccgcccatctgaaactaagttttcaccaggaggatctatcagcatcacctccaagaaggcgtgtggtgcccacggacatcaccgatgtcgatgctcatagcaacgacgacttcagttgcagatttacggtgatttgtgctcgacctcctcctaggctttgagtgacagcagcgacggtgacgggaggtggcttgcaacgggaaggaaggtggcgagttgcgcgcgccggcggcaccttggcccaccatcttcaccagttcgatcggagaggtttacagcagcaatggggtagggcgaatgtgctgattcgaagctcccgtagcccgatggcaactacttgagcaacggtgttgagagcacgccccctagctaggatcgccagaagctggatccggccataaccaggtcgtcgaaaaatacagatagctaagctaattgctatgataagatctttagataggttaccgaacaatatacaaattaatcttgatgcacgcatgtatatatatattgctgttggacacttggtttaattttgaggagcattatattgctggttatagatgctatatatcgtccttgcttagcaatatatcgtgagtaataattgagatgggaaactattaactagtgtttgttggattggttctcgatcgatctgcagagaagcggaggtctattttgatcgatccgagactgagactctgccatgggccatggatattggaaaattaaaattagtaacaaattaaaagatgctatagccattcgacgttatattgttgttgtacataagttgagttgagttgaggccatacatgcagtgcagggatggtgtggtggataagataagatagtgtgatcgatatgatgctagtggaaatagctagctagttgacgcgcctgcagttggctcggacctcgccggcgacgttgttgagggagctcatccgtagcatggagtcgacgaagtcacggaagaaggcgggctgcgacgcggcgtagagcgtgacctgggcgcgcgtcttggggtgggtgagcagcgcctcgtcggaggagagaaggccacggccggagagcagcatccgatagtagaagttgtcgaaggcggaggaggtggggtcgagggaggagccggcagacctggcggtgttgttgggtgggcaggagcggcggagggtggcggcgaaggaggggtgaagcgcggggtcgacgccctgcggctggatgcggttctggaaggaggagcagtgtgcgaagccaagcgtgtgaccccccgacagcaccaccaggtccttggtcgacatcccgcgcccgtggaacgcctgcttcagctggtcgaagctcgccgtcggccccggtagcgccgtcgtcgtctcgctcgccagcgacacgcgcccgtcacgacgacccaccggcacttgccaagaaggaccaccggactgcatgcagtacgtacgtacgtttagtactccatctcatctagctatatattgatatactcctgtatttactacttaatttgattgagggccggccggattaccatggcgactgcgtccctggcggccagcgcgaggatgtcagcgcaggagacgacgccggggcagagggcttcgacggcggccttggcgttgtcgatgacgtagaaggcgtgcagcgacgcgttgggtgggccgtccttctccgccgacatgttccccgacgagtccaaaagcacggaaccgtcgcacccctgcagctagctagcagcttccttcattgatgttaatatatatatattcgaattcgatagagtagctagctagttaccctgacgaagcagtcgtggaaatgcaggcggagcaggccggccggcaccgtgcggtctttggccatggcctgcttcaccgccgccgccaccgccgcctccgccttggggcagctcttggcgtagtagtccaggctcagcgcctcgccgccacccaccagcatcgtcatagtcatcaccacaacgattagcagctgtaccagatccagatgggactgggacgacgccattgctgatgccattgcctgctgctgctctgcatcgatcgatccgtcttagagctaccgtgctgctaattaagctatgtatgtatgtatacctcgttcgtacccactctgctttggctttggagctagctagattattagacaagaataatactatatggtactggaaataataattattaattgtacgtatgtagtatgtatagcaccagcagcatgcggctggtagtggcgatcgagaagagagagctggataatactacattcattcatgactaattctcactgcattgcatgcgctttacaatacagacagagacagacggacggacagacggacagatcatctatctctatacttactcttggcctggcatgctcgcactgcagaatgctcctggcgtagtactactagcttagctgtgttgcattggaaagtgtttgcgatgcacagaaagaaatggagaaattactacccccaccccactcgatattggatccactagagctagaaagaagaaagaaagatgccatacgcacgcatgcatacaaacgcatcgcatgcagccaaggcacgtgccctctgtctctgcgtgctgcacatgctggcatgcactttgctactcctcactctcactcatgggctcatggcagtggcaggcaagcagcatgcagttggtactggaccagtgcaaccatttccaataggattatcatacattaccaaccggctggccatgcatccttgtccaccgtgacccttttttgtgtttcatttgtccatcaattaattcaaacacagcggccgtgcaaatgcaatgcctctctatctgttcgttatatcctagtacattactgtacaatttgttcggtcaaatctacgtcattaaacacatctgtctagatatctgaggcaaccgattccacttgtaccttcgttgctactcgtatctctcttcattcttactctgctagctagctagaaccaattaagcccggattaaccatccattaattctacaggcagcccacctcaaattggcttcgattgaagtcatttctatcaagtgtggctcggcccaattgtccttcatacttgccaagcttagcccactgcgcctttgttacccatccgccgagccaccttataccgaatcaggggtaatttcttattcgacccttttctaaattctatcttaaaattgacgtacactaatttttaaaactcatcaacatacaaatactcccccgtctcatcaacatacaaatgtgtcacatcatcacccattagcaattactcccccgtctcaaaatataacaactttagccctcaagatttgtcccaaaatataacttctctatcaacattctcttcccaaccaatcacaactctctaccatttactttttctacctacctccactactcaacaaatcacaacactgcatcattcacttctacctagtagtactttcttaataaccgtgtccacctctaaaaatatttatattatgggacagatgtagtattatttagaatattttaaatcacatgcaagtgtatcacatcatcacttactagaaattattatctagaatattttaaatatcatgcaaacaaaacataccatttatatttttattgtatttttagaactcaatatgcaaacaaatatcaaatcattatctccacatcattttcacattatttaaatatatacatctaccatttctataatatatacttcatctgtcccaaaatataaactttttgctctcaggatttgtcctaaaatataacaacttctccatcaacattctcttctcaaccaatcacaaccctccaccatttacttttcccacctacctccactacttatccaatcacaacccttcaccatttatttttatctactttcttaataatcacgtccaactctaaaacttcttatattctagaacggagggagtaacatgaattaattcatcacatattccgtagcaaagcgtgtggtatcaactagttttagctaccaatctaaccttactattttgagtttgcttaagactgaccatattccataaaggcaagataacatcgttaactaaaggtaaattgccatttttgctcttagtcatatcaccctgttatatgaaagatttgtttatttggaaacttttgacatatttataacaaatttggcataactttgaaagacttaagacaagtttggcatatttagcttcatttttgtcaaatttgacttcaattgatgcttgcctggccaagccagcaggggttttgcttgtttggtttgccatttccgcccgacaggaaaaggtgttgttgggtttcagattattattgctcacaagtgttaattggcaagcttatacggttgtgctgttgagggctatgtcagggttatgaataccacatacctaatagtagtcgactacatctcggcagggcccaccacataccatgtcctatacgaaaacaacctgcggatatggagagagttccggataaagaaagacaaccagagttctacatggaaacgaccaggactactcggattgtatccatattggtttccctagttctacttggacaaggggacacctataggtataaatacaagaccccctaaaaagagaggggagacaagacaatcgacagacgatcaacacgatcgagacccaccacaatcaacaaccaacacaatacacgagacaacatacaagccaacgtatgccaagacacgccgccggatatcaacttcagggataggcatggctattcccctacggtgtctccggataccgtcaggagagacgaaagcgcttgtggagattatggttaccccatatctacatggcggttatattccagctggatatacggtaccaaatatagatagaatatctttatgaggactcgggttaggttctaaacttgtatgtcaagaaaatacccgggatcctagtcggttacgattgtattttatctgtaattccatattccgttaggatatggattgtactttgtattacggatcccttcccctatataaggagggtccgtgtacctcttggggcacgatttcttttctcccaatcatacaatcaataacacactcggcggaatcatccccggacaggagtagggtattacttcttgaataagaaggcctgaacctgtataaaattccttgtctccaaacccatccacttttctagcttgatagccaccccttttattattgccgaaatcttgtttcgacagttagcgcgccaggtaggggcagcgtcaagttctcgccgactaagtgcgatgggtttcgtttctggcatcgacgacttcgccttccctcccgggcaggcgttcaggttcggcagcctcaacttcatcaccaacgacttcggcaagatctctctccttgactcggattcaaaccagttggggagagaccaggtccccatgcgagagagctcattaggcaacaagacgtcgacgggacagcggtctttcgcacctcccagcagaacgcggttgcagcaatcactctcctcgacaccctcctcaaggaagacgcactcaaccaagccgatcatgttgtcaacatcttgaaccagacgaagaccatgatcgctgccttggttccagccaactccgcaagcacccgcaccccgactggtagccgagtccctcacttccgatcccatgatcatcattagtcaagcctcagaatcaccggtacaggatctactcgcaggagcaggggtcacgacgaacgacctgttcactcgcctcccgaacgtcacagggagcgccgagctgaacggcctcgctctccacctcgccagcgtcccgttgaccttcgcgacacgatcaaccagcaccgtgcagcacgaggtcaccgccattcaccaaatcgctacgacgacgacgtggatggagtagctgccttcactagtgacctgcgtcgagtggattggccagccggctttaagccgactagaatcgagaagtatgacggcaccactaatccagagtcttggctcaccgtctacggactcgcaatccgcgcagcaggaggagacagcaaggccatggcaaactatctacatgtggccctagcggactccgcccgatcctggctccacggactaccccgtggcacgatcggatcatgagcggaacttcgtgatcacttcatcgccaacttccagggcacctttgaacgccccggcacacagtttgacctctacaacgtcgttcagaagtctggagaatcccttcgagattacatccgacgcttctccgaacaacgcaacaaaatctccgacatcaccgacgacgtcatcatcgccgccttcactaaaggcattcgccacgaggatctagtcggcaagttcggacgtaaacctcccaggacggttaagcagatgttcgaaaaagccaacgagtatgccaaagccgaagatgttatcaccgcgtccaaacagtcgggcaccacttggaagccaaagaaggacacgccgaccgcaggggggagtggaagtaacaaccacaaggatcgcaagcgtaagcccgaagaacttgtggcgaccacctctccatcttcccgacaacatccccgcgtcaacaccttcgacaagataatgaactcccaatgtccgcatcatcccaactccaaccacgtggccaaagattgcttcatctacaaacagttcgcagagcaatacgttaaaaacgcacggaaacctgcagacggagatcagggcacatcaaagaagaaagatgatgaaaacgatgccccgactgattttcaagatcatcgcaaagaacttaaccacatcttcggcggacccctggcttatgagtctaagagaaaacagaagctaacagaacgggagatcaatgcggtccagcctaacatgccccaatatcttcggtggtcagagacagcaattaagttcgaccgctcggatcatcccgaccgagtggtccacccggggcggtaccccctggtactagacccagtggttcgcaatgtcaagctccgacggactctcatcgatggtggcagcgctctcaacatcctttttgctaagaccctggacgatatgcagattcctcgcacggaattaaagccgagtaatacacccttccatggtgttattccaggattgtcagctacaccactcggccagatcactcttcgagttaccttcggcactcgggagaattttcgcacagaaaatgtttgtttcgaagtcgctgatttcgagacagcatatcatgctatactcggacgaccggctctagccaagttcatggccgtcccgcactacacctacatgatgatgaagatgcctggtcctcgagggatcatatcactacggagcgacatcaagcaagccgtcacatgtgacaaagaaagttgcgagatggctcaaacccacgagaccactctcgcccacgaagagatccgactggctgcgaccacggcaagcgagggagaagtgcctgcaaccaagctgacaaagaccgaagaaagtgatgccaagacgaaaaagattcccttagatccctccgatcctgacaagactactgtaataggcgctgagttagattgtaaataggaaagcgcgctcatcacctttcttcagaataataaagatatttttgcgtggaaaccatccgatatgcctggtatccccagagaggtgattgagcactctttacatgttaaggaagacgccaaacccatcaagcaacgactccgccgttttgcacaggacatgaaggatgcaattaaggaggaattaaccaagctattagcagcaggcttcattaaggaagtccttcatcccgactggctggctaacccagtcctggttcggaaaaagacggggcaatggcgcatgtgtgtcgattatacggacctcaacaaatcttgtcccaaagacccttttgggttacctcgtattgaccaggtggttgattcaacggccggctgcgagttactcagcttcttggactgttactcgggatatcattagatccgactaaaagaatccgactgcttgaagacctcatttattacgccctttggggcctactactacatcaccatgccctttggattgaagaacgcaggagcaacctatcaacgcataattcaaaggtgtttttcaactcagatcggtcgcaatgtcgaagcatatgtggatgatgtagtcgtcaagaccaagcagaaggatgacctgattgcggatttggaagaaaattttgcaagcattcgagctttcaagatgaaactaaacccggaaaagtgcatcttcggagtaccgtcagggaagttgcttggatttatcgtatctcagagaggcatacaggccaacccggagaaaatcaacgccatcctcaacatgaaaccgccaaactcccaaaaagacgtccaaaagctgactggttgcatggcggcgctcagccggttcgtctcacgactcggcgagcgggggatgcccttcttcaagctgctaaagaaaactgacaatttccagtggggatccgaagcacaaaaagccttcgaagacttcaagaaatctctcaccactccaccagttttggcctcgccacatccacaagagccgctactgttgtatgtgtcggcgacctcccaagttgtgagtacggtcctggttgtcgagcgtgaagaggaaggccatattcaaaaagtccaacgaccaatttattttgtcagcgaggttttagccgactccaagacaaggtatcctcaggttcaaaagttattatatggtgtcttaattaccgtcaggaaattatctcactattttcaaagtcacccggtcacggtagtcacatcgtttccactcggggatatacttcacaatcgcgaagcaaatggacggattgcgaagtgggccttagaattgatgtctttggacatatctttcaaaccacgaacttcgatcaagtcacaagctttagctgatttccttgctgagtggaccgagtgccaagaagacatgccagaggaaaagatggaatattggaccatgcattttgatgggtcgaagaggcttacaggcactagagctggggtcgtcttaatttccccgactggagaaagattgagctacgtattgtggatacatttttctgcgtcccataacgtggcggaatacgaggcgctactccatggattaaggattgcaatttctttaggcattcgccgattaatcgtccgtggagactcccagttggttgttaatcaagtcatgaaagagtgatcatgtctagatgataatatgaccgcttaccgacaagaggtacgcaagctggaagataaattcgatggactcgagctcacccatgtccttcgacataacaatgaggcagccgacagactggccaattttggttcaaaacgggaagcagccccttctgatgtgttcgttgagcatctttatgaaccaaccgtgcccataaaagaagcaattgaagccatggatactcaaggcgtaagcgtgattgaagccgactggagaaaacctctcataaaatttttaaccaaacaagaactccctcaagacaaaaatgaagccgagcggatttccagacgcagcagactttacattattcatgaagctgaactgtacaagaaaagtccatcaggaatactgcagcgctgcgtatctttggaggaagggagacaattgttgaaggatatacattctggtatttgtggtaatcatgctgctgcacggaccattgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctggccgttcgcggtctgggggcttgacatggtcggcccgtttaaaagggcagttggcggttacacgcatctctttgtggctatcgacaaattctccaaatggattgaggctaaaccggtcatcacgatcacagcagataaagctagagattttttcatcaatattgtgcatcggtttggggtacctaatcggatcatcactgataatggcactcaattcactggcggagcatttaaagacttttgtgaatacttcggcatcaaaatttgttatgcctccgtggcacaacccatgagtaacgaacaagttgagcgcgctaacggcatgatactgcaagggatcaaagcacgagtttttgaccgactacgtccctatgctggcaagtgggtagatcagctgccgtccgtactttggtctttacgcactactcctagtcgggctaccggccagtcgccgttctttttggtttatggtgcagaagcaatgttgctaagtgaagtggaatttgaatcactacgatttcggaacttcaacgaggagagccatgaagagggccgagtagacgacatcaaccgactagaagaagcccgagaagcagctttaattcaatcgactcgatatttgcaagggttgcgtcgttatcataattgaaatgttcgatcacgagcctttttagtcggtgacctggttctgaggaaaattcaaacaacacaggatcggcataaattatctcccttatgggaaggaccgttcataattgctgaagtcactcggccgggttcttatcgactcaagcgcgaagatggtactatcatcaacaattcttggaatattgaacaccttcgtcgattttacgcttaggcatttcgtttgtatctttcctctttgactgctaacttcaagtttttcctcgaagttttcagtcagggggctactataataataatggagtgtgatttttatcaattcaatttacttacttgatgtatcattgccctgtttgatttcttggcttagttaatgaggactgaaagttttttaacaacttttgcaggtttaggctcaacaaggtttgacaaaaacttttaagaaatcaggagctaagttaagatatcaagcacagcataaattcatcagtattgtacaaattgtgcctccatcatcattaatcatcaaaattatcggtacattaatcagtattagtcttttcatcatcagaattatcaggaccagtcggtcgaagatcagtgtcctgaaatctctcaactacatcagcagcaattttgtcagccgctttctgcgcatcactgatgaggtcaagagcagcttcttcgctcgtcccgtccgcaaagccatcaatggcatcaacgtcaactctcggataaagggatttggtcatcgccaacgccatacttgctcccatacttccagcttctttgatgttcttgaaatatgtatccgaagcaactctcagcttgtcgaaaatttcaaaagcatcaagtgcactcgggccgttgttattgaagaacatcgcttgaacaattggggcagcagcgttagcaacctcatcccgggctccttcaagttttttgatcttgccaactaggacatcaaattgagcttgagatttgatcttgcggtttgcatcaacagattcacattaataagtcagcatatggaggataatggctttttgaggtattgattgttgataccttcaacttcctttaaagccaggtctctctgtcttgccagctctgccttgtcattttccagagtttggatctgcttctctagttgagatatcttggcagcttgcactacattaacttcggttaatcaggataacagagataacagcacaaatcagttgggcagagtttgcgcaaaccttttgatgagccacttagttcaaaattggattcctagagctcagcaattcgattcctcatatcatgctcattttttctggcaagctcttttgtctcgtgcagcagactcctggtggcttcgagggtcccgagatgagggactagcctctctaaggttgccgttttagcttcgttcctaagatgaatcctctgcaagacagtttaattagcgcctagattaaatggcaaacgagatggttgagatcaggcgccaaagagcttacatttacaatgcgggtggcttggctgagtgcctttttcagcaagcatacctcctcgtcctctttttgcttatttattacgattccttgaggctgcatgttgtcatcccaccacttgaccagaatcggagggcgtgaatcctcagctgcttgtatgcggggaatttcttcttcgtcactgatcattggccctaatgtatccactgacagaggttagacgattgatcagagttatttgggtcgacatagtctcaaacaaagtgttttacctgtaatgatttctggacgaggatgagtggactcggatgcttttaaaggagatctagatctccggtcattgctggcgtcttgtccgtgagggttgtctgcttgggtttcgacttctggaatctcttcgtttacccctgcatccgactggtttccagtcgggggctcctggccagcaccgacttcagcttcggccggctggttcccagtcgggggctcgttgctgggttctacattgtcggttgctggctgattgtcactcggatgatccttagcagttggtccggtttctttggaagaacttgtgtccatgttagtcgggtcagagtctttcccagacgggtctatatcagatggtttcctgcaaatttgattatcagcattattgccgcaatgggtgtgcatcaatacaagagggatcgttatatgagttgcacctggaagacttcctgatctttggcgcggagcgactggatgttttcttccttggagtagtctgttttggtagtttcttggtcgtctctcggtcttcaggcctcctggtggcatcatctgctttgtcgtcgcttataaccagtttcctctttcgagaatctgactggccgattggatcaaaagcacttggttgagtttcagaccgaattcttggtcctccgctcccttgcgtagtttggtggcggggagatcggcgttgagcgattgggggatccgacttcatcaaagcaaattcctaggtgtaatatcctccattgttaactgattcaacaagaaaacaaaagcatacttttgaggaagattgagatgtttgagtgcataccggtggaggagggttgaatgcattgaatggcacaacgggcagcagatgtgaatagctgacaacaatagcgtttgagaagatcttgtacattctttctttcatgaccttaaagtcaagagaatctggatcttcccgatttggatcatgcttgccatcaaactcaaaagctgtgcgggatctctctttgattggagctagtcgacttttgatgaagtcccgagtgatctgttctccttgcaagccttggtccttcagttttagcatgcgttccatcaattccactgcctgagcagcttcatctcccataggcaatgagttccatgtgtcctggtaaactagaggaagacagcagtactcggggagtgcaggctcaggattctgaacatagaaccagtttgcatgccagcctttgtttgaggtcttgaagggcatggagaagtatttttggctcagtgttcccctgagctggaaaccagcacacccaactacgcatggtttgctcttatttggctggggcttgaggaaaaagatgcggcggaacaaggtgaaatgaggcctaatgcccaaaaaagcttcgcaggcgtggataaaattggcaatatgcactatggagtttgggttcaagtgatgcaagctaatcccgtagaagttcagaatcccccggaagaatctagaggttggaagagaaaatccgccatagaagaaatgagcaaataccacgatttcatgtgtgtcgggggtcgggaatgcttcgccgaacgccgggcgccacccgataatctccttcgctggaagaacgccgtgcgccaccatctccttcaggttatcttctgtcacatcggagggcgcccactaactctcgaagctttctctttcttccgccatgaatgtgaactggatggtttaatttggtccgagatatggctggagaggaatggggaatcggagcggtggacacggggagaaatttcgtgaagtttttgaggatggtttggagcagattgatgaaccctagcttcgtcggcatggttctatactgtagcacggagtgtggaatggcgagagtctcggcggggaagacgaagcgacgtttggacttcggtatttttagggtatcgggagtactaatgggcctaggcctgtacagtacttcagcccaattatgttttcagcgtggcccgttgtgatccctagggacttaggcgctttttgctttggcaatatgtgctcacaatgacacggcccgatgctgttaaaatcctttttaacacgattcaataattctttggaattattatgatgcacatgaaaaggtgcccgacagaaaggtgttataccatttttgtaagcttttttaggctacaagagctgttgggttaatttgagatgactggtttattagtagtcattctcctagcatgttatatgcttattttgattatggtaagggttatagcctaggctaataaacttcttaattaccatgatctttatcatatttgggggatcattttaagagtttcttactcggattcctaccaaatatatctatttttggaccttttgagtgtttatcactcggcccttcttgtatttttttgtccttggtatattcaagttgagaggcagtcggctgggtatcttactaagtaccatgcgtgctccgctataaaaccactcggttcttgactatatgtttagtttttcaactaatcacatagtcgggggctacacctaattaggtgcatctactcgatgcaccatgttttattttcgcccttcacagtcttttagcactcggcaagccggagcaagttgaattgaagcactcggattatttgtttcgagcagactattttggtcaactgcgaaggtcacgggggctactgtggagattatggttaccccatatctacatggcggttatattccagctggatatatggtaccaaatatagatagaatatctttatgaggactcgggttagattctaaacttgtatgttaagaaaatacccgggatcctagtcggttacgattgtattttatctgtaattccatattccgttaggatatggattgtactttgtattacggatcccttcccctatataaggagggtccgtgtgcctcttggggcacgatttcttttctcccaatcatacaatcaataacacactcggcggaatcatccccggacaggagtagggtattacttcttgaataagaaggcctgaacttgtataaaattccttgtctccaaacccatccactttcctagcttgatagccacccccttttattattgccgaaatcttgtttcgacagtgctatctctgatctcgccggacacggattcgaggaggaaggctaccatgttgtcaactacgagtcagacctttagactgtcatgtcgataacagttagataggctaccccacatattgtactggtgtgattatggtgaataaaaagaacctccggctccggccaataggatatagggttattacctaacaactcaggggcccaaacctgtataaaaatccctgtctccgtttcttttacctcagtctcgcgtatatcctagcactgacgatcctcatactatgcaaataccagaattacgacatcaaacgtcgacagtggcgcgccaggtaggggactttggtgcttcagggtttcgacgagatgggtttaagagatggattctccaataacaagctactcgacgacttcggctgtggagatctaacccgaccggaacatgtcttccgacgagatcggaaccatcatcgtcatcgacaacttggtctatcgagatcacccaagcctcaagatacgcggcgtaccaaaagatgtcagatcatatgatgtcgaaggagtacgcaataaggtaattggtagattggtttttcaaattgatctactaatttcgtagatatatccggcatatatctacaaaggtacgcaatattttatatacaatttatcgtacctattcagatctatacagtattgtcaggtctatactttattatgtttacctagaggatgtttcttatacaatatctatcgcgcgagtgtttccgacgttaaccaactacggtctaacgctgggggctcgctctgtttttcttctgtataaatcatgcttgtttacggtttatataatacctgatatttacatctactcgttatatcctgataatactagaagatccatgcagttttttgagtacatactcgatattatctgctatatattttgtcttctagaaaatattttttaggaacaattgagcacacgagtaggttgtcgtcgagtacactccattatcgagaacattctcgacaaatgcggagttatcgcacacaacctgccaacgaagaccgacgacctatctcatagcaccagccatggctggactactcgagaaaaggttgttaacggacaattcctcgcgaacgccgtcggcttgatcacccgacatgattgcgaacggacatccggatatgctacaagttgggtgtgtgattcatgctggccacatgatgtgcacatgtaacaaaccaactttagcgcccctataggtgattaagagactcctactcctagttctcgaaccagtaaaacgtagtgatctctcttgcctcacttcaagtggtcgagttacgactactacctggttctcgaccagcggtgtagcgtttctcccactactcccactttaagtcgtcgagttacgactactgcctggtcctccaccagcgatgtagcgtttctcccactactctcactttaagtggtcgagttacgactactgcctagtcctcgaccagcgatgtagcgtttctcccactactctcactttaagtggtcgagttatgactactgcctggtcctcgaccagcgatgtagcgtttctcccactactcccactttaagtggtcgagttacgactactgcctagtcctcgaccagcgatgtagcgtttctcccactacttccactttaagtagttgagttacgactactgcctagtcctcgaccagcgatgcagcgtttctcccactttttccacttctagtggtcgagttacgactactacctggttctccaccagcggtgtagcaactctcctactacctctatttcaacaaagttgacagcaggtacacagtatcgccaagtgttttacctagagatcccttaccacgacgacacctagcgttgaaacctatcttactgtccctttacgccgtcttgacaaggcctccgaggaacctaagggaacttcggctggggacgcccagagccgataaggctttgtcggatcctgtagagacaaaagaccatgtaagatcttgtcgtataagagttctcgccgtgcgtattaaccaagccatgtaatcggaaattgacttttccaacttcacggctgggggctaggatcagtgcttgttcaaccaaggcaggtcaagggtccaagagccttctcctccgagaacgattctctgatgacaaggctgggggctagggagagtgtatgactctacaaactgactgatcgaagtcggtaagagagaagacgctcgtacacaaaacattggttggtaaatttaattcattttcaattttccatacatattataacatgtcatcctttgagcgttcgctcgggggctatttctatttgatattcttttctgagtattgatttcaggaaaattctattcgacattatggaagactccatgtctctatggttctataccaagatcgactaaggcgagtacgacaaatgttgacaaggctccgtcgcagactctacgccttctcgatcgttcgagaacggttgctggatctcgacaaggaatacggaatgaagagatggtgtacctgccgagataaaatttcttgacttcaattcaaattctcgattacagcaagacggaagacttagtcgtacgctatgtacttccttggttgacatcggatattgactcagacaaaccctttaggtgcccgcacgaggctgacaaaggaagtctaaacgttatctctgaactcaccgagaacggtcacatgagctcgataacagttactccagggtctgcggttgagaatataaatacgttcatttgcattgaagtcgggggctactgtcagggttatggataccacatacctaatagtagtcgactacatctcggcaggacccaccacataccatgtcctatacagaaacaacctacggatatggagggagttccggataaagaaagacaaccagagttctacatggaaacgaccaggactactcggattgtatccatattggtttccctagttctacttggacaaggggacacctataggtataaatacaagaccccctaggaggagaggggagacaagacaatcgacagacgatcgacacgatcaacacggtcgacacgatcaacatgatcgagacccaccacaatcaacaaccaacacaatacacgagacaacatacaagccaacatacgccaagacacgccgccggatatcgacttcagggataggcatggctattcccctacggtgtctccggataccgtcaggagagacgaaagcgctatctctgatctcgccagacacgtattcgaggaggaaggctaccttgttgtcaactacaagtcagaccgtcagaccaccatgtcgacaacagttagataggctaccccacatattgtactggtgtgattatggtgaataaaaagcaactccggctctggccaacaggatgtagggttattacctgacaactcaggggcctgaacctgtataaaaatccctgtctccgtctcttttacctcagtctcgcgtatatcctagcaccgatgatccccataccatgcaaataccagaattgcgacatcaaacgtcgacagactagctagatgttaattggagagacaaatctcagcaaggcaacgtacccaaaatccatcttccgggtttctatatacaaattcccaaatggtatgaaagaaggggaaaaaaggaaaagataatggtatgaaagaaattcccaaatgtccaagcatgcccaaactaaatattagataatttcttccagccatatacagcagtactccaatcaacgattatttctccaagtgaccggctcctgtaaccaccagaagcctgacacacaccatgactggagatggcgcgcaagatgaacaaatggcgatactgctgatcaagacggcgccatggaacctgctgatagccaagatggtgcagtgatcaaggaagcacgtgcacgcgacaagaagaagcgcggcgataggaagaaactagagaagaagaaatggatggactacaacacaagggaggcatcaagacagcgtctcaaccaatagaccgacgtgggctacgagatatggttccaaatccccgagtccacgggccggcctgaatgggccaagtgactaggccttaagcatgccagacacgcgcgcgagagagaggatgcgtccgtagtacaaggataaaaccgtaaaaggttaaaaaggatagaacacagactagaattacgcggaggcattggtggcagtggctcgatcctattggatcgagagaaagttgtatgcatattcatctactcttccagttaattgagcgagtcccaagagatttctaacaatctagaatcagagctcgtcagtgtggaaacactcttggctcggttgtaaaattcatgatcaaggattggagatatgctctttcgagtatattccgcgaaaaggcaaattgccttgatctagttgactgagtccggaatgagggattcaggccttgattcgtcatctgcatctcacaaggaagcgatgatgacgcaggatttgagtctggatagcaagttcgatctgctcctgaaaacaactggggagaatgagaagaaaagggtggaggcagaggagagatcttgagcccacttcctggatatcaagagggtggaagagaagtctcaagttgacttccatgaactcaagaaggcggtcaaagtgaggcttcctcaagtggagaagtaggtgggaagttatgtgttggggggctttgagtaccaaggtcgaacacctagagggcaacatgctttgttaggatcagggagacaaggcgtctgccatggcagtcatgaagaaggagtacgacatggattcagcgttcttatagcccacacctctgatccatggtacgtgcaatctaagtcttaactccttgttccttttggcgtagattttagcagatcgtcaatcaagagtatctggaataccaattgggttggccggaagtgtccctcttatgacatgttcacagttcaacggtgacaacctgtagataggggtggacagaataagaccgagaccgagaaagtcggttagtagttcggtcttagctattgaaagaccgaaatttattcgggcaattcagtcattagcctcggttgaccgaagctcaataggccaagtaaaccaaaccctagaggcactcagccacagaggaaccgcactctccctgtctcccacaggccacaacgccgcgtcgccgcctcgcccatccatcgcgctcgagctcacgcagcgtggacccgcggtcacgtcgcctccgcctccatcacaccggcgctgcctccaccctccacctccatcgcgccgctgcgccacctccgccctccagccagcctgcctccacctcgccgccgcctccaacgacatcgagcccacctccgccttgatgccgccatcgcaccaccttcatctccagccagcgcgcctccgcctcggcgcctccatcccgccggccgcctccgtctccatatggcaggtctcggtgtcagcaggaatagggacaacaggagatggcaggattgcatctggtggagatcgacgggatccaatcatgaagcttgatttgccttttcattttttttctctctgaatctttttaatttgctagtcgcgtgtgcaaattctgagatgcttcatctatctattgatctattgagttgcttttttatttgtcgaccaaatatttgatgtttgttttttgtgattttttttgttttgaccacagatcatacatataatcaataaataacatcaacactttatatcaatatatactagcatatatctattagtccacatggccggcaggggtgaatccaaaggtgggtaccggaagggggtcaagccctccttccccgttggatccccatgcaggaggggagaggaagacaagtagggggttagctagaggagcaagaagaaaatgagctccctcaaagtaatcttggatcctttcctgatgaaaagaatacaatattaccattcatccactaatcatcaccttagacatgcaaaattatattgattagttttacttaggtctacatatatagtgaacggggacgaaggatcacttgtgtcccaccagacctgagatggggacttgttctgttgttcccccatttgatttttcatgaagaatcaacttaaccatccctatacgaatggaaaattttcccttgcgaaaacgtggaatagggctccattgacatctctatctttgctagtgaggcccaagtgcacatcaaaagaaggcactagttttttgacatgaatagcaagggtgcgtttggaagttaggttcacatcttctactctctctcgtttttccgcgcatctgtttttaaactgttaaacggtgtatttgttaaaaatatatatatatgaaagttgttgtaaaaataatatcaatctatttttcaaggattttgtaagttaatattcaattaatcatgtactattgagccaccccgttttccgtgtgtataaaggagagcttcccaacccctcctcgcaatacacaccctaagtgaagatttggggtcgtaaggtgagttttgatttggcatattagcaacacgtaaaacaatacaagctattagcgtagattaatcgagcatacaattttttgttaaaaattgtaccatttagaaagcgtgcagccccatcgtttggtatattagagaaaaaaaagcgaaacgctatatttacaaatgaaaaataattcgtgaataaaacttttatatacgtattcttaactatctaaaaggaaagggtgaaaaataaactacgatgaaaaaaccctaaaatcagctttaaatttaatgttaaaaatttaaattttaactgataagaataagtataaataaaaagacgagcagatgctggtgttaacgaaaacgtagcgttattgtttgcttactcttaattttaaaataaataaatctagtatataatataaatatgtacgaagatatttgtttgttttaagagcaagttggcttatagtttatattagagttaacatgtacagtaaatgagctataaggttatctccttttttctcctcctctctctatctctcacatatgcattttatgtatttatcttaaagtatgtgaatagctagctcttgtataagagccaacaaccctctcagttttttaaattctttttcctccacgtaaatttatagttgacttatagcctattattatacttggtgaggaagcctccgaatcgataaggcaggtaagtactgctccagtacgtaaagtccaccttattattggcaccatcgtcatccatccagcaagccaaccggaataactactactgctgctgctgttgcgttggagtaccaaaggaggaggaggaggaggaggaggaggaataatcttagagtctactagactcacacactagctttagcttagctaaaagaagaaaaagaaaagagaggcacaataataggttaggcatggcggagcagctgggcggcgtgggcagcccgcagctaagcctgagcagctgcagctccttcctttccatctccagcgccggtaccagcgccgccgatggtgctccccatctatccctcggcgtgggcggcgccgaggagctggatctgctgctgcaggtgggcataggcggtggcggtggcggcggcggcgacgaggaagaggaggagcgcaagaccatccggatgatgaagaacagggagtcggcgctgcgctccagggcaaggaagagggtaagaacctctaatccatttcctcatactatctagtatagtactagctactctattaattaatctctcggatggatagatggagtagtatttggttccacactagtactagttagctaattgcatgagcttaattatgtgcgcggatggatgtataggcgtatgtgcaggagctggagaaggaagttcgccggctggtgaatgagaatctcaagctcaagaggcactgcaaacaagttaacttcgtattcccttccctaatacttttattactaataagtcgattcatcactctacatttccaatccatcttttatgtatatatatgtatgtgcatagaatcctttgattttactacaggtatattgtaataataatgcactatatcctatgcagcttaagacggagatggctgctctgatccagcagcctaccaacaagcagagttcccaccgaagaagctcatccacttgatcagaacgcagcagcttaagcctttaattaattaagcataggcaaggtagcgggcagccattggattggggaccattatttaattgggttggctgtccagctccagcaagagtctctagcaagtaacaacaactcactctgatccgccggcttggctttccatgcattccggtagtacgtaagtactctattttgttactgtgtcgatcatccgctacacatggatgcatacatgcatgcttaattgtttgtgtcaccggctaacttttgcatacccttgtttgcttgcttgctgcaagacccaaattaatataaattgtatgagactcggattagctgctatcaattgctccatccgttccataaaaaaacgaatctataaccgaatgtggcatattctagtactatgaatctgaacatatgtatgttcagattcgtagtattagaatatatcacatccggtactaggttgactttttatgggatgtaatgagtatagtttcatgcacgcctgcacttgtgtgttgcctataaattcagttttgcatgcacttcaccaatgaattactgatcactttcttgggtacgcggtgatcatgtgtttggccatccatccaacgcatgccttgccttcgtgttcgtgcatatcccttctttctatgaagtagttaagaatagatcgtaagtgtttttttcataaaaaataaattatctgcgcatcatcgtcggtttcattgatctcaactcttacgtacaatgaatatagataggagtctgtctagattcgtcattcattatacatacgtttgttttttttttggacgttttgggacgggagaagtacggtggagaaagggtgtagcaacatgttgctcaataacggtgcgctgcttctgggaggaagattatatatgatgtcatgtggagaagaacagttttgctatacatatatatatgacgggtgtggctacatgcccctgccccttatacgcacggatctctcccttcctcctcccctctttctctttctgctatagtataccataaaaattttaaaaaagttgagaaaaatttatgcatagaaatactatatataaagaatatttgaattcaaattcaaatttaaatcagatatataaacttttaacttatatgtgtaaatttgaggtgtacaaactttaggtgtataaattacctaaattttgggtttctaaactttatatgtgtaaatttgaggtgtacaaactttaggtgtataaatttattaaaataggaaaataatatggtgatgaaaaaggaaaccacgtggcgagagggggacagcgccgtctttccgatatactccctctgttttttaatagatgacgccgttgacttttttctcacatgtttgaccattcgtcttatcaaaaaattttatgcaaatgtataagatataaatcacacttaaagtactatgagtgataaaacaactcataacaaaataaattgtaattacgtaaattttttgaataagacgaatggttaaacatgtgagaaaaagttaacggcgttatttattaaaaaacggaggtagtatggtgccacatttttctttaatcgttttttagatggtgatttaacaggctgatttgcgattagtttgccatgcttttcggattgggaggtttgcggtcagaataatccgtgcagtttgattctccgcgtgctatcttttttgtgtctttgcttaaaaaatgtgattttcttgaccatatgagaaaactacaatgtaggatttgagatttatattagtataatttaaaattattactgcaaatataacaaacttgtagttaagattatggaattcacagtataaatacacgttgaaaattttaaccgtcttttatgaagctgtgagattatgccatcgttaaaagtgcgctttgataaaacaccatcttataaatgggattcactaaaatgcaattctcaaacagtgttatgtactaaaataccatatgcctcttgcatggacgaaaatgtgcctacctttacttctctctcacctctggtgtgacaaggaaacaatggtggtggcgaggcacgctggtgagaagatagcagcctcttccagctcatatgctaggggcttcctatctcgcgagctcgtgccgggaggcaagtcgtgcgcaggggctccccccacccttatctgtctccacccctctattttctctctcatttatatcttttcctcggcccctcgatggcagtttgtggatggagtggtgacgataccaacggccaagttccttgcatcgggcgaacccctcctcctccctctagcaaacccttatttcttactccgttagggacaacacaagagtggagcgggctacgatgctatcaagacctaccaacaacgccccttcagcgagtccccttcctcctcccttcggccaggttagctctttcttcagtctccaccaccctaccccactgtcccgctgcccccggcctcgccggcgccaaaaggagtcaacagaccagggcgaccgtacctggccggcctcctccccctccccttcacctcgctttgcctccgccaccatgatcagcccactgcccgctactgaccttgcggctccgtggcgccgccgccgcctcatcgcccacccttgttcgccacccaccgccggtccgccgtctcccaagccatccctctagacccgatcccccacttctccctccccaataccaccctctcctttaccccacctcaccctaaccctaacccccctcacgcatggcttgttgtgacacggtcggaaaacgggtgccacttcctcgctcgcccgtgtgtgcgaattaggattcttgcctatgctgtcagcctcttttagctagctcacgcgccatctaaccttctcgagcaacaaagaccaatatgtgggccctacccttgcatgggactcgcatgtcatgatcaaatcaaatggggatccaccatgacacgccgcagatcagggttaaaatttagatatccgtagacgaaaaataatcgtcccattcttttcatgggacttgtatgtcaggaccaagtctgatggggatccaccatatatagcatgccaggttgatgcagggggcggatcagggtcggtttgaatcagcgatggcatccaagataagtttagccgtttagggacgctaaagatatactactatttcgtgagttgggagacatggataacacagactgcccacgtactttattaaaaaaaacattccaacctcaaaatcgagtctgtttatttcgatcggtacatatactcactcatctatccccacacatggggtcatggcgtatatgcgtgacacgggtgcatatgatttttaccctaaaaccaactgaatttcccatggcaattagatgcagatcatcgatcgatcgatcggtgcaatgtcaacccggccccgttctagctaggtcgatccagtccaaccagctagccattgcgtgccacacgtactcctcttaattaatttgttctatgcatggcgccatggatgatgttgtcgtcggagatgaagtagtatatagctagggtgggtggctatgatgatcggacgacgagggtgtggtggtgatgtgaatgttgggattccacctcctcatcctgcgatgcacatgcgcgctgtgctgctgaagcaccagcacggagccgcaggccgtgaagtcgtcggaggccagcacctccccgacggggcccagctccggacactcgtcctccagtagccctcccatgccgctcgtcatggccgccgccgccgagccgccgccgcccttccccaccacgaacagcgagtacgtccccaccatggcgctcaacgaattcaccatctccgcgccgttgctcacgtacctctccgtgtactccacctgtcccgccaacaccagcctcgcgtacacgtccgccatgaactcctcatccgccatcgcctcctcgtcctccaccgccacctccatggcgccctcaccgccatggctcttggtggtggctaataattgttcatcaatgccaatggtaatatcatcctgtcgcgctggaaggaatctcaccaccgtcacgctcacccacgggtgcgccgccagccgcgtcgcgtacgctaccgcctccctgtcgtccggcccgcccaggaacaccgccaccacctggttcttcaccacgtcttccgcgcccttgtcgccgcccccgccgaggcgccgttccaccaggaccccgacagtgcagggcaagcgctgcaggatccgctggttcagctgccgcctcccctctcgccggcacaccatgcgcccgtcgtaccgctgctccttgtggaagggcacgatcaccagcgacgcgcgcgagtcctccacgccgttgcgcacgtctgcgtccatggaccccaggctggagatggcggtcatctgccgcaccggcacgccggcgtcgtaggtgaaggtgttcaccgccgcggccacctgctcgatctcgcgggcataaccccactcgtcgtcgtcggcgtcggcgtcatggtacagatgggtgatggcgtacttgcgcgcggccataagctccaccaggtggaggaggtagacggccagcggcgcggtgcccttggaaagctccgcgagcgtcagcatggtgtggacgcccccggcgccgtggacgcagaccagcacgcggagctcgtggtcgaccttgaggtcctgaaggcagcgcgaccggtatcgggaggcggcgcgctgctgtcggacgatggccgcggcagccgggcctgccatgaaggtgttgaggatggaggagaggagcagcaccacctgcgccgtctggccccagatgccggcctggttgccgaagttgatggcgaggatgtcacagtagcccttgacgttgagcaggaagcccagcaccagcgactccctcgccgagatgcccagcatgcggcccgcgagcaccgtgccgcccaccttcccgactgcgccgagcagcgtcgtgaaggcgacggcgacggcgaactgcatggctgtgaagctgccgacggcggcgaagtcgagccttgcgccgatggccccgaagcagagcggcatgacgagctggtgcacgggataggtgaggcggtcgacgagcgtgcgcgccgtgggcccgtcgcgcggcatggcgaggccgatgaggaaggcggtcatggaggcgctgtagccgaacacctgctcgagcagcgagagggcgatgatgagcaggagcatggcgcagagctcgtacttgctgacgtagcggcggccgcgcttgagcctgttgagcagcctggcggccctggcggccgcgagcaccgccaggcacgccgtgaaggccatggacatgacgatggacatgtccgggaaggatggggtgggctggccgtcggggccgtaggcggtggtgccgacgaccatgatgctgaagacggagaggctagccatgtcgttggcgaaggcggcgccgatggcgagctggccggcctcggagccggtgagcttgagctcggtgacgatgcggatgaggaccggggaggcggtggtggtgaggacgagcatgaagagcgcggtggaggcgtagagcttctcgggcttgaaggggccctggccggggtggaggaggccgtagaagaagggccccgcgagggcggcgagcaggaggcagagccccgagccgccgcaggcgatggcgagggagcggcgcaggtggtggcggaggtaccggaggtccatctccaggccgatgaagaacatgaagatgatgcggacgaagtagatggtgtcgctgagcgcgctgccggcgtcctgcatgcccagaggacgcaggtccacggcgcggccgagcaccgtcggcccgaccaccacgccggcctgcactgccatgctcgcaatctcatatatatatatatatatatatatatatagcttccatctcgatctctctctctctctctgctggaaatttaattatcaatccaatccaatccgcatgcatatatatatatatataccaggatgtgcgagattatgcttggctgcccaacgcgtcgaagcgcgcaatggaagatgccggagagcgccaggacggtcgccatgaggccggtcacggccatcacgccggccatgaagtaggtgccgtcgttcacctcgtcggagcacttggcaccgtcacctgccatgctcgtcgccggcccgccggaccgatcgatcagcacgctacctacctacctacctatagcgggctatcctatatatagcctgccttatatttatcagttaaaatttgaattatcaactttaaatttgaagctaaatttgagggggtttttttgaattttatttttcagtctttacttttagaacgctaataacacgtatctaaaagttttattgataaattactttttatttgtaaatataccgttttgcttaatccccttaaattgcattcctagcttccatccctttcgtcaacccaatctaggattcactatagccaacataattgtgtacgtgactgtaggtttactggtgctcaagttaagatacacagttgtaatcgactatgcagaaataagatatcaagggtcctaatgaattttacctatgaaaccctctaactcatgggaaggataggaaattttttttcattgaaaactttcgttacctttacgttgttcgtttcatgaaatgttattaaagggattccttcaactttttcattaaaataggattagagaaacataatacttaatttccctgtcgtctttaattgttgcaatcacgggtacttttctaagtctactatctactatatattatatatacttatatatacttaaaaagtaaaacctgttttcgtcgtccgtgaaaacaaaaagaaacgatgagaaaaaaaccaaaaaaagaagtccgactcccattaaaaaaaacttccgactcccttggaaattccgtaaaaaaaagaaaagagatttctttatggaaaaaaatcaagcgcgaaaaaagtgcgaaaattttgttatgtccgataaaaaaaagtgctataaaagggtttccgtctaccgtaaaaaaagaaaaataatagtgcaaaaaaagatttatgtccgattaaaaaaaatcccgtcgtccatccccccaaaaaaaacaagcgtgaccattttttctgtccgattcaaaaaaagaaagttgggaaaaaaggttttccgtttctctatctctgactctatctcttctctgcttcttaaaaaactaaatgtgtttccgtcgtccgtccgtgaaaaaaagcgtgaaaaagaaattgagcgaaaaaaaatcgaatccgattatacgtgacgcggtaaaaaaaacaaaaaaagggagaaaaaaatgaaaaaaaaagagaagtccaattcaatctatctatatatacctaactaaaaaatttgtatggcttccgggttatagttttcgttcgtcgaaaaaaatatttccatcgcacgtgcgatcgatcccatttcaacccctctccggtggcaaaaaaaagaaaagaaagaaaaaaataatgagagaccgcatcaaatttggacataaatcatagagaaaacactgctacaagaatacaagaatacaagatcagattcaagaacactaagaaaacgccgatgccggaaggggagggtttcgttgtcgttgccgaaccgccaccgccgtcgcagggatgtcggtatgccagggcgcagccacgttgttttgagagatagagagcggggggaggggaaatgattttagggttagggtttgggctgttgaacttttatataggtcgaggtcaatcaggaccgtctatcagatcagacggttccggcttctcccgcgtcacaccgaacgccaatcccaggccgcccacacggaataagttcactttaggtagcttaagtttttcttcccgattctattcctaggccgcccacactattgggccatctcatggaccacgtgtacgctttgtatggaataaggtcactttaagtcccttcagctggactttttttattttattatgaatatattttcttaaagagctcatatcatgtaaaactaaatcttaatcatgtaatatttttatatttgttataattttaatttacacgttgcaacgcacggatatttttttctatgtaaaaaaaagggaccatgacatacgagtacgagtgagagatatatgccgcacgcacccgcaggctcatgtttaaacgagctggcaacatattgtcaattacaggtctaattgttttatttgggtgattaaatttgtttttatttacataattagtttgctctatttaagctttttgaaaattgctaaaatttgagaataacttttcctacttcatattatattatttttagctaatggaattaacagaaaattaattatatatttttatctttttaacaaaggtcactgcaattttatattttattatgattatgattatgattcctttatattttttctcaccaatatacatgattaaaattatcttcacccgttgcaacgcacgggcatcattgctagttaaaaaaaaagttgaaataggagataatgtgaggccttgagattaaaaggaccccgaaaacgagacagatcgtggccgttgaagagggacacagacaccgtggatctgaacgctgccggtgtttgttatccacatttgcggggcgcagcagcaaaagcacaagggcaaagcctcgccgccgtcgccgccgccgccgccgccgccgccgcggcgatcgccacgccatgtctccctccctcttgcttacctctaggggtacccactcgccggcgccacggccgcaaacccgtcgagcatcacaactgctcgtctctttcccctcgcgctgcagccgcttcgtcggcctccgcctcgcgcgcgcagccgccgattcgcaggggcccaacggcgctgcccctggatctggatctggtggggacggagagggcaaggcagccaatggtgccgacaccaaattggtacggtaaacaaccaacccttccctctctcttaaatcttaatccccttgacttactactactgttccctaatccctctcctgttctccccaattactgttccttctctgtcttaatggatagatagatggattggttactccttttctttcgcctgcctgctaccgtctgcattctcacaggctggttggatgcatgccatgatagaacaggagagataatttcaatttactaacaaataacatgcaccgcataatttggagaagtttcttgtgttaattttgcatcaatcacatggtatgcgttctccacataaacttgtaatggtttgcacaaaaataattcgcactagccctcaactccaagtcgactacctgagaatatgtcggagaagcagagatagttatgatgtcctgagcattttatacattatgagatccagaataagacacaagtagtcaagcactgcataggtcacatgatgaggcaatttaatttaattaccctgagatctgaactataggcagatgaactaaacaaatcaggcttacaaaacattgagattatcttgcagaacatttgggaatggtaacaggacatggaggttgatcctataccaagacaccatgtatatatacatatataaatgatacaccaccaactgcaattctatcagtcggtttcatctgaattacactgtgcaatgaatagatatatcatatgtatgactcatcatgctcacattttttctccattagtgggccgcttgttaataatatataagttgatgaaatattgttaactctcactgatccatggcatcaatgatctgtctaatactgcacgagcgactgttgtctgttgctagggcagctggtagtcaatggattgttcactctccacaaaacatgttgagttgagggcttttatgatatcttgcctttgttgatctgttcctacacaaaacaacttgaaggtcctatatgtaagaaaattagcaaggattgcttgacaattgttgatagccttatagctcagggcagaaagttctggcagaaccttatattcaagaaaattagcaaggatctcttgacaatctttgatagacttatcgctcagagcagaaagttctagcacctctacttctacatccattgctgtagagtagtttccttttcatccctgcagagtgtgcacagagattctcaaaagtcaaaatactgttctgtacttctgtgacctgtttttttgagtgtcaagctgccatgcaggagttcattagaagcagaaccatcatgctagttggactagactctgtttgtagttgtatcgatggaaatatatgcatgaacaccctttcgtccacatgtctttggttctcaattaatccattgtctattatcatgtttggcaccaacgaaaataagctatactaatatcttcttgctaatttagctataatattattctgacaacaatccatattttaaagctatggctataatattctgacaacaatccatattttaaagctatggctatgtgtttttttcattcttacagccaaagaaccggagggacatactcctggaatacgttaaaaatgtccagccagagtttatggagctcttcataaaaagagctccgccacaggtttttatcatcttacttccctcctaagtttccacaaactgtgttttggataattcataaggatgggactgggtcaatccatgggtaccaattgacccactatagttcaaccagatgaactaaaacacaacatcaaagttcatttttagatgatttggttgaactagaggcaatgggtacttatgtattgacccacttccaaccctagatatatagggtggtatgctgatgatttcttgaaatactttgatatgatgacatttccctctgtccatttttttttctgaaaaggttgttgatgccatgcgccaaacggtgactaatatgattgggactctgccacctcaatttttcgctgtaactgtgacaacggtaatgggatatcatatgttcaggtcttgacgccggtttttcttgtatggcattatgtcatactactaattattagcacaattcatttgtacacttgagccatgaaattgtgacatgtttatttacctttttcatcgacacaggttgctgaaaatctagctcagcttatgtacagtgttctgatgaccggatacatgttcaggaatgcgcagtatcgtctggaattgcaacagagtttggagcagattgcccttccagaaccaaaagaagaaaatgtacttttccaccaatgctgagttgtggacatatattccttacagggacatatgattaaattgttgccatgttgacatgtatatatctgcttagtaatctagagttgattatgaaaactcattttttgatcatttgtttgtcttttgaaaggttaacactatgtgcaacttacattaattcacacaaccaaatctatgagtggataaagtcaagtttttgctggtagtaactttacattattaaaactgcaaatattttattttgtcttattttgcatggcagcatttactcgctgttgctgtgcatggtttaaacctccataaagagaggtccaagtagtgtatccctagaaagtaaggttaggaagcatcaatcaatgataacttgataagtatgtagcaatgatgcttcccggattcaaagtaaagaggactgaaattaatctgatctttagagtgtttctattggttgaagagttatttttttcataggaaagcttgttgatgagtgatcattacctcaggagttcacagcgttatctaacatggaaaactaaaatttgtctttctataagaaaaccaactcagctattgtaactattggtggtttccagctactgttttggcatcctagtgtttaattaggctttgagtaggagcgatgaaagatgcaatattcattttggatgttagattgattgaggagcacacatccatgcataacataaatgttgtcactaacactaattgtaaaatgtctcacgtctctctcctgccagggcacctcagtgtgccatataattcactggcttgtgtcactggtcagccacatttggtattgttttctaaccagtactttgcattgtcatatttgctcattgctgtttgacattgtaaagagattagtgctagaggttattgacttgtgtatttagatttgtttactttaatgtcatagctttcagaatgaagtcggtcaacattttgtgctcctggtgttttgatcatttttctgcaagtgttcttaacagtacattacaatgtggtgtagcttccctacttcgcacaaatagtaaatactataaaaaaagcaaagatgaggttgtttaatatgcatgctggcatttgtaggattctgcagattatgctcctggaacccagaaaaaggttactggagaagttatccgatggaacaagactactggtcctgagaaaattgatgcagtaaaatatatagaattgcttgaagcagaaattgatgaactcagccatcaagttgctagaaaatcatctcaaggaagtaatgaactcttggaatatctaaaaactctagaacctcaaaatctgaaggtatatcttgatcccattaccctctgctgcatccatcctaagaatcagaatatatatagttaatactgactttatgttaggatgatcaatctttttggttggtttacatgcgtgataattcatctactattctgaaacattgtaggagctggcaagtagtgccggcgaggatgtcgtttttgctatgaatgcattcataaagcgccttttggctgtctcagatcctgcacagatgaaggtgagtgtttatttacttctttctgtgttcatgttaattgattttgttcagaaccatgcatacctccattttgttgaattgtgccactcattcaggtttgcttccattccatttagtattttctgataggaaatcgcagcattttataaattgttccccaagtttggaatgttactgcaccttaaagttagtcactttgttttgttttgttttgagtgcagacaacagtttcagaaacaagtgctaatcagctagccaacttgatgttttggttgatgattgttggctacagcatgcgcaatattgaagtgcggtttgacatggaaagagtattgggtgctgccccaaagataggggaattaccacctggagaaaacatatagcagggaggaaaggggcgtaagagtggggaagtgatgattagttaaaatctagggttactggccggccaagataactgtatttgcgtggtcatattattttgagtggaatggattacagcatttgtgcaaagacaccaatccacattttgggaactaagatgagatgctaggcatagccatttctgatatatttctcggggaggtatagacgacgagatacatagaaacaatagaacgggacctgatgctgtagttttgcaacctgactattgttggtaaaatacaatcaaggcaactcatattaccatattgtactcccatgttgtatgtctagttcaccaatcaagttgagtctgatgtgagtttgtttagaatcttgactaattttgctacatgacacataagtttgtgtaatttgatagcgtacatcgtaaaaacgtgttatggctgttggacaccttaaaaaatgtgttccttgcacaggaaaaaaaattcttttgaatagatattgatacaaatacctcgaaacgggttgggatacatattcgttattactatagataagatcttttgaataggtattgatacaaatatctcgagataggttgggatacatatttgttaatactatagatagagtatgattttttttcatccaaatagataaatctctaaatataggcacttcttttttcttcacttttgcatttcttaattttgtattctgctattctgacaaatattttttcattcttgcttatcttatcttactttcctagttgttctaagtaatacacgcggtacaaagttcgtgctagggaatttctttgagtcatcatgtttttcttcatacaaaaaatgaatatgtgatttttcaacgaaatgaagctttttttttgcttagcctatctgaaccttttgtataattggaattaattaaaatataataggtattttgtttcgtctagaaacatagcgtaaaaatattcctcgacttgcataaaatctggagtactatgctagatgccattttcagctcaattggagagagaatttttcttagaaagacaagtgttcatagaatcatagtgccaaaagcttctaatttagtgcaagagcaaagatttaatatgccaatatgacgcactcaaggaatgtacttggggtgacgacacatttagagatgcataatttttaaattttcacttcaaagcctaaggggtgaaaatggagcggatttgaacggatagtaggtataccatatcttaaaccatatttcttgagtggattcgaagcggattgtttcggatgttggaaatggtgcatattcgatttaaaaacggattgaatttatcagatattacgtgtataagcaatcaatataacatcgagttagcaatgcaaggaacaaacaacacaataatcgatgaacaaccctcgtaataattatattttttttgagaacgtcgtaataattatatgcataagtgttaaacaatatgaatacttcatagtataaaacacacaactatgcaagtgtgagatgagattatgaaagcctcgaattaaggagtcttggtaaattgatgactagcaaaatttacatagaatcttttagaacatttaggccggataaaaatcaatttcattgtctgtcttctctgcacacggcacgaccttatatgaccctgtaccataacgtttagcggaaaaagctttcaactaatacaacttattataatatatttctccaaattttagtgcccacatattttaaaaaatacgataaattgttattactacttaagatgagaggggtgatgtttttttaagcctttttaatatttaattaaaaaaaataaataatccaacaatttattttcaaatataaacttttggtcagtggcaagaaaacactagcaagcctgttgctatggcgtgattaaaagatttaaatttgtaaataagttttggagaggatttattttaaaaataaataatattaataaaaggttaaaaaataataaaaattcgagagcggtcggttccttggaaacgaagggaacagggaaagtatgcagaagcaagtcaccgcccaagcgaagaagccaacgcggtggaaagtggaaagaaaagcggacaaaccaacccgaggcgaccggcgactcggcgaggcaaggaaaagaaaaaaaaaggaaaagaaaagaaaagaaaagagagagaaggtgtggtggtggaaggaaccctagcggcggcgaccggctccgatggcccctccaccgccgtctccgtccccatctccggcgagcggcgcgcagtacgcgcaccagttcctgaacacggcgctctcccagcgcgggccctccgccctgccctacgcggaggacgtgaagtggctgatccgcaaccacctcgtcgccctcgccgacgctttcccctcgctccaccccaaggccgccctcttcacccacaacgacggccgcgccgcccacctcctccaggccgacggcaccatccccatccaccacgccggcgcctcctacaacctccccgctgtcctctggctcccggagccctacccgcggtcgccgcccctcgtcttcctctccccaacacgcgacatggtcatcaagccccaccaccccctcgtcgaccgctccggcctcgtcgccaacgccccttacctccgctcttgggttttcccctcctccaacctcgtcgatctcgtccgatccctctctcacctgttcggcctcgacccgcccctcttcaccaggagccccaatcccccacccccttccccttccccgccgatccctgccaccccgctccctcgcgtccacccctcctcctcctcctccccctccccatccccctacagattccctgcctcgccccagcttgccgcgcgccccccacccaccgaagaccccgctgaggtctacaagcgcaatgccatcgctaagctcgttgacatggcctatgccgatgccgccacgctgcgcccagtccgcgaggctgaggtcgacactctcttcgccatgcaggctacgctgcgcagccggggggaggtggtctctgatggggtgcgcaagatgggggaggagaaggaggcacttgagcgccgcctgcaggatgtaatgatggccacggacctcatggaggcgtgggtcatggagaacaccaagggtgctgccggcgacactgaagcggacgaggcaattgagaccgcagatgtactgtctaagcagatgcttgagtgcactgctgcggatttggcactcgaggacaccatttatgcgcttgacaaggccattcaggagggttctgtgccatttgatggctacctcaggagcgtgcgagcgcttgcacgggagcagtttttccaacgcgtcctgtcaaccaaggtgaacaaggcacaacaacaggctcaggttgctagaatggctgctcgggcaccacagtatgcatcataggaccggtgaggggtaacttgagtatacttactttgatattgcctttgtctaccaactctactatagctgtcacagtgtaaagttcgtttgctctttgcacatcttttttggggtggatgggggttacttactagatattggatggatgatcccatgtcaaataagaaccttagttgggagtgctgcactggatcttgtgtacgatttctgtacttcaatacatatcttcagttttgttctttgtgataactccatgtctcaatcttcatcgcaaaacttttatcaaagattacaaatcttgaccttggtagaaaatttcagatgcctgggtgttccccatcttactaattgtagtcattgccattggtgccgactaattggtgccagcgccggaacaggcaataataggcccttctgaactggcacctatgggctttcctgcactagtgaattgtggtaattcagatattggaggctgatatacctgaagttactgatactttcagaatgttcagttatatttcttttgtatgactgcattgccagctgtggaaacctagcctatttgttagaactcaaagttgggaagcactaagtaatctaattaaaaattagtaatttctggcttgcttaaatgttatgacaatggaagaggcaatctaactacctctgttgtaaatgttggacgctctaatgtgatataggtatctcaagtttgcttagaggtttgtttgtggtcattgtgtttgtaggtgtcaggcgcgaatgtaatcaacaatttttttggtgtgtgggtgtgggtgtgggtgtacttggggtttcttccctatacgcagctctcctacgtgttcaagagaaaaacgtttgcatataggctttctggccactcttatcaatattaatatatttataaattggcttagtagttggttctagtttggaaatatggttcccctgagcacagggcactgcacactttggaccgaatgtgacatattctagtactatgaatctgggctgtatgtctagattcatagtactaggatgtgtcacatctggtactaggttggttttttatgggacggagggagtaggttatttattactagatgatctgcacgatgcaatgcttacatcatggagtaatgttctgtaatttctggacaacctgaacatgcccatccttagtcggtggtgttggtttttatggttcaaatcgcagcccagattttgagctaactctggttctgtttgatctcaacacatttgtagagccaaacagaatgggtttcttgcagatttagagtgtgagtttacatatgctgcttgtccttgaggtaaaaaacatttttaaaatgtattgcagaaaattacattgaaccattgcaggacaaaaagttactgatgttgccctgttgctccgatgagattcgagtgagcatgccttttgctccagtatagatagtctgagtaaaacctagagttatttagtgtggtattaaaaaaaagttgaactcgaggaggcggcagtggtgatgttgagcccccgagtgaggccgtggacggtgccatagccgcgggacccgaggccgatgcagccgtagagcagcagcccctgccggtatggcaggtacggccgcccctacatctcctccgcctgcgtcctcctcacctcgtacatcctctcgtgcgccgatctcctcctgctccttcccgttgttcctctccctcttctcggcggccctctgccatggacacaacagcgctcacacacagcccaggtggaggaacagcaggccaacgtcgctgccgtagcggtggtgcagggtgtccaatgagcggtgtgggagctggtcgacgaggtggaggtggctgacgaaaggaagcaacggcggtgatggcagaagcttcccttttccaagactcttgattgtgaagacgactaggagcaacgctatggcgaggatgacatatgatcattacatcttggtggatttttatcccaaaggttggatttttactccgaatgtcttggtgcttataaatcaattagagcacattccatgtccttgttccattatctctacaaaaatgttcttgtagccaatcaccacggggcggtgactttcacagatctattgtgtgtctagaatattctatggtagagttttttttctccaaattggattttcacatgcatgtttgatgaactcttatgccatgtagttggggttatttatgaagatcaccatcaatcatcttcagttggattgctgttttcaggctattgtgctggtgcagttgtgcagcagtgcaggtatgcttgtgagttgtgtcaggttgatctgggattacattcagcaatacttctctctcatttcctggtgaattggcaatctatcctaactgttgctggttttccttctcaggtaagatggcatacagctcactatgccgggtatttgcaatatcgagcaccagcattatgtgttgtgaaattccaaaatactattacagttaatcacccttcatatattttttcaggtaagagcacctttcatacaaaaacacaatgtgcccggtgaaagataaaacacaactacaggcttttttttaaaaaaaaaaaactatcacctgtactagtgcagtaaaattgcactttgatgcacccacacaagattcagtgcaaacccaaaaaacagaagagaaaaaaaaattcctctaatcccattttatttgtaaggaggttgaaatggcctggattagtccaggctagcttttgcagggaaacaaaatagagagtacttgagaggctaggccctgtagccccatcttttgaatacgtgttagtgatgcatattttctcttgatttacactgcagatctggcttaggatgataagtgtaccttattttatctacctatctgatgtcttgcatcatagttaattatatgaatgaattgacaactcgatatttgtctacaccctgcattttttcccgtattcatccattgcctgactgtttacatggatgcatgtagaaccttgtgctgttttggttcataagtttagtagatagaatcttatgatgcagaatgaaatttcccttttccttggatgatataaaagtaacatactctttggatgtgagcaattagacatgtcactagcgccccaacagatcagctcaaagtatgttcccacccatgtttgtaagtaaaaagattgtccaggtccattttctttgtttagcattccttggtattatttcccaaattcatttgttcagcatgggaaggccttttttgtcaaaatgcgtgatggtcagtaatgcagagcttttattttgtaactttattggcacagatggattctaaccaagaatttgagaatattagttaatctctttctgtgtaacatgtttattcaatagtgtttgtttgcatgttcgaggtatgaatttacagttgaggttatgcatgccaagaagtatatattttttggggggtttttttgcctggtgcattctaaccagtggcttggagcatgcttaagcagactgtgctttagcccagtctgtacaccggaaatcattatcccgacatacatgattttattcagactttatcattacctttagagatgattatttcatacttccaaatattcatttctgaatgttatacctgctacatttagagttcgatataaacgtttgcagttcacatactatccaatggggccttgaaaaaaaaaagagcaagaatcaatgacgaagcaatgcttcttttcctcttgtttgtaggttgaaagaatgacttgatttatggagctataattatattgaaaagttcgttttgtaattcaatacaaagaagagtgtgagcatgactagaagatctctgtggatttcttacaaggtatttattttgcatcggtcactatgttaggaacctttagtggtttatatagtcatgaaagtttttgagccagtgcatcaaatatcttggtccattaagtgcctgcacttctctaaggaaatctacaggatttatctaagctgcaaatcagaatattcaggattaataaagtaaaaattgcatttctgcagcaacaaagaaaagacttcgaggttgtgattgaggatggcaggtcctaagtcacagggaacgtggaacgtgggtgagttcctcgtcccggaacaaggaacgggaacgaagcggaactttattctgaaaacggaggggtcgtcgttccaatacgtggcatggcgatgaaggaacgagaaggtggtaggatggaggaaccaagtacgctgagctaaaaataaaaggggaactcaccggatcaacgcttcaagcgacgagcagcgttgttgctccttcgttgctcaccgccatcatgccccgaggtgcctccgccagcgcacgccgccgccgtcgagcaggggagagggctgcactgctagtcgcaggtccatatataagaacagccggcaaaatccttgacacatctagagggaagaaatgataaatggatctttgttccgagcagatcgaagaatatgtatgttgggcaggtaaatattcagataccctccaacaagctacggtagacttctgtgaaatggttcatcatgtaacactgtccatgaaacactactgcaggagataagggggaaatttcagcaatccaacttatttactcaccgacggagcaacatttgctactggccaactattaagtagaaaatgttttcaatggaagaagaaacctgcacacttgtgactcaaaaatcgtagtctgcgggtcatgaagtttcactacaaaatacaaactagctattttgaactgactattgattcacatattagaaatgatcaatacagaaattttacatggctgtagtgcatttaaatatcatttttagggggtaaatatagtgctcaattttctttccatatttatggcaacttttcaattcctaatggaacttgcatactgatgtggatgtctttgcagagagaaatacgctcgttacatgagatagaggattttgttgggaggcaattaggtgcgtacgagtataactctaagaaaggtgtcacaaaggtgtggttcattgaattcatacttttaaattggtgaattgtgaaagagatcaatgtgtaaatgatgggttgttgccgtttcacttgaaacaagctgatgttttatttcacttaagaattattaggaaggatgtggccttgagttaacatttaattatgttatgtaggaagaaattgttttttttttcatgctacgccttctaaagcccatgcgtgcgcagcgtgacaccgcacatacccttatattatgaatcaatccagttttccggagttaggatgtgtttagttcacgccaaaattgaaagtttggttgaaatttgaacgatgtgacggaaaagttaaagtttgtgtgtgtagaaaagttttgatgtgatggaaagttggaagtttaaagaaaagctttacaactaaacacggcctcactcgttcaccgtcttcggtttataatcgggcgtgggtttcatcacttctaatagtagcatgatgactatccatgatgactatccgctactgccggcccgcctattaaagtcctccgctcacgcagtttgaattcatctagctaaagtatgtataagtatttctcggttcataggacaatgctacgtagggccaatttgaactgaataatacagtattagtatacattgctccaaaaataattcgaagtggtctcaggttaaagaaaggcaaattctctatccttctaaacttatcaagctgtttacgcagcagcaaactggcttacacagtaaacgaaaaccaccacaagaaacaagggagcctttagaataaataaaacggctacacatagtaataacactagcaattgaacaatgttggtagcaagtaaaaatggcatctcctagcagaccgacttgaacataaatacctacagaatcacccgctcgttcatttaatccgtagtattgactgcttagttgccgctccatcttcaaccagctagctgcacaagagttatgcaatggctgcacttatcatgacattcacaaaccgctccgacagaatcatgcggggaaaagaaaaccagaaaaatatggatactgcccttctctattactcctaccttcacaagcatggccataaaaaatcaacagtacaacatattaggttgcatgcctcaaatcatcaaatcaacagggataggctatctcatatttttctcaatacgaccggatctttcaaaaaaaatatttttctcaatatgaatccccatgactgtaggctagtgagcctactgaatgccttgctcctgcatttccctaacagattcttcttttaaggtgagctgactagcgtgtgatactcaacaaatgacggcgggcaaatttaacaggttatcgtaatttgcattgatttgacactatacctcttaagttaagagccttacccaagaaaaaaaattataatgcagaggacaagacaatttataaactaataccagggtgtaaaagataggaacatcaaacctctgttttgggttcctcatgcaaaaatgaccaaggtcctgatttccatagaagcctgcgatttctcaaattattaagataaaagcataaaagagcatccattagatcaattacagaacatgaaatacaaggctccaaaagggaaacagacataatattaaaaattctttatcgccaattgttatattcataaaagtgatgaaaattgggaagatacccttatacaatatactgcccagtgcatggatatacatcaaataacagaaatttgtcctatccacatgaaactattagttatgttctcctaaataaactgcaaaatatgcgtggcaattcactgaacagtcaattagtttacatgctccctgaaaggttacaactttcatatagaaaataagttgatcttcaagataacatgcaaatatgttacttattgtggcagtaacatatttcgaccgctatagacgtcacattgcttacttaacatagtgcttttagcaaatacagtcaccctaatcaattgccaaataacctagaacatagggcatgtgtagcaagtttattcccaagtctgcaagaactataatttgcattttcacagttgaaccacatccacttagttcaataaaatagcagggcacacacgcgcgcgcgcgcacacggagagagagagagatcacttacatggctatggtttacggttacagaacaacacaagatattcattcccaaaaaggcaaacatttttaactgcaagatcatgtatgcatgcttgtctttttacaccggattagaacaacaaaacaagaaatataatcacctgagaatgcccgaagccatgcgcaatcccataagtgttgtcaaaccagcccaaactccagcaagtccaaaaacagatggagcatataacaaaactaatgatgacattatcccaacagcaatctgtatagccaaaagatgacaaagaaatcaatataaagtaaagaaaaaagagagacaagtgtttccataccgtagcnnnnnnnnnnnnnnnnnnnnnnnnnnnnnnnnaatgcagaccatcaaatatgaatgccagagcattaattggttgactggcacatacaaactgaaatgaagaaaaaacattagaataatagatgtgatgtgataactaaatgataaagtagggagatgtaccaatgaacaagatttgacaaccattaggaccacagggtcactggtaaataatcttgctatattactgaatgaggtaaacaggccagcgaataagcttaatccactgactactcctatctgcaagaaaatctccatttttctatgttaacaagaaagggcgattgcatctatgaatacatgaaaaacaaagcttcacaatagaaaacagagaaatgacacatgacctgcaaagcaaacattgctatcttctggaccctcttgtagtccaatattgcataggagcttgctatcattgcctacaaatgcaagtaaacttaagtctgaacattttgattgcacaaatcatgatatatcattgagctagaggaacaatctttgtattagtagtattcgctagaagtttgagggctcgatgtaaattacaatttataaagaaagaagtatgtgaaatgaagccgatttaaaagtgtggataccatgtacaatcaaagatacacacctgggcagaaacagctaaagcatctgcaagcaaagataccgcaagccatacttgtagcatatctgatgagctgccatagctgttgggccttgtcgagcagccattgatgtccctatggtcatcgttaataaaatcgagagggttcttcctaacagcatgccacctaagcatttcaaaaacagatgatggaattatagatggtggtaagtgcaataaaaggaaaaacaagataagaagtatgaaattataacatggaggttctcaggatgcatatcatag

SEQ ID NO: 61714 - DNA, 41140 bp, Oryza sativa
  unsure (1)..(41140): unsure at all n locations
tcaccttttgagtttaaatcacaacctcaaacgtaatactagaaatcttaacccccaacttacaaaaccgatttaaattaggtcctccgacaatatagaaggttggtttctctaacgtgacaagttgactatggtcaacccgggtatcagcatgggacccacgtggactccacatataagtcggaaaaaaaagtggcctgggcactggaatcccgatgaacgtagtgggtatagtgacttgggcgttatcgagagcaggttgagaaacccactcaacgaggggattatccctgccgatgtcaccgacggtgaggggtgaggatggtgtggaggggcctgctatcccgcaactactgctccagtagtcgttgtgacgttggctgcggtgacaccaggtggggtgcctgctatccaactgtggtgaaaggcagggttttgcgaacaggtgtgtgtgcacgcatgcgcgcgtgcgtgtgtgttggggggaggaggggaagggacaaaggtggagatgaaaggcgggcgaatcttctagaggcgcatggagagaggcttgggttgctggtgctacggtggaagcaggcagtgaggggaatgctggtgcaacaacggtgaaggggtgccgacagtgagctgctggactatatcgtggaactggttcttgctaatgttttagacatgcgactgtggagactgtggagtggccttgcagatgttgtggctgatcatgttaacgccaagatgcatgttggtgttattgttggtgcgatccatggcggacggggataaaattagcggtcaggagcagcatgcctaggcgattgggcatggtggcgaagctaattgtagtcctggatgaaggggagggcatggacatggcggattggtggttgatgttatgcacggagatgagagaagaggaagctaagatgcacatgaaagggaaggagaatctgtcctcggcatccgcatccctgtgccctgcctagacctcaccgactacatcatccttgatctctacctcctatgcctcgctgtcgaaacttgggatggagagataggtgcactgtcgctaccgtgtgctaggggaagaggtgggagagaagggtttttcttgtatttttctgtgcgacttacgtgtggacccacatgggtcccacgttaactcaattggattgaccgtagtcaacttgccacataacaaaaccaaccttctatactaccggaggacctaatttaacccggttgtgctacttggggtcaaaatttctagtgttatggttgagggatgtgattcaaactcgacataaagatcatcaagtgaacttattccttgatcattccataggaatccgaccttttcctagacgaagaaaatggctcgcctaatatctaaaactcccagaactaaaatgcagagggagtacctaaacaaactgatgtccatcgatggttttcaatttaaaagctaataacgcactggtaagagcaggtacaataaacttccccttgccggttgaaagggtcaattaggcctagagggggagtgaataggctaatttaaaactttatgcggaagctaaaactgaaataaggtcggaaagtctgatccacagtcagactatctgaaaatatcagatagtctgatattggatcagactgagcacaacaagtagatctatcacacaaacaagagtaaagcacaaacagcgactagatctatagcggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttccttaagaggttgcactaagcactcctccttccactaaggggtatctctttccttgcggaggcgagatccggccttcacaaacttctcctggccaatcacacgtagattagtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagaaagagctcaaagatccaaagcaccttagcatcaagctcaacccaaagtgaatgagaatgaaatgagttgggtaaccctagaaaagggttaggtggggggtatttatagaccccccaaaaatgtggctgttggaggggaatctttcagcccatgtcggatagtccgatacaagatcggattgtccgatattttaaacctccaaggcaacaagaaacagagaacgaagttccatgaaattttggactttccgagacatcggactatctgatgttaaatcggagtatctgatattttagaagcaaaaacttcatcctcaaacagagactcaagttctatgaaatttcggagtctctgtatcatcggactatctgatccgacatcggatactccgatacttagaaaaactcactcgataggattttttcaaatcaagacagagagtgaagttctgtgaaaaatcggatagtctgatgttgctcaagtaaaactgcaataactttttactccgaactccgatttcgaagatcttggactctatggaaagctagtatcatgggctatcaaacccaacataaaacatggtccaaaacctttaagagatgttgaaaaacttgcaaagaaacccggtgtaagtgttgtgacaagtgaaacaactcgggattgaaattttgacttaggtttttcaactcacacaaagatgaagcattttgagcactaatattctaccaataatatgcatgtggtatccctcttaatagtacgacattcctacgacacaatgtaaggtaaaagatacaatataccatttgatcattccacattgcatcgtgatgtcgcattcatggggtatgcatctcattacaacatgtcgaggacataacaaccttcacatttgcttgaataaaagtgttagttctctctaatcgcattgtaatcaatcatcaaaatcattaggggcctagatgcactttcaccggtgatagggatcccacgtactccctccgtcccaaaaagagtcgaactctggaggggggagtttgtcccacaaaaaatcgagtcttgcgcagaaaactagaaacgtcgtctcggtggtggatgggcccacgctctctctctctctccagtctccaccacccgagccttatcccctcccacgcatctttctcgttctctccgtctctctcgcgcgagttcgcacaactcctccagaatccccatcgcatccaccacccagttcccctcctcactccacccatctctcccgctcctccccacaccttcttccccgctccatgccgctcctcctcactcccgtctctcccgcttctccgcgtccacctgcttgcggcggcggcggatagatccgttccgaggcggcggcgaccacgacggcgggtggaggcggctcggatgcttcggagatgtgatgcacaaggcggaggcgattgatggatgcagtgctgttggcggatttgatgcagatttaatttcttttttgttcttgattcttctgtgttttttttgttcttctatgttcttgttcttcctagttcatgcaggtgaattcaaagcatttcgtttggttgtagagatgttatcttttcctttggcaagtgtaaaaattgattggttcttgctcgtgaattcagagcacttattcttctctttttttttcttttcagattggagagatatctcttctttctttctgtagtataaaaatccaaattttctagcctttttgtatacggcagatgcctcctgtatgtactggagtactactaatcgatggataaaaaaacgacaaaaacaacaaacactgataagggtattttggtattttcacattcgtcctaaacttgcatcaggaatccaggagtagactctttaggacggagtgagtaggctgcattgctgagctagagggaaaaatgatggagagttagcgcaagcgggcgactatttatagtcgctgagctacacacgcatttcaagaaaacggggcccactagcagagcggagaggagctggtcggcagtcaacacaaccacagactgacgataaatatattgataaactactactcatcttaactactgtggtagtagctatctattgtacattttacctacaaagttaactcttcatgacatggtaaaagtttatagccagcaacgggctacactattaaacttgctctaatacagtttgaaattgtgttgttattgttgctattaatactctcttcgttttttaatatacgacgttattaattttttaacatatgactattcgtcttattaaaaaaaatttacaaatacataagatataaataatggtgaaagtacttagtgataaaacaactcacagcaaataaatgataattatgtagtttttttaataaggcaaatagttaaacgagtgccaaaaagtcaacgccatttgttagaagatgtatagtagtataaagtataacatggataaatttgtagatggccaaaaggcccgcccggcctggctcggccccggcacggcccagcagccatcggaccggcacggcctgatcggcacttcgtgccggcccatgggctgcacctcccgcctaggcacggctcaccagttgtcgggccgtgccggcccgaaggcacgggtggcggtcttttttaaaataagcctattttcctccctcctcgttggactgttacatatgtatagctaaaataagtctatttttcatccctcctctttgggctaacatgtatagataaaataagtctattttcctttcctcctctttgggttgacatatgtatagataaaataagtctattttatatccctattctttcgtccatggcatataatatatctatttttactcccctatttttttttggtgtatcaggcctggctgccgacccatcgtgtcgtgccaggccggtccaacgtgctggtggaggggcccaggcacggcccggtggtcaagccgagccggcatggaccagacctccgtcgggccgtgctatgcttgggccaggccaaaatgccgtgccatgggccgggctgtcgggcctcggtccttttagccatctatagataaattctctaaaaaagaagaccttacagaagctgcagtctccagaccacatagatatatttacgtgccggccacgatcacatgacaatattccgggcaaactgtggagacaggtaaggaaagcaagaaaaaaaaactcgcaagtacactacgacacggttcaagggaaatgtctcgagcactcactgaacagcagacaacgtcactcgagcaacaaggacgggtctctgctatgtacatcacgaccgcactcctaaaccatatatatcgattaatgctcctgagaaccactgcccatcacttggccacctcaaccccgatcctctctgcaacctgcgtagtttgaaataaccattagatagagagtacactgtacagaagatcattctactggaacctatcggagattcggagttgtggatgaaagggaacaccgaattacagaaaggatgctaaagaaagggacataaaactcccacatgattctagagcttcgatttaaacttcaaacgataaatctcccacatgattctagggctttgaattgaacctcaaatgcagcaggttcttctaaacaatgacaagttgacagctagtagtgtttaatgcgctactctcatgccagacatcactgtgccagtaatgcatgaaagatctgttgtaccttcattaacagtcgtcaaggcaacccctgacaacacaatgcacagttgcacacatagccagtaaacgaacctcacatagtcaaagactttgatgatgcaatttgattattaaataaatgtaagagcaactaacataaatctcctgaatgattgctacaaaccatgcagatggcatagtgttattaaattatttacaagttgtaaagaggatggcaactctgccaggaaacaatttgcaagagaagaaaatgactaatgttggggggtgtacagaagaaatacctccttgaaagagtgaacatcacttccccatagccaggcatcgcagcctgcatctctagctccccatatatcattctacgatcatcgccgacatgcacggcctcttcaggtttgacacctaaagactcacatgccttcagaaatattgttgggtttggcttttctgcagcaacctgttgtagattattaatgggaataagagaattatatataaaactgacttcaacagaatagataagagtatatgacacgagcatggtatgcatggaaaagcatataatgctgaagaaatgacaatataagtcgacatacctcagcagagaccgcaaccgcatcaaaccagtgatcacacttcagaacatgtaacagaggccgtagacgggtatcaaaattggagacaacagcagttttgacacctgcctttcttaaagctttaaatacgttttcagcatcaggatcacaaagcttccaagcctatcaagcaaaaaggattctcattaggcccacaaaatggaagctgaactattttcatacgttgaaggcacagttaatcttaccttctctgtcatatagtactgatatagttcctcaaagtactgcaaatctgaacagccagtagaagaagtgactatatgctgccaaaagggtctaccatcatccacataccttaaccaagttggaaatatacgaagtgagatcaatcttaaagctgtctaactaccgtcaacagaaaatacgcagtagtgcagtacatggaacataacaaacaaaggaaacatcagtcaaattggaattcaactgaaaagaaaacatcatgaacaacagcatgttcttgatctaagcacaagaatgttgaattccccactgtctatacaatttttgaaccaaatatacaacatcccattgtttgtttatccaaaaagggcatttcaggaggcaacagaatggtagttatccacaattttttttatttggtagaaattcagtgtacatcattgttaaggtgcataccatcatatcctttttgtcgttatctgcaaaatctagggatgctaataagaaacaagtaacagctgaactgaaagtagttactactaattaagtgatggggcgcttgctgtccaataagaatgattgtgaattacaatgaatatgtgctgacccttcaacatgttaaggaagaaggttacataggaaagagaactcgaactacatacacagagtcaatgaatacccagtttaaatcttttatcatgattcattatttgtagatagaaagacagtgagttcacacagatcccttaaccttataagctgacatgtgtaaaatgatgtttgtgcttgtgctctggcaaagcatgtaattgccaatttatgcaggtttacgtgaatgaagctgcttccagcttagaaaaattctaaacatttcacaatgacttcaaaagatgcttccagcgtaggttttcatgacattaaaagtcagcagaacaatagtcaataccagcaagttcaacttattgttactcaatcaaggtacagattgcatcaatataataatcaatttgtatgcaatatatataccgcattcaacagaataagatttaaacagattacagttcataaacagcagcaattacacaagtatcagatcagatgatgagatgaatgaattggcactttggcagtcaataatttcgcgtgtatataccacagattcgcacctgagccgtgatccgccccacggttgctcatacgcacgccggtatctcgcaaggatctcatcttcggagtacttcactccatacttctcaccaatgctcttatacacctaaacaaaaggggaaaaaaaccacggttcaaagctcaaacggtcagagatcaattcatcgcaggagcgacatcgcactgcaaactctgcaccccaacaattccggctgaactccattgatcagaccccgagacccacacatcgcagtgcgcactgaggagacgagggccaggagctaactgaccttagcggtgggctgcgcggggacgacgagggtgccgacggcgtcgacgaggagggcgcggtgggtgacgtcgccgtagacggacttgcggtagtcgtagtactcccgcgccgccgagagctcccacctcgccccggccccgccctccctctccgcctccgcctacgccgccgtccccagccaccgcagcccgccacccttgcgcgcccccgcggcggccgcggccgcggcagtcgcggaccgcagcgtcgccgtcgccgccgccgccatctcgatcacggtgggggatgacgccggctggctccgtcgatggtggtggaaggctctctctctctctctctctctctctctccggagagccgccggggaatgcggggctccggttgtcgtgcgcggtggtggcggagatggggggagagggtggcggccgtgtgctgcactgttgctgctttcgtttcctttcttcttggagatggacttctgttggtatcggaccttctagaacacattcctttaattttttaggaagcctgaaagggtaaaaagaaaaaaaaagtgagtttgtatgaagacagccaagataagtttaatttatcaaaataggaggactccctcaattccataaaacacagactaatatgatatctaaattagtaacattgcaatatggtatatcatatattagatcatttttatagaacggaagaagcatatgtttttataaaagctacgaattctaactgtctgaatatcaagctgtgaaataaaattttgttatcggtatttataaaagcatcaccaatagtctccttattctatccacaatcctatttttttaaggattttggtgaaaaaaatagctccaacagatcttatatttgatttttttttaagtcccttccatgcatcctttgctctcttcatttgagggagagcgacggggcgtttgccgtccccaatctctcattccgcgtgtttttttttctcagggggagtgctaggagagcacgctagagggaggaaaacaggaaaaactgttagagtccactttatttttttaggattttggtaaaaaaaggctccaaccggtctcatatctgatttttttttttgaaatcccttccccgcatccttcgctctcttcatttgagggagaaggacagcgcgtttgccatctccaatctgtcattccgcgtgttttttctgggggggggggggggcaggagagcgtgtgagagggaggaaaacgtgaaaatttattagtttagcagaagagtccacttctaatttagggataaaatttaggctttatcttggcgggatcagttttttggctatctattttcagattaggaaacccaaaaacaacttttttgggagattatacgtaatctcttggtgatgtgatgctaaacctctccgcttttggccttgcaaaattctaaggttaattgctcggtaaattggttaactttaaaatattaaattttactttttaaaatgaaaaataatcaaattccactggcagtcaacggtttttaatttttcttttgaaaaccaagaaataaatatcaataatgccttatttaaatgtggtttggttttgtgaaaatatgtgtgtggtcatattctaagaaaaataaacatgtgtgtgaataataaagagacattgcagcacaatttctagattactccattggaatttggaggatggcaggaaagaaggataatgatagttgcatgctgcatggaattgagttatggttaggattggtttggacatttgctttcctatggcccagtggcccactatgttataatgatagaccacgtcattggttccataggatagcttctagccaggatcatttcttctgataaattttcatatatagtcaccgtatgattgataagtttccatatattgttcatacctaactctattggacgtatgcctaatattgtttaattataagaaaaatatcatttgaaatggtctaagcaacgtttgcaacatattttgggacaaataagatgttaaaaataaagttatgttggaacggcagggatatatgttttttttagaaataaaaaattcaattatgccatgagtctagcaaccttgaagtttgaggcgtcttggtcaaaagtgagcaaaataactttgaagtcacgaatatattgctatagataagaagaaagtagttcatatgagtactatatttgtattagaaacccgtaaaccgaaaacatgtgcgatggtattgacgcttccgatatgattcttaaattaataaggtattgttggaccaaactactatcaaatttgtttagcattgttcgcttgcaaccatgtgtggccattaaaccaatctcgcattattccctttcaaaacaaagggagaacacaaaagcactcacatcaaaaatggttctgtgagacattacgttgttgctcatcatactagaatgtgtcatatctagttaaagtttcttatattttggaacgaatagagtgctatgtttagatcagtgccaaaatatattatatagttataggagacaaatatatgattaaatattgaaattttcggtagggcttaaattaatttgagtaaattaagtttatgattatattttagtatcaaagtttcactttggatcacctttcatcttatcttttcactttgaacaaagttactttgactttgttttattttggatcacctaaaacaacttttctcaagcacatcaattacaattactttaagcacatcgacacccataaaccggcatgtcttcacaacttacacataagtattcattgcaagattagaaagtagatgtggctagacaagtaatttggggtaatccaaagtacaacaaaggtaatctatctaatctaaaataaaaatattactagttagagagtagtccaaagtgaattttgataataaagagaaacacctaagcgtcttccggttaactccgaaaggttgtgagctagccaacatgggttcggagcctcaccccttctatttatttgatattaggttcttccctaatattcaccttttttatttttgataataaaagatggatttaaagtgcaattacatttaattttctgtatcttttggtctgctaccactctaccagtaccatattaggttattccttaatattcgtgttttttaattttgataataataaatgaaataaagtgcaattaaatttaattttccgtccccttctccctcctctctgcccgctcgagctcgccgccgcctccccttcttcggtcacattgtcgacgaggcgtggcccgcccagttcatggtggtgaagagatctccgacgtcgagctccatgtggcagagggcgacgggatcggcggcgcttgagctctctggcgtggatccgacatcatgcttgctggatctagcagagctcgagcgccaaacaggtccacagatctggcatcatgctcgtcggatctagccgagctgccgctgtcgtcggcatcttcccggagatggcgtcgatatgttcagagctgttgtcatcaatgcgaatcgagttggcttcctccttggctaccgccgccgggctccctctcctccctccctggcagcgtgggccacagcgaggtgtgggctggctatggcgacgacaacctctagctcgttgtctcgtcggtagcctccagttcctcctttttctcctctacaacttcccggaccatacaaatcgtcttctctctctcctagaaccaccattcaaccactgttttctctgcatgaacctctgtcaccctgtgagaccactccaaacctttagcgtggtatctgaatctaagtgtaacttaaaaccacgggtgtgagacaccgcattgtaggtgtgtttggttgggtggatgaactcggatgggagatggccacccgatttttttgtggtgtttggttggaggtcagggtggatggggcagcccaaaatagggaatattccctcaatatactggatgagtgcatccggccgatttggctggatgaagccatccagttttggtctgggtgatgtgtcatgttctgattggctgtggttggtttgattttctgttaagcaagctccaaatgactttttctcctaaaccgttttatctaatttatgatttgattacaccattatatttgttacaattaaatctttaaaacaagatctcggatgattatatcttgataaaaaaattatatgataaatgggtctcactaacttttggttgttttcatccatgctatatctctccaaccaaacaagaaattagatcgccatatccatacaaaccaaataaaaaaaataaatcgtcatattcaataaaatatggatggctatatgctatccatacgtgaccgtaaacatagaatggtcttatgggacggagggaccagggagtactcctcgggggtcaggtcatcggcggggtgcgtggattgcgccacttgtagaccgggccccacatgccagacgcatcgatgcttcgctttgtttacgcggcgcgcctctctttttccttagccaccaaggctcagaaaccgcctacaaaacggcgcccggcgtcccacggatcaagcgaccccctaaaaaaccaaccgaaaaagaaaaaaaaaagaagcagagaaaaaagctctcgcggcatggattcgcacgtaggcaagttattcgattcggtgggctcgatcttccgcggcagcgacaccctcccctggtgcgaccgcgacatcatcgctgtaagcttccccaccccatcctcctccccctcctcctcatgaacccttggctccgccctccgggttgatccgtgtttggctctagtatggccatttcttttcccccgcttcgtgagtggatgtttcgttgtggctgcgaattttctgtggaatgtacgcgctctcgcgaattggaggttttaggtgttcggtgaccgctaaatccctagctattgctgtgtttgtgctaccatctgctccgagtttgcgtttgttttagctattgtcgctcggtgatcaaacattttgatatcatgtgctattgtcgacatctgcggttgaatcacaaaattagcccccattttaccctcgagctaccgtggtcgtaggcctaaacgaactatatgttcagttgcaagctgctatatgcctatattcacttgcctcgcgtatcatgttctctgtcctaatctatgtcatgccatgtgcactttttgtcttgttgaccagggttgtgagaacgaggttgcggaggctgcgaatgaagaacagaagaatgagagccttatgaggctttcgtgggcgcttgttcactccagacagcctgaggatgtgaaccgcggcattggaatgcttcaaggtaatgaagccacatacatcctttaattttttttagcatttggaatttgttaatcaattcaaaagctgaatgaatagagtagtagtttactgtttctaacatatgaatgtttaccccatcactttctgaaaatttatacgaccatgataatatgtgtctccccatgtgaactatttatatattatttttggtcatgaaaacatttatcagttctccagaatgcaacttgcttgaccacgaattatctataatgtgtctgtagggccgatattattatggtataatgaaagtactttggggacaaatctacacataatttttgtgtatctaatctaaatatttaaaagacatttctgctcaaagtctcgatgtatgtccaaatgaagatgttttcatgaccaaagggagtatataagtcagatattgttaacctggaatacaaatctatctggaaatcatgattttaattctgacgctgtttcagacttatatatttaagtttcaacagatgagccacacattgtctaacaatttatctagggggacccctttttaatcgaatcaaatagcttttaacatatgttataagtgtcctcccacatgattacccattctgacgctcctattaaacttcctgtatgcactcttctgaacaaactttattaatagtgccgttaatatggcactctaatgctgaatcaaaatgtcacttcattacattgtgtcacctataaagtgatattccaatccattgtccacattttcttgtatgtcaaccatttttcaattttctttaacacttttttgatcggttggcaatcagatattgtatctgaccttcctgctttcacttgtggttgggggggactcatgtttttctcttggcacctggcagcttctttggacaggtctaccagtccactgcagacaagggagaagctctacttactggctgttggacactacagaactggtgattatacaaggagtcggcagcttttggaaagatgcttagaggtttgattactgaatatatttctaatcattttatttgctgtttccatgagcccatggtcgctggtaccattattgttgtatggatatgagatctatagatactgttgtaaatggtcatggtggtaacctcagcttgcaagacaattaactgattttaattgattatcataatattgcatttttatcaacgaagcatctgttagtttaaaaatgacaaagtagaacaagtgtatgacctgccatcatgttcactcaagacttgaagctgctataagagaaacaggctgctttgtagaattacgctgtttagattggattggtgccaatttttgcttaacataatgtgtttgtctctttaatcagatagacatctgagatatcttatttttgtacgtttagattctaacttttttgagattatcctgaatttgatgttaatgaatgcacatttatcaccttttgcagattcaacctgactggaggcaagctctcactttacaaaggcttgttgaggacaaaaccagaagaggtagggtatattatttaacatccaagccttcttcagactggaaaatgaatttgcactcaattttcatttcatactgttagtataattgtcaaatatattggttaggggaactgtagttatcagcagggcacgcatgaaagttgatattaacaaagggtatcttagttatgtctgcacttcacattataaagaaagaagtatcggagcagctcagcaccctcttgtgtcctttggagatcggaacaaagaaattctagaagatctgtgtaggaaataatctaattccaatgaattttagtaaaatatttccgtactaatctaattcgtaggagtacaatggtttttgcaactcggatcgattgaaggatgggcattactgactgctttttaaatgcagacggtatgattggcatggctattgtcactggtgccttcggacttgtgggacttgttgctggtggaatcatcgctgccgcttcttcttcatcctcatcatctaggaagaaatgaggaacccatatcaagtgaataagatgtcaagatgggcaagaaatcgatgtaaatatgcgcatcttgctgtcatacttgttgcaaccgtatactcacgtctccatttttcagtccttttaccatgagttcaaacaggagacatcacatgcctgcatgttaaacatcatggaagatgaggaggctcctgttatgagttgcaatcaggatttacgtaaccttgtggttatcatggttatcatgtgcagtaattttctcagtttttgaaaccacggtaaacctcgcggtggccgcacggttaccacgataaccatcttaccgtggggtggttgtaaccccgctcaaaatggtttggtaaacctggttgcaatccttcagtacttgaactgatggctactaccttaaattgtggagtaaaattttaattaactagataatgtctcgtgctttgttacaggatatatgttaaatattatagaaatgataaaatgatttgaattgaaatattgtgaaaatgatttgagaacgatgatttagcatgtgtatattgagttttagaatgaaataaattgtagatgtaattactatatgcatacttacatgttgagttttaggtgattacggattatgtatgttgaccttagtgggttgatgtatgttgagttttaggagtttagtgggttataatggtaggtatagatgagaggcatcttttagtttcctcccgaacggtagaaatttaaccgtaagatgacatatagatggtgaactgaatgaacattggtgacaaccgtcagttcaagtgagagaggggatcgggagagatggtttcattttgttcttttttctttgtccacaaaagttatcttgtcattttagaaagagaaccttggtaaacaagaaaaatatgaaattaatgatcctagttaacatggaaaaaataactgcaaaaagactaaaacagattaaagattacgagtcctcattgtttcatgtgaatacaagagttggagttgagagtggagacatgtttttcacggttggttgtattttgattttttttatctatttatgatgtataaatacattaatcatgttgggtttttgaagaattacgcttttgtcgtggcaaattttttagcatgtaatcattgatgaccgatagtgtcagaagtatctagtttggatttaaattgacagcaacatgcatataattagtttttttttctaattcaaacatttgttaaaaacaaccgttaacctccgccggtcatatattagtcacaagtatttataaccttggtttggagtcgatctaaataaaatagttaaaattattttaataatgtactatttcaacaccatatctatatctatacctaattaaaaaatacataagacttctctgaggattttcgttcgtcttagtccgtcgtccgcatcatgcgcacctcctctccacttcatctgccgttcgcccgtgttaacgcgcattcgctctgaagatcccacaaccaatcccaatcattataaatctaaaaaaactaaatcctagtccaattggtatcatcataaatccaatcagaaatcgcaaaataaatcacacaagaaataggaggagaggcggaaatcacacaggagatgagagatgagaggagagggagtggcaagcgggaggctgccgctgctccttgccgcttcgccaccgtggagatcccgagctcaggggccagatcccaatccgccgtgccgggggatgattgagagggagagggaggaggaaggtggcgacgatgaggccgagaaggtggtgtggcttatgaaacttctgtatattttttttcacattggtttatattagtttcaacatcacgcaatactattaaggaggactgatgtacttttatctcaacaaattaaaactatagtgggagccgggaggtctccaaagactcagagaggtagggaaaaaaagtaagagagcatctctgagactcttaccagttttattgtttggagggcatgtttgattactcgtatttccctagcctggctaatctcctttatataagtgagtgtggtatggataagagcatttttaagagcctcttaaatagactctccgagccaaattttggcaattcaaaaaaataaatttcactccaatagccaaatgacttgccaaactccgtccctcatgaggagctgtacgcggtgaggcgagccgaggtggaggagatacggcggccggaggtggagaagaaggagagcgaagaggttgacaggtggggtccacgtcactttccacgcgggcatgccatgatggctcaccacgtaggcaaaataggcaaatagttaagaaatcacctctctccaatgataaattattaagagagaatttattctataccactgagtttgttcgagttcaacgatttaccattgatattgtctctttctacgatatacaggcgacattatcaatgttctacaatacgccattgggctggatattcttttcaagaatacccaaaatacccttatggacatataaagttaacaattgatttatcccattagaagttttcaaaaaaataaaaactttgatgtggcctccttacacaacatgaaagttcgtataaaagtttcaagttttttaatttatatttttaaaaaaaagatgtaacttatctgttatatgctatacaaaacacttttttatttatgttttgaatataaatcatctttcatacactacataagatatttttgtgctattatctctcgtataagcaaattttctctcgtatactacataatttttttttctaacaataaatataccagaaaaaaaacttgaaacatataaacaaactttcacgttgtgtaacgaggccacataaaaatgttcatattttttttggaacttctaattagataaatcaattattaaccttgtatgtccataagggtattttaggtatttttttgaaaagaatgcccaacctaatggcgtattgtagaacaattgataaagtcgccggtatattatagaaagagaatgtcgatggcaaattgttgaactcgaacaaattcagtggcatagaatatattctctcaattattaaatacaaacctcatacgggtatttggataagtgaaaaatctaaaagtggcaaatagttaaattccccgcatctttccgctgcctagcagttggaggagagaggagaaggcggtggcggtaacagagaagggaggcggtgccggcaactgagaaggaaggcggcgccggcaatggcaaggaaggctgatggaaggagagggcggcgtgatgctgcggttggggtctgttagtcatcggtggatctggtgcgttgaagctttatgaagggagtcagcatccggcaaggaagacggcgccgacgacagtgaagagaggaagatgatggcggcgggaaggacaacaccctcaagcttccagatctgcattgtcctctcctacgtcctaaatcgggtgccaagcaaatgagggaaggcggtgacgggacgcgttgacccccctggctagcctcgccgaatccgctcgttcccgcgttagcatgactccgagcaagcgatgccttttggtagagcgagtgataggggcagcggcagcagggccttccttcaccgtgctagggatgagtggtgagctaccggatttcgattcaacttagagtatctcttttacagtttcttattcgaatttcctttttcagagttttggttgtttcttccacggctcaagattgtttgtgttctctagattgaattttcactgaaaaactttgaacgctaggagaccaggagaggattcacactcttccgtagtggatcagagatgagaggaggagcatgtcgtcccatctactccatgccatcccctctcacaatagatggagcatgtcttacatggcttgggaggacgagctccagaaatatattatatatgttcttctttcttatctctctttaatcgattcggttttaacatggcaattgatctgttggcactagtatcgatcaatttgtatcttttttttttgtctaatatctatcaatttttatccctttttatctgatatctgagttagtttcactttctgtttcttgtctcgcttgaggggacgtcacagactcctcttccattgctcactgtctcgctaggttgcctgccgaacaaggctctcttttgtcaactttctctgtcttttattcccgttacaactcacagcctctttgttagcctctttcttaaaagacaagaaaaggatgggagtacatatgtataggagatccgtttggattgcgatctgtgaccgagttgtacttgtacgtggccacggaaactggtaccggtaccgagcttcaacctatataatctgaacgtgcatacctcaatccgtttcaaaattgaatctaaccatatgatatgacataacgtagcctagattgatttatttcagacggagaaagtatatactcctatattacacaattgactacaggaagatcaatctagttgtacttgtacagtcttcggttctatcctctatgggccttcctagctccggcggcccggcccacaacgcgagccttggacctgctcgcacatggacctcctccctcttcgcccgccgcgccggcgacccctccgccgccatcgccggcttccagcgccgcctctacggaggccaccggcgccccgatgtccctctcgccggcggcagtctcgccgatagctacgccgagtgagaaaccccctccgaaaattatatgttagcgaatttatttgattgatcgatctatctgtttatatgtggcattgatgtgatgatcaggccttgatgagattagggcctttatatattaattaatctgtttctgtggcatcgatgccttttcttttttctttttaattattatgttatttgcaggcgtagggttgagattcccaaaagtttcgtcatactagaagatattctgcaacacaccctgtctaatatgcacagtatccaggaaagcatactgttctggcagtccaatgctctggtatttttacgccgcaaaccctttcttttcctagactcccagtatttagatatgattcttgcatttatctatctgccatttacctatacttggaattgtttctcttttcttttcagagaacaaattcgcagaaagcgtattttatgatctttcaaagaggtccaagggcctttgttgcaacaacatgtcaaacgctggctaaacttcagaacaaagggagtccagtccagggccttttggactctgcatcttctatgttctcaacaaaacttgccatcctaacaaggatgcaacactgcttggcttcttttcttgctgaggtttgtttactaaaataccaatattaaaaagcttttttcaaagtcctggtctcttcccaaaaactgaggcatggtcagcttcaaagccagctgttggtatggcatatatgaacttaaattctacctttgcttttttccataggtttacaatgaaactgacaaacgcagaagtgtattaattagaagatcagaacaatcgctgcatagtctcttcgttgctctgaataacatcttctccaatttggaggtagaacttagaaatgctggtgaggtatgaaatgtttttttctttttaacttaattcgagattctaggtgtaaatctttctttgttgttttctaatatggtctcggtttttcttttccagcagggggctgtattagcgaatcatgataataactcattcgaactcttccaaagattgccagaagctgatgttcagagttcagctgctataagtttgatctatgaaaaccttcagaagttagatatttttctttcctctcgggtttgcaactccccccctactacactttcacacgtgatttttttttcacttgtcagcctcgcagttcccagattactgttacctgtattttaattgggacattaaggctgtgttcatttggattaatatgattatttcaagcaactttcctatagttttttttgttgcaaaaagtatattatttaacagtttgagaagcgtgtgtacggaaaataagaaagccaaagttggtaagggggagaaatgaacgcaccctaaggattcaatgttgtacccaagtttttttggctactagtttgtgcttttagtcgaaactcaaaaaagtatttttaggcatatgcaagtaaaccaaaaactgttccatacatgaatggtttcaaatgagaaatcagtgctactgctaattattctaaagtaccaaaaacatttttgggtgattacggaaaatctcccacttgaggcatcaaaatcaactaattaatcatgtggataattgacaaagtgttaaatcttgtacatcaatatcagatttagtagtctagcaatcctttttacataattcacctatttattttattttttatgttagaaaactatatgtgggtcttgtactcttgttcatctcacaaaagtagatcttccggtgcagttcttagaagatatctatatgttgcttataatttcattatgccaagaaatgtgttgcttatttatctgaattctgaagcaagtaattttatgcaatgatagctttcaagccataaaaagccgagaaaaatgaccaaatattggttaccctacacatttggagcattgggcctctctgcatttaccctatggcttttacgccacagtagcttgatgggaagttctgacattgacaactggcttcatggtgctaaaaagttgctggtttggtgttgggatgagaatgttcagaaaccagtaagatactctatctatattctattttttttatttattttgtgcacaatggtagtgcaaattactccctttgtttttaaatattcaaactttcaaaggtttaactggatcttgtccaaaaatcaagtgtttgtgaccggagagagtggttggttggattcgcagtcagttactcccttcgtttttttgataaatgacgatcaaacgtttgtccaaaaatcaatagcgccgtgtattaaaaaacggagggagtaactgattgtgaatccaactactctctccggtaaccaatacttgatgttttttggacaagatctggtcaaaccttgaaaccttttaaaatagtaattagttttaaaacataagattgatttgtgtagatttgtcttcaaaagtattttcacaatcacagttctaaatttctaaaaataaattgtgtctaagtcacacctcgaagaccatgaaagaaaaatgtcaatgtcatgcactttttactgaaagaaaaaaaaagatcattctctagttatctcaaacggttcatttaattttcatgtgtaaccactaaattttggaagtgttgctacaacaagctcgtccaagtttccatatatttatccactatcaagatgaacataatgatctgtctagttgttcgaatttggaaattagtactttctgttgtgtcactgaccgcacgcatgacacgttttttctattatggatctttaggtcagttctataaggtatctcaccaatacactccatcaaagcaaaggtgtaacaggaaaacaatatatccaattccctgaagatacattaagcaaatgcaggaacatatcgtcttctctctgcgaaaggtaatacctggtttacatttgagtttctgattgaaaataaaataataaaatgttcccttaaggggttatgagaaatccctatgcaggggcggatccaggatcaaaaaaattgggggggactcaattacacagtttcttcaacctccagccatctaaggacctttagattaccattcatggtgaaaaaattaaaggaggtgctcggggggtatccatgggtcttgtgggtgtagggagtcccccctacacccacgttggatccgcccctgtccctatgtgtaatggcatattaatacataagacttgaaaaggttttctggtggtcaatagagtccctggtagtcactttgtagtcaatagagtcccatttctagaattggttatctttatagaagttaaatttcaaaatcgattcaactcaatatttaaagtagaaaatttccaaatggacttgatgtcaatatttgccgaaaatcaattcaaaatcaatctttctttatcgtgcatagcaatttgcagtttcatcttgtagaattcttatttgacattacagttttgagttatttgagaacctgtttgaaccattgagtgtcatggttgctgaatccactttctaataatgtacacaaggcagttaggaatagacctttatagcgtatctcgtatcgtacgtccatgaagctatatgtcaaattttgatccaaataatgtcactatctaatcactaattaggatggcattcaattgcaataccatctgccggagaataattatgatatgtacacgttatttagctattccgaattactctattttgggtgatcctcgaacaattgttctctctatcgtgctcaattgaaaatgtgagtatgtttgatcattcagctatattctatgcatattaagtgcaggtatgagatggaaccaggatctcctgaagaattagcatgtctcatgattaatcaggttattttccttccttgtgtacatatatttgcatttaataaattcaggtcgcttttttctcaccaactttgaaatttcagactaagaagtttttacgggattttaaagagtaagttaaactattcatgtctgacaaatatatattggtaaaaacacacagaaaactcttatctagtataagtattcaccagctgagtttgttggattgttcttgcacagggtaatgccggaattagaacatgttcttagggtacagcaggttactcttgcatttggtcgatggcttcttctgccggtacttctaaagccagcaagggttgtccatgtacgtttattccaatgtttaccttcttctcaatatcacttgcctaagtagtgtattatctccgtcccaaaataaactaacctagacgacgatgtaacatatcatagtctagctatctatatttattgtattaggatgtattatattatctttgagatttgtttattttgagacaggcctcagtatgttctactctattatctgtgtgcctggcatctgttgtgaaaggagtacaagtgttaccaggcttaacatataactgttgacctctggttatctatacaacagggtcaggttacacagagaagagatagaattgcacatcttaagcgatgtcagcttctctctggagtacaggaaatgcttgcagagtttcagtactgtatggacaagggaatggtaatttatctatatctaaaattagtctattaagatccagaatttatattataactacgattattccctgaggatctactttatttcctttacagaaggaagaggcacaatgttcgcttggactattattgtacagcatttatagattttacagaggtgttgagtcgagttcaaaagaaacaggcgagtggatatagtaagtcgcaagtgatcttgactaaatatttaaaatattcctttctatccttgattgcctaggaacccttactatcctggattcaaatgttttttattgcagtatgaaggaacacattttctgtctggcagaccctcaattgggcgtggcaatcaagcgggacattctttcgagtctacggaattataaatgcttatcaccaccatcgagtttgtatggattttagtcgagcatatatttatggtaactattaggaattaataagatcgttattccccttttaatttttggcttctcatatgaaattacattgacgactaacgtgtctaaaccggtgaaaaagaacagcccctaagggtcacttcattacaaaaaatttctatagaagattttttaaaaaagtcaaataaatcaattgtcgataagtctgtcttctatctattcttcttcgaactttctgtcaaatcaaacccccgtcaatcctccaggacccaaacaactcacttttcgcccatgaaccatttgtgtcaatggattggtttgatcaaaaacttgagataagggatatgtaccaaagaaggtctcgtaagtagttattaataaaatcgaggttgaagttggagttaccaaagtttgtggagtcggttttgattgacgtatcaatactctataatgggtgtcccaatattggtgttgttcgggctatgcagcggaaaaagagattatgtattctcgctggaatcaatcacacattctgcccctaaagcgccagattcagacagaacaagagggaaagacccggccgactcgcccagggctcgaggacgagccatacgagagtgagtcgaattctgtttacgttctcggtttggtttgggcccctctcgatcttttgcgtataaggagttacgtcaactccaaaaggattataaggtttaaccggtaaagcttatgagagaagttcgaagctgggacaagattttatcgtctcgttcgagaacttctttatgcaagaaatgggctacccgtgtcgaccagtaccctttttactcagtgtagtacccactcggagaacgtgagagtatgttcccctgccctcttctagactttatacacttgtaaaaatatattcgacagtggtggatcatagctcaaagaacctattccagtgaacttgactaccattggaaatgtcggtgccgtatttctttttcttgtttggatagcttttgagaattctcttaccgaggaaggcacaaaccttttgaagtagtggaattgccaaccctatcttacttttgttttgggaatgctgattcattttccccttttctatactactcattccattctctttgtcttcaatgagaaggagaacttcgtatttggtaccaccacactagatctagtctactcatatttgttcgacgaggtcgtcccgatcagtcccagcgcacgcaccctgtagttgtcggcctttagaactttttgaaagagatggatgtctgggatcgatttcaactcagagattgcctactggccacgaggcttatgaggcctgcggaggaggtggagggaaacgtatgagatgagggatttggacttgctacacttaccagatgtgaggtagttaaatgctttccttccattgcagatatccatattgctatagtgtctataaattatcatatagaaagaagctaaggggattctacaagatgttctgaagtgtcgatatacgacgaacaggaatctattctacaagatgtttgaatgtgtgagtatccttgtgtggatcagcccgaaggctgtcgattttaaaaggtgaagacaaggaagagccattcttcatacataggagcgagtggtcgaaatggaaagcggacaaccggaattcagtacaactatagggttcggttcctctcatgtttacgctaggggatgattctactcgttcatcgacttcccccgcatggagcagcatagatctaaatttaggaggattatccagatcgtagtactctaaagcacaattcttcttggaggagggttggtttgcccaggtgactgatcctgccataatatactcccgccaattctattgcaccggcaaccgaagttgaacatacatacgacgatcttcatgtgtgaagggacgggaggaaagaaagggcggtagatgataatgcgaaagggcgccgcgtctgggcgggcgggctaaatggataagcgaagaacatgttagagacttgaacttcatcggacaagaaggcgctggttgtggtttgattcccagagctagatgggatatgccactggatatttttccagaaggaaattgtcctgcgaaagcgaagcgacgttggctccatactgggaataaaaaagtatggaactttctttgattgcaaaatcatgaaaatggctcagttcgaggggagtcgtaacaggtataccacgcacaccccctttccaagggtagtagtagataggttgagctaactctttcgctataatcttctatctcgcattgctacgtgctcgaaacaaccaattcgctcgtatagctaatgcaacctatagagtttggagagtgctgctattctttccaaatggtctctgagtgcggtctgtcaattcctgttgtagacatctgaggagaggtggaagaagagtagacttactacttttgcaaatcaaagaaagaatttaaacagacatcgtactcgagcgggacactgcagtctacttcttggttttccaaaggtccggaggagcggaagagtttctagtcgagaagggtcgggcattagcaaatccttcaatcccagattcgagggctaaaccactacttgaatgaacaaagcaagcaacagttttgtttttcaaccgagaagaaaggcgggcaagcgggcgccacactcccctataaccttcttgcactccactccggtatatctttactctacactcctctacaagatagagatctacgtttagctgtggaagggatcacggagatatgtgctctaacgactcaacccttttttgaccagggaacgggagaattcccactaccgctggcaggccagccgggccgtgagcgcggtgggaacgggcttcccaaaaaaagagccccggcccgggtcagcatagaatggggggagggatccttcacaaaaggcgaaatggatatgaaaaaaagattgattgaactttccgacggactcatgggatgagtaaaagattgaatgggattcgtttgggcaacggaatcaagtgctggtccccttttctctcttattgaattaactaattcatttacttttgacttttgttggatttttggatatttttttggtgttgatttggcattattcaacaagaataaaagaaaaatttcgataaattcctttttttaattatgagaaccaatcctactacttctcatcccatcagacgaagacgaacttgcatttgttgaataaagaaaagaagagttcgatgtaggaggagcgagcctcccccagagctttcggcagccatactttcttcacaaaactttatgataaagatggactctctttcaccgcaacttgcccgccctaacagatggaattgattcacgatcagcctccttcggacccggtagctacagcccataagcaaaacaagatttggtctcgtacgcttgctaagcaagtttcctctctttttaatttttaactgatagccctctcgttacttgaaaggaaatggaatgcatcttcggtgcctaagcttgagtgagcgcatcgcaactgtgccgatttctttcttttgttgccgtacttggtaggctccttgtccccttgatttttcaaggaactcatttttttactggctccctttcctccctatgctcccccggcgcaggcccaccacgcttcgcgcctgcggcgttttcgccagacggcacggcgtcggctttcataaagcaaccgaattaaatcctcctttattttgaattctgtttcaaaataagaaagaatcatttcttgttccataactctgtgtacactccgtgttgataatttgagacctaatggacacatcatacataagaacccgttgtcgagattccatcaatatcttgcttggcagcttcataaacttcgtcgtcctcagatcagaaggagttttgtcaaatgaaatgctggacaatctacatgagtgaaaggatgtagcattagactctttcgagcagaaggagaagacggacctttatgtatgactctggtaccggcatgataccaaattatgggctttgtgtaaatggcttcatgctggtatggggtattaccctattttactcaaaatactgtgacttgtagctcagtccaaaagcctgctgcttatggtactgctagtctgttatgtacaagtatcttaccgacgaaaaatgagagataacatgctttagtctggttcctataggccgtggtcaatgaaaacttataatcggggacagataaactggaaaaacagcaatagctatcgatactatattaaaccaaaagcaaatgaactcaaggggcacaaatgagagtgagacattgtattgtgtctatgttgcgattggacaaaaatgctcgactgtggcacaattagttcaataatgcgatgggcgaatgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaataactcagttcattcttgaatttcggcttgtagctttgctacgcaacctcgcattcgaaattagtacttacttggaaagcagggacagtagtatatggtagtcagctttgaattgttctctgtgtagaatgcctattggtttttcacgaaacagtactatatgtggtcagtacataggtatcaagaaagagggctagctctgtttgaatagttaccagccaagaaaagactactcaaaaatctgctacttcgtttccaagcaagcaaagcgccgctacttatttctttctcactcactacttttttctattttcttttgtctatcgaaacagcctaggattcaatttgatttatcctagtggtgacagcttatgcttcatttccttcgaattcttctttcgatatgcctttgttgaaggtcgttcgagcttttcctgggagtatggcatgggttacatacttcagcgccgtagcgcctggtatgagcctcgtggagaagcaatggctagtccacttgatctcaaacctcagatagcgacacaagaagacatcaaaaccatagtagcattgcgaatgataagaagaaaaaaggatgagtttgggattgcagccatgcttcgctttgatgaacgaaagaaagagtctggactcactagaactctctctctggttgcagttctctactagctttcccaaacttcactagcaaaagacttgaagaaggaagcattatgaaggggagtactcttcttctactgaagtcagatattgcactagaaatggaatagaggaggaagaggtgactgctaggtaggcagtagtagcgcatgctggaaagctagtcaagggagctttgattggttaggtcaactattcagaaacaatatcatcgattgagataaattgacctataagaatgtatgtattttttttcataaaaagatcttttaccacctaagaaggtgtgggtacttttttgccggcatacatactcccaactactttcctgaatctcattttttggtagtacgaagggggaattggcccaaaaattggataggggtaaagacgcagctggggggcggcggcttattcaagtgccgcaagctctgatagtgagacaacaaaggaaagaatcttcaggctattcgcttccctctttcagtgtagccggtccattcgagggctattggacccttctccacgaatttgttcgcgaacacgtttgtacctacgtcgggatacatgatcgctagaagagggttatacaaaagagagggacctgagtaattcctttacaggtcatcgctgagaaagcatcatgcatccacataaaccatacagtgaggccttttctttatgaaagttggctagtgaccctatgagtctgttctttcaagcatcaagttttttcttctaatttctactatttcttccaggatcaaaaatattttatttggttgagctttgtcaacagattggcagtgaaatagaaacttttctatggtgaaatattagagaataactatataaaataaaaaatatctctttgagatttcctcgctggcgctcgctcaatccgttcaccagggttcctttcctttcctttacggtcgagctacttctcgttcatcatcaagtggtttcaaaaagaattggaaaagggatgacgcaagagcagcggaaggtgacttagcaacatcagtcatttcttatagaaaggaaggaaatgatctctcttctgtctagacgaaagatctcatttttgctaccgctccccctcttatgagtctctgtcagccgttgtttagtagctttcaacgcgagttcagtcattctcttatatactgaaaagtacgaactgacttaaagcacgaacatgaaggagaattcgaaacatcttgaatcttctcagagagcttgagtgtgaaatgagtgggccggccaaagaagaccactatggaagtgaaaggggagggcaagagcagttcgaaggtcaatgaaatgggttcagttcccttgtcaaataggggccccgacccaagtgatagctctcttggcgaagaatgaatagtagggacagcaggtaaagcagttgggacggcctgtgaagctttcgcccttgcttgtcttgtcccaaagctaactctttcttttaggcatgcaggaaaagaaaggttggaaaagggggaactaagaaaagtgaaaggccaggcttgtagctaagaaatatacttaataacacgacccccttactaagtttgcctcacagttttgttatgataaatcactcgtgggtttgagatatttcataagtagtggccaactaccacacctaattggtgttatgattggttaagatgaatgagaatacaaccaaataaaggttgttaatccaccttcaatagggaaagaatgacaggatataataatattgcggagtccctaaatcgcagggaagcactaagaaacaacatgccatttgaagcactcggatgcccaaccacagctatcacaatcactcgaatccggtgaagaaaagtaccttcatagcgtaggagggagagattgttttcatttcgattttatggcctggcagaaatgcgtgtccctatctagtgacatcgttgagagggaggcagtgttcagcttctcatggggatagaaaaggagattgcgtactccttctaagacatgaactcggaaaagagattgaatggcaagtgaactaattcctgaaagtcgtcgtgattggatcaatcagacttccccacaggaaatgccaaggggcgccctttatcatcgcccatttcttccttgtctgctgctgccttaagtgcgtaaagtaggctcaacttctttggtttctaaatatcttgtagtagtcgaaggtagtccagtccgcttgttagattgaattgaatcttatataacctacgtagctaaagagaaaatcataatagtctaagtggacctctcaaaggtataaataagtatacattagtcttactggttcggtctttttctttttctttttatagcctgcttgtttggtttgctagttcctggaaagataacccttgctttgattgaaggaagtgagcggacaatactgttcctccggtccgtggttcgacctcccgtagtggtccttgcttttctttttgaaagctccgtcaaaagcaaatgcttcgctcttcttttacaagaaaggtactatctccatatttgtgttgatatatgttgatgacatcattgttgctagttcttgtgaaaaagcaacttcggcattacttcaagatttgaaagaagaatttgcccttaaggatcttggtgcgttgcactatttcttgggcatagaagttaataaagttcatgatggaattatcttgactcaagagaagtatgctactgatctgttaaaacgtgttggcatgcatggctgcaaggagatcaatacaccgttatcaacaacagataaattattgatgaaagaaggtgaacccgtgacattttgtacccaaaacaaacgcgctaccaagctgcgctacatcccttttccaaattgttgtacagtgtcattgtacaaaacccctgtcttgttttccacatcataattttatcctccatctatatacaactttcttgtcatttcttctttttggttcctggctggatccggcctgggatagtggcgcccattcctaaccagttctgaaaaggttcgctcatgctggaggtactaaccacttagtgatcggtccgctagttcacgcaaatccgaagaagttatcacggacgagccacatgcctacttctttttgttgtggaaaaaggtctttccaccgagatcctaaagtgcattcatttcctatttatagagcagcctgtaccacgtattcctccctagttttgaagcagggcgagactactttagctaggagcctcttttccttctgcccagctccccgaaaacaannnnnnnnnnnnnnnnnnnnnnnnnnnnnnnnnnnnnnnnnnnnnnnnnnnnnnnnnnnnagattttgactctgattgggccgaacagtggtagaacctggtgaaccaggcctactactaaacattgattctctctcctaaccactcttaaatatgttaaatacactccatcgatcaaaaactacaagcaagggagtcagctcttattgccgtaaaggaaaaataaccccttgattcctttcataaagatgaagggacagaggtgactaattccccatctcatttggggcggaaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggctcaaagcagtgctttgtttcctggccaaatcaaggatttggggctgattgcaaaagatatctgaatatcaagatagatccatccatctatccagatatctaaaaaagaatcgattttgatttcataaaacctttgattcaaagaactgcgcttagcccccccactcatgaaacgcatcagcattcgcaagaaagagaaagaactcggttcaaagaatcgcttcggtctaaaacgagtcttccaagatcatgtctatgtgaagagcttgaaccaagcgttcacacgcatacgccctctgaagatcggcgagaaaaacaaatcgtattctatagaatatggtagtggtaattatataactgctttgaggaggaagagggaaattgtcaaggaaaatgccactggaggtacatgtatgcatccacttccaaattcggatgatccaacacaaaaagtatgatatttctattctctagctctcgtcatatagaaaaggtatctagctcgtccctctagcgctcgtaaaagaaatcctggcaaagggaaagccagtagagtatgccttggtttaagagagagatcccttttgattctaatccgcaatgacagtttcccttgctttgattgaattgacgaatggtaactactaccaggctttccctcgaggaactaatccactgagagtggtgcgttcccgtctgtgatatagacagagacaatcttatccttctctactctcgtaacaaaaactaattcatcgatgagtttataatagttaatacttatttagtcatgtattaataagatatcaggaccgtgctcagttttcggacgaaataaacatatcttgcttttctcattgtttgcttcttattgaatcgcctctctcaccgccatctccaaaaacttttttggcggtttgggagttggcttctgttgacgtgacaagttgatcgtggttgactatatgagttacatgtaggatccacatgtcatcctagctaatatcaccttctttggggttaggattcgaaggaaaggacggctctttgcgattaggatttcgttgactcgtcgttccaacctcgaaaagtagagtgtcattactgtcgagaatgctaacttgagcgctcgcattgccggtgcacacttccggcccacatggcccagcacgcgcgcgtttcttctttttttttcgcagtttgctatcgccgtttcttctctttcttttttcgctttcttttttctgtgatttttctccttttcttttttcgattactttttaaatatttttccatgattttttcttaatcttccaacaacacgtatttttcaaatgttttgtgttgaaagcttttaaatcttaacttaaacattttaaatttggagttgaaagctttcaaatcttgagttaaaaattttcaaatcgtaagttgaaagttttgaaatttttcgaatctcgagtcgaaagttttcaaatttttcaaatctggacttagaaagatttcgaatatcgattctcaagttaaaagttttcgaatctcgagttgaaagttttcaaatctgagttgaaagttttcaaaatttgactttaaaatttgaaacttaaatcgaaagttttcaaatctaacttaaaaaattttcaatctgttagtaaaaaaatatccaaaaatatcttcagaatcttacctaattactatcattagtgttggcatgtttggtacagctccaactcctaaatttagctccaggagttgggtctgaagtggagttgtggagctgcctaaacccagctccacaactctagtttattttgtgagagagctccacccaactccactcccagttttggtggagctgagactgtttggctgagctccagctcccggaggggtggagctggagttgtagctgtgccaaacagccccgcgctagcggcgcgtacgcgctagctaagagcccccattactgtagccatccaatggatcagctcatttttacactacaaatacgaggcataacaacgatcaagtgcatgcacaccagtaaattaagtacaacacccccagtgctgtcagtcactagctagctagagcctagagctgacgacaacgcgccgcacggtccgctttaatttggctctccgcaacgatcgacacgacggtcaccagcgacgtcgcgggccggcggcctcgtcgtcgatcggcctcgaattgtgagtggaagcccaactacgtcgatctcctgaattaggtggggccgtcctcccagctctgctcctgcaacttttctatgccaaccgcgcccctcgatcgccagtcgtcagggacgcggctcgtcggcatcggcgtcgatgactacggcgtctcgcgtgcgcggcgcccgtggtcctacctaccgacttagctagttaacttggtcaacctgtcacattagcggaaaccgcctcccaaaccgttgaggccttgttcagttatgtccggattcaatccgagccgggaataacaagtatagtaaaaaatttatgtatatacaataagagaccgggatttattctgggtcaggaacaaatttacttatgatagggataataagagaccgggaatcaatccactggttaagaggtgttgaactaattcgaatgttttgttgtccctatcatgtaaattggtttccggcccggaataaattccggtctctcattgtatctattataaattttttattatacttgtcattccagtccggattaaatccgggtgtaaccgaataaggcttgaaggagttggtttccatcagttttcagagatgagggaaggaggtgttacacctaattttgcggtttgagactttgaggggatacattattttcgggagcaagacatgaggagctcaaatcagttcctttccgaacacagcacacccctccttgacatgggccggcccaaggcccagcacctgtatctggttacggtatactaagtctgcagttaagtaattaattaattatggtatgtgatacttttctcaatacgtaataatgttcactttgatgttattttcatccatactatttttagataaagttaccaaaaattttaactaccttaagtttattgccaaattttagcaagtaattatgaaatcttgccaaattttggcaaccttgccaaaattttgacaacttagctaaaatttggtaatgccaaaacttgataaggttaaaaatggtagcaaagtgaacaagcccgaaatggtgtgttaaccacttcggttaattaatttcagtactcagttcattaaattaattaaagaaaggccgaatccctagaggtggggaacgggtgggcccgcgcaaacgccacgaggaagaaagagagagaaaaggttagcaactttcacgggacaaaaaccagcagactagtcagatatacatatactcctcctcaacaaaacaaaacaaaaaacgcgagaagagagagagagaagcttttaattcgaattctctctctcatcacggcttcttctgcttctccttctcctcccccctcatccctcctccgccggtagccgccggccgggagcgagcagcgagcgagaccggagcccgccggagccggtctcgctcccccctcctcccttgttcgcgccacccccgaggtacatcccgccgatctctctctttctctctctcgttggtctgctctgtgattttttttttttttgccaaggctgttctttatttggcacagagattgttttttttttccttctttgcgggtgtccggttcgagtccacggggtttgactctgccggaaatggttcgaatgcggcggccggagggcggaggaggggttttggggggcgttcttggtgggttggtttgcgccgagtctttgttaatttgttagggttcttgatctgatgcggcttctcgttgccgggatgcgcttgcctcatggctgaattcaaacaggccggtctctctctccctccctctctcccgtcagccgtgtgctttgaccgagtaagtttttgaacttcgattggttgagctgggggttcttgactttttcttactccacgaatgttcctttttgcacaatggggctactaatgaatggaaagctagagatggtgtgcctaatggtgatgtgccgtcattgtgttagctcggatttgtactgcgaatttgcgagctcacatgctcagctgatgatgtgttgatccagggagtatatataattggttggtagagtacttgctagattgtgctcacgggtctcatttcaaagttcagtatgaaatcttggttgtaaagtagtactagtgttttgttaatcgttagggagtacttctcctgcatttttcttaattttttccctttaaaaactgtaggtggatttgttattagtaaagctgatttgtgccaaatagaaattctgttttatccgcagtaaggtactgtaaacagtacttgcaggcactagggtttattggcaaggttttctatgttacattttaataaatgccacctttttcttcgtcaaaagaagccacggttataaagaaaaagtgaagcattaattgatgtaaatgcacgaactacaaatttccacaaatataaaccttttaataaaatccacaaatgaaagaaaaatgcagttcacacaccaatctctttctcaaaatttacacttttcttataacaggtatgctaaattttcttaatacaaagcatatacaaaacatcacaagcactatagacattcatgacatatctgttgcataggacaatatgcagtatgaagacctggctggtcaaaacttccgatgcacatgtgaggccctatccatgtgctttcttgatttctgctcctttatggccctatctccttcaaagcccttaaacacttcaacagtgtccaatcatactatgagactgtatggatatgggcatatggctatacttttgatgaggcaatgattttttttgttaataatagtgttaataggaagtgttgaattggttttttaaaaggaagtatttaagcattgaatttgtcatttattttgactcactaataacacagatagttctctttcctagcaggaccccttacaatatctagtgtatttatggcctcagttacttatattgatgactccggttctgaggtaattgatcctccaaagactgaggtgctggatgttaccgaacttgctggtgatcctgttccgcattcaccaaaaccaaatgtggtagtttctagcagtgtgcgtgaactgcttgaatgtccagtctgcctgagcgcaatgtatcctcccattcatcaggtgcacatataccacttattgaatcttttttgcacttaaaaaggatattttcttgtatggaagtcacttgggaaacaaaatgcgtgtttcatttaattgcattgcttttactatcttgaatcctgctatcatatttgtagtctggcctgatctatttgaacttatctagatgatttcctggtttaaaacggtcgttctgagctgctttttcacatatgttctgttccactaccaaattgttacccatgtatttaagcaccaaaaaagaagttagctaagatagtatgtacaatatgcacattgttgtactatgttgtaagttgtaaccccaactctttttctgctaatgcagtgctctaatggtcatacattgtgctctggatgcaaaccaagggttcacaatcgctgtccaacttgtaggcatgaactgggtaatattagatgtcttgctctcgagaaggtggctgcgtcgcttgaacttccatgcaagtaccagaacttcgggtgtgtaggcatttatccttactactgcaagctgaagcatgagtcacagtgccaatataggccttatagctgtccatatgctggatctgaatgcacagttgctggtgacattccatacttggtgaatcacttgaaagatgaccacaaggttgacatgcataatggctgcaccttcaaccatcgctatgtcaagtcgaatcctcatgaagttgagaatgccacctggatgcttacggtatcccctcgttaactccaccatgttagttattgtgaagtatatcactgatgtttacttatgcaaagattggttcacttgtctgctaagatagtccatatttctgtactgagttttatgagcctttctgtaaaaataaacattggttcacttgtacagtatgattgcactctgtacttttcatgtcaactgaggatgctgatcatgcagcatagttattggtctaaaataatctctcacctatgaagaaactatgcatcagaatatccatctgcttccatttccaaaaaaaaaaaaaaaaactttgtctgctttacagcacaataatagcatttggacagggctcttgatctgcaaccttttcttgctgctttctaagtgcaatataaaattaagaatttccttctaatctgttcttttccattgaacaaaatggactaagtaac

SEQ ID NO: 61715 - DNA, 951 bp, Oryza sativa
caggtgatgcaaaatggaaggatagcacaagcagggaaatttcaagaactccaacagaacatggcttttggagttatctttggggctcacttttgtgccgtcgaacaagtttgtaacgcaaaaggcacaagcatatatttgtcaaagcatcatgcagaatcagaaaaggtaccaagcatcaatgagtccgatgcagaaaaggaaatcagcagcaaatggcaaaacacaaatatgataaattgcagacaagaagtatttagagataacactgaagaagggaaattgctgcagggtgaagaaagagagaatggatacattagcaagcaagtgtattggtcatacctcacagctgctcgaggtggtcttttcattcctatgataattgcagcacaatgcttctttcagatatttgaagtgggaagcaactattggatggcatcagcttgccatccacgaactggaagcaaatcaaaaatggaatccacccagttcatggtatatgtatttatatcagttggcagcgccttgtgtatcttgattcgagcagttcttgtagctgtaaccggcctcctcacatcagaaaaattgttcaagagcatgatgcattgcatctttcatgctcctatgtctttctttgactcgacacctacagggcgaatcttaaacagggtcagtccattctcctgtctcagaagtgtaaactatgtaaaataaatcctaaagaaattctatgtaaaataagtaaacatatactgcattacacaggaaagtgtaatgtgtatgtcgctttacctgagttgctaatacatgatttttgcattgttcatgtaggcttcgattgatcaaagtgtgctagatttggagacagcgtcaacattaagtgagagcacattttcagtgatgcagtttctaggaacaatactaatcatatcatatgtttcctggccagtt

SEQ ID NO: 61716 - DNA, 2533 bp, Oryza sativa
cccagaaaataagacatatacctcaatataaccattatagtgctcatcatcaagagtaataatgaagtttttctcatcccaaccagcagcactcactttcctaagcctatttatcttcgagaactttctttgccatgtcttcaaatggttcttaatttgctcacccgtgagagtactattgaacctttcattgaccgccctagcacatgcattgagatggactgccttgaaaccagatgaggtccttgtgccaccagcaacaacattagctaggtgagaaagcatgaaagaggacatagctgaggtccatgaagcatgggtgcttcctcccttgccactgttgttatccatttcctacctatcataaaataaaacaaaaatgtccattcagtaatatatatatcaataaattatgcatgcaacaatatatgaactcagaaaataactattcagcaatatatctaataaaaaaatgaccattcagcaacatatcaacccaaaaaattaccattcaccaacatatcaacccagaaaatgaccattcagcaacatatcaacccaaaaaattagcattcacaacatatcaaccgggaatatgagcattcagcaatatatcaacccaaaaaattacctttcaccaacatatcaacccagaatattagcatccagcaacatattaaccaagaaattcaacattcatcaattcatcaaaccagaaattcagcatacaacaatacatttatccatacaactaagatttggcaaatggactacaacaagctgtccacacgaaataaataaataaagaagttcataatacaaatgaaatgtagcaaataaggtagaaatacaagttgcatagctacatattacactccatgatggttattacggtcagcccacatctgatcagctaaaccctgcctgaactgaaccatcaatgcatggtcattcgcttgccaagttggcgattcatcaatgtcctcacttgaccaatcagacggagctacaagctcatcaattccgtcatttatgacccagttatgaataatacaacaagctacaacaatatctacttgagttcgaaatgggaagaatggagtggcatcatctagaactttgaacctcctctttagtgacccaaatgcacgttcaaccgttatacggagggatgagtgtctaaggttgaacaactccttctcattttgcaccggattattcccccactctttcaagtggtaccggacagcacgaaaaggaggcaagaatccttgtttggctccatatccaccatcaactagatagaattttcctatcatatgatcgataagttggtcacattcctaaatatcaacatttgtcatggagaatttgataaactatagtaatctattaccttgtgggacatgaaggccattttcacgttccaaagcatctcttaaaactacagcatcatgtgctgtcccctcccaaccagccaggacataagtaaaccgaagatcaaaatctacggccgccattacattttgagtggcatgggacttcctaccacgaaaagaggactccacattcttacgaacagaggctctaatatgtgtgccatcaatagctccaatacaatcctattttgtgttcaacaacattaaaaattagggacaatacatcaatgttcacataaatataaaatgagataggaatgaatctcacaccttaaagtaaggatcccatctaggatttcctgctattttagttggagtgtccaatgaggggggtctgataagttcatctcgtagctcaccaattgcatgaaggactttgttaaaataacgacttactgtttctccagacctaccataattagtgcggactaacctatttctaaggttatgtcccaccgtatgcagaaacatagccacttgttcctcaatacacatgtggatggtatcttcaagtaaaccacgatccctaaatagcttacaaaaacgaaaaaaacttccttttctaagtctaagcatgtcaatacaagttgtatcattgaaccaaattttcgtttctaggtactcaattcttatcctatccctttcagccattgggccatatctaataccttctctccttgaacctctcgttcttttcctagaccgaataatcatggccatcattgataacaataaatttgtagcagcaatacaaactaaaagcttggtcctcttatccatctacaatacaacaacaaaaataacacatgaccatcatctactgtcaagaaatttaccaaaaaaattaacacattgttgaaataattatactacaacattcttaaaaaaaacagacatgcacagatctatataaaagaaatccccattcagggtttagggtatttttaccttgtacaatggaaactgagctctgcagtttgtggatggggatggagaagatgaggatgagcagcacctggcaatggaagctcgcgcgccgctggcttgcccttacttccacagttggcttgcccttatcgggcccgcggggtact

SEQ ID NO: 61717 - DNA, 18961 bp, Oryza sativa
agcaagtaatcattatattatcagcccacaccaggcaaaatcatcaccattattcaccatacccatatcgcaattcatttaacaaatcaccaacactatacttgtatcatttcaccaagtcgctcatgaccgtgagcaccggctaatcgattagttttaaactctgcagagtttgtacaactttacccacatgatgtgatagaagccaaaaggctacactctagttgtttcggtacccgtcggtaacccacactctacacattgagcacggtctagaggtcacaacgaagccgttacattgcgtaaagtctagccttgcatgagcatggagagtgtttctccacattggccatgaaccaatgccgctaggaaaggtgggccccatcctaatactaatgttgtaacacatctattccctcaacaaggcactatccattatattggatatgcttagatgcccatgccatatggagaacacgatcgttcccatagagggtcacatgggtagctcctatgagctatcgctcagactagtccctactacaacggccttccaatgcaatgctaaacagtaaacaacttagtaagccaaggttgccccataaccgacagatgtggttgcacggtaagcttagttggtgacacatagttcggtccttaattgactcgggcgaacactccccctatcagcgtagaactatcaccatatgcacaccacttgccgcccaagtttgaaatcatcattttcagtttccaattttcacataataacagaggcaaccgctctgtacaacattttaaaataacccatttgaaagagttaatatcatgtcatttataaccatagcaaattttctaagcatggctaagcaatagctatagtagtagctcgaatatacccatattggtgcttggataggaccacaacccatcctaggtccatcaacaatagggtgatcaataatcaaggtggataatgcaacaattaggagttgttctaccaaagtcccacatttttgcaaacaccgcatgcaattttaaacataataaagcatttgcgaaaatatatgattcaacatgatcgaaggaggaattgatctaatagtacttgcttgctcaagagttactcgaatatttcttgatcctgcacactcccatcaacggcaacaatcgatctgtcctctatttaaatttaaacctatattcaaatgaaaatccaataaaactccaagataaaatatcatgcacggtgcatgaacatgttcagtgtatagatgatggtttaatataaatttaggagaaagattcgcctaaatccgatgttgaatgtgcaagttatcacgtttctaagatattaaaatacggtacgtactattcgaatttaaattagtgaatttttttacaacagtgattctaagtttgagtgtgcagtattaaaaagagagttggaaactaacaaaatctggttcacctcaatcggagctaaaatgaattttctatgattttccaaattttcagcattttatagtgcataaataattaacagaaaatcttttctcagatttaataatttgtttataaaagaaactaaagggcactgcttgaagtacgttttcctatagggaagagaagacgcatttctgttctgtatatctctactctacttttatttaaaaaattcgtagtggtgatggtgaagcacatattttcccgacatgcgatccaacataatgtacatcgacacgcttcagagcggcacactactcctccgcatccctctgcaccacccacgcgcgattcctacggattgctcgcaatccgcaatcagcgggaaaaaaaaacacgctagcgccgccccacatcgccgcgccgctcccccttcgccacggctcatcctcctcgtcgcgagtcccctcggcctccgcaatacgccgcggcaccacacctccctcccgtcccgcacctcctcctagatcgccgccaccgataccgcgtcctccaccgtcgctgaatcccctttgccgcgcgcccatcattggatcgagcgttgtcgtcatatccacctccaccgttgtggagtcccccgccccacatccccgtccccggcgtttctccaccccgcatcacctgccgtcgacgctcatcgctaatctgctcctctccgccaccgccagcgcccgcatccacgcctgcccagatcacgctgccgacgccactccccgatctcaactgaccaatgtcgtgcccttacccccagcgccacatcccaccctctcctccccttttggccttcgaggcttcgcttcggtcccacaccgacacgaggtaccgcggctgcagcgccactgctgttttctcagctatgatttgggatcctgtgtgcaaggagtggctgattactccatcctcaatttgttgatttagactttggaggcttggtctgctttgctttgttatttaatttgctgttccttatttttttaaatagatccattcctgttcagaggaggcatacggggcagaatattgttcattcatagagaggcataatgcacagttaatttcaatcactttccattttcactgtaagttctaagttgttccagaaaggccatgatgatattactattagaatgttagattaaaaatgcatgcccagtagatgtttttattaaatgcctctgaaacaatctggatgtgatttcagcatacgtttgtgcaaacagaccctttaatttgattgtctaacagtatcaaatgatgatttttcaagaaaatccactgaggaattttcataatttatttgcaatccacagatgaaattgtactcttcaatctttataacaactaactataatcttttgcccaggggtatttcaatccttacactaatctatttactgtcaattagagaatgtaccaaaagaatttttgtttttgttatcaaatgttgcacatttgatgataatctatatttcttaatactgtctgcaccttttgtttgcaagctccaaattctataaaaaaaaaaccttgactgcaagcttgtttacaattgtttggccagcacagtaggagcagggtctgatcgggtgctccctgtgcataactgctattggttcactgctgttccaaagtgagcaatagtaatttggaatgaaaatataccaatataagaggtttccagcctcgatattcagatgttcataatatatctgaccaaagtagagacaagtttcaggttcatatatctgatcaaagtagtgcccttgccaaattcagttccagagcaacatgcaactcccactaggtgacccaaaaatttcattgtggttccactacaaccaagttaaacacgtcaaagtgaatttcttcttcatgttcggacagaagtgcatagctagatcaagataagctagagagcaacccaatagttagatgacttgaacatagccttataaatagcatgcaagcctataggtatatataatttgattggttttcctgaaaatactaaccaaaatactttttttttgtttttatcaatttggttaattattttacatgataatatttccacgttcggtcatcaacttatggttgttgcacccctgacagaatggctgggcagacaccggtggctcttgggtgaaatgagagcaagtcaaccgatcattttcatgaagagatgaattagacggaacaacagagcctcatgggtatgcaacaaataactagttttttttcctaaacaatacatgatttttcattatgacttaaaacctactctagatgggtcaacaatgggattgcatatttctttacttggtctcagaatgaactgaaatgtttctcttttttcatttaactatattagaaagcacatattgtttgacaatggtattagttgcatattgtattttcaaaatttgaagaactaaagaggttgacatactaaaatgctttgcatgaacattactatgacttttacaccttaagctcaaagttgtcttatttgtccagggactcaaacttttgagatatgtatattggcatgaagagaaaaggatacaaatatatgaagcctctgacttgttgggttgttgtatgtgttagttcctggcaatgcagagctagcactgtaaggaaatgactgtgttgaggcaagtgtcaagcactaacttcttccacaacaaccctgtcttccatggtaaccattccgttactccctccttcccaaattgatcatcacactatgaaattcaagatttctcaaattgatcatcatataaccgcatggacacggatttcatcagaataccattaatacaacatggaagaatgtgtgcatgctaaggtgtaattggcatggtgttaatcgatgcatgtattgtgggagaatgtgtgcatggtatcttgattgatgtgatttaaattatcattggtcttggtgcataaacatatatgatgatcaatttgggaaggagggagtatttcttttgctatgtaatgagaaccattgtgtagaattttgtaaacaactttaaccattgcttctctgcatgcaaatgcagatccattcctttccaaaaggattagttaccatttcttttaatttttacacatatgattagcaattgtctataagcattaggaatgagaatcagatgaaactatagacaaactttccaaagtagtatcaatatgtggccaataatgtgctgttccattcattaattttgttatatgtggtactagcatgtgaatactataaagatgtgaaaattataaatatgtgacgtaattattattagttctatattaagattttttgttacagccgatttacactcaatgattatttaacatcatttcacacggttgtattcattttaaaactgtggggtccatctctcagtgaggggcactcctctaaactttcagccaagcactaaagttttcataaattacatataagtcctaggcctaactgtcagtgtctggcgctttgcagaaagaaccccttttaccctaataacaggactaggtccttcttcttcaacctacaggcagctcgataggcagagaggcacaacggctcgggaatggctcgccggcgatgagcggtggaggggatggctcggcctaaggccggggaaggctggagtcggcgagcgccatggccggtggtgccagcggttctagatgacgggcgggcggtgtgccacggtctatggagattcgattaagggataggggatggcctaaggaaggactactaggagacttaccctgtgcagtgctcggttagagttgaggcggtctgaggcggcgtgacgacgagctcccatggcggcagaggtcggtgacggtggtgacatgacggcgctctagagagggggccctataattagttgatgaaatgggttgaagggtctcctagggtcattctggcgcaaggagatggaagggaaatcaccgtggtggagatttgattggcgtgggttggggggcggtgctctgttcggcgcagaccgtggtggtggtgcggccgttcccggctacccagaggggtttgagcttcggctatgcatggtggagaacgagtgtggtgtggggagttagctggcgcgcttgctcaatttataggcgagggaggagccagaggcggatgcggaggctgttgtgacgcgttcggcgccatccatcctaaaataacaaaccaaactctctcaaacaggatccacctcgtgagttcttaaatgcatgagttcttacaaataaataaatataataaaacctcacccctgcggccctacccggctaccctgcgagtgcgagtgcaaggcgagtccgagacggagtccgtctccagcttggtgctggagtcctattcggaattgtaactcgtgtactgttgtacccgttgcaacgcacgggtattttttctagtaaccttaaatattcctgcatgtgttgtagccgccaccgtctgctagcttctggactgtcccatccgccatgttcaccgcgaagaccgccattggcctccccaacggtgtacaccaccgtaccgctcttctcaccgaaccaccggagctcgatcggggtcgtcctcgccggcctgaggtctggtactcggacgtacacagtgcacgtacgtcgtgtctgtactctccatgcatcagtgtcgtctaattgtgtcttcaacgagcagaatacaagctgggacactcggcgagaagtccccacgttgatgtagcgcaactccgtcctgtccgccaacacccccaagtatgcggagaaccggccagtatcccccataccaatgttcaaaatagccggctatagccaccgctatagcgggctatagcgtttgggcagggttggagctaggatagttagccttttgcgctaaacgattttttccgctcatagcggcaattaaccggctaaatccgctaaactgcagatcatttagcgccactcactttgtagtttagctcctgggccaaaatcagagcaggccttgggccttcgccagtggcccaaaggggaggtagaagatcaagccagcaatctgtgttgtctagactgtaatgaaggcatgaaagaacacttaatttgtttcagtccgtgattttttcttgattccatgttcatatgcataattgttgactgatttctgtctggcaattacaaaaccgctaaatagggttagctgggctatagcccgctatagcctttcttagcctccctagatactagccgctaaaagccttagccggctattttgaacattgccccatacgtgtaaggcaccgaacacacgtccatggctgagtccgatagcgcgcgccgacgaacgcctcccagtggaagggccagtaggccacgccgccgccaaggcatggcctagccgggcgcagtatggtttccttcgttccgggccccagctactgtcgtcagacgagtagcaccgcatagccgtgaagccggggcggttgtagatgatgagcaggcggaagaaggagcgcgatggcggcgtgtcgaggtcgtcaccggtgagtattgcgcacacgcgtagtactgtagtagcctggacagtcgccgccggtcatggggttggagacgacgagcgtgaggccgttgctggcgcgggcgcgcgtcgcgccggagctccaatgacgcggccgttgcggccttgcgggacgccactggctgggcgtagtcgagcagcaaggcctcgccgtccgggagctagaacgggcctaggaaccgcgaggcggatgccgccggaaagaagcgcggctgccgcgagctcgaagccgcgagccacttccgcccccacgcgcagcggccgacgtcgttctcctggtggaagcagccaagggcgaggcttgggaggaaccgagtggggaaccgagctggccgcggcagtgcgcgggagattgtagcggcgtacgtgcgtggccacgaacctgccccagctagcggggacacgtcgacgcgaagcgcgcgacgtcggtggcgtcggagaacacgcggtctggcagagtggtcagaagcgcgccgtcgtttcggcctctctggtggcaacgccggcgcgacagccacccgccggtgtacggcgtggcgtcgcgacgtgcgcgggctcgtcgcagcggcggcatgactagctagagcctggagggtttccccaattgtagttgtgcctgctaaaaggatgcgcttcgatcgttaatggatgacgtacgtgcatgttagggtatatatataggccggcatgtcgagtccgaaattgtgacaatttgtgagtgtgtatccataccagcacaacacgtcgactatcacgggtcacggcaccgaatgagcccgacgcagcgaatccggtcttcagctgcgacgctgcggaggattcttttctcttttcattattatcggtcgacgatctcagccgttggatgttgatcaaacgacttccacatcgtcttcttcctctcgcctcttttttctctctctctattttcgttctcctgctagggcaagctcccccatctctcgcctgacaagtggcaactcctgtcctcgattggcaggacatcgctcaatccatgcaccagcaccaccacaccggctatcttacacagcaccgcgccgagcggcgtccccatcaccgtcttatgcccacacctcctccccatcggccgatgtcaactctcctttaagcccatcggatcaaatcctcgccggcagcacccttcccctaaccccaacaatcaaaaacttagtgtcagcaacccggcctgcttaggaagcgcgtgttgtttgttccatattgtatttgcactcgtattcaaatccagtcgcacagaggcgcgtcaagcgtgcgcacgcgcgataggagggaaagcaactaaggaagcggagtccttggcagtcgcatcgtgcagatgatgctgctacggacgaaaatcaaagggtgacggaagtaaaaatactaatcttttaattcttactatcaaaatgcccgtgcttcgcacggtgtattaaaactaaaaatatttgttcttaaccgaagttattttcgcactgcttctgtacttttgctcgctagaaaaagtatcaaatgatagagagaaatatagtagctcataataaattattattctgaagaaagggagataaaaaaagacaaagccggtttgatttccacctttacacgacgcgagtcaacatggactctgaagatataggtagatctatggggtggctcagtagcacgatcgactagcaaatcagcaagcacccttagaccaattgacggccgaacgatgaccgtagcatggtaggtagcagccgcgtctggctgcaacggacgaagactttggtgaatgaggcttgaagtttgatgttataagaactcgaccgggatcataaccatatcagtgtgtactacggccacgagccacacatacggagctgatcagcacaacaataattaatttacggtgctcggacatgaccacaaagctggagatgaggtgtgtgcaatgccgtgatgatgcgtttggagaggtgactccaagatggtggtcggcgtggtgtgtgtgcgcgctgagagtgtaaggagatcattgagttgatcaacgaaatgggaacatggttgtgtgaggcatgtgccgtggctgaattaaagtggtgcacaatattactgccagaagccgatgcccatgggtatgacgcgccaacctaacaagtgctctggttcctacaacaagacgttgatcatgggcaatatatattgataaaatagcatgccacgagttgctacttgatctaatctcctatacaagttttagttaatttgatttgtacggtcgatttagttaatttggatgtagaaggattcaatttggactttggtggaggggaggggctgctgatgggctttggcctagagcttggacgtgagacatattataaacttttgtagagattgattgatctactgggcttggccaaatgaaggaagagggaggctatgtggactttggaaattatttttcgagctgagcggtagaatggtgggtcccacggagatggggttagagcagtgggtcccctggtaggtcccagtcccaccgtttttctctctttccttttcctcttcttatcttctctctcacactttcccttccttctctcgcttttttcttctctctcggctgcttgcaggcaggagagcgccggcagcgatccaaatggcgtaggcaggagggcgccggagggcagggcaccggggtgcgccagggtagagggagggagctccggcacggttggggatgcgacgagagcggctgtgctcggcgggcgcggcaacgataggaccgcggtggctttgggccggcggcgcagcttggttcggcttcggcgatggcgtggtgcgagctcgacgcacgcgtggcgtccaggagccagaaggaggatgggggcggcgtcgggcggctcggcggcgctcgggaaggaagggcgtgacgttggcgggcagatagaagacctccttccccacgccacttcttcgatctagaagtggttagcatcgatctgcaactggtgggcttggtgggcttgcttgctgcacatgattcgtggatgcaccgctattccaattttatttgtgcgattgaattccaattgggattttttcgggggttgattgaattccgattgggatgggatttgggggtgttgtgacggacaaattttattgggtggattggagttcctcatggatccctatgctgattttattagggtggattagaatttgattcctggtttctcccatgaatccgtctactgattttgtttgggtgaattagagtccgattcttcgaaatttctgaatcggacaccggcattgcaggcgcggtgatgaacgacgcggtgatgaatgacggacgaagaagtgacggacgaaaaatcacgtgggtgaaaaagatgtgacgaaaaatcacgcgggtgaaaagatgcgacgaccggaaaaatatattactagcaaaaagtgtccgtgggttgcaacggaaagtgtacagactagaaaattaagaaaaatttaagaaaaatttacattatgtaattaattaaaatacaaatttgctaaaatatttggtatttttaagtaggtaagtgtataattaaatcaatttacaagtaaagccagtgtgagaaataaaatgacattgttaaatttaattttactaaattctccacgattagttacgctctttgaaattttattggaattatcaaagcttaattgctaatgtttaataatacaaacatcatttaacaattatttaattggaaaaagaattaaaatccttcattctaggtttgggccgaatatagaaaagtttatattttctcccttttgtctattcaatgtgcctggcctgtttcctttctccgttgaagtccattttgtgtcctccattcggtggcccaatatgccggcggcatgacgcgggagcagctggagccgtccgatcgaatggacggtctagattaatcctaacctaaataaatacacctaaaccctaaccctaaccctaggattcattctccccctctcccccgcccccaatctcctcgagcggaggcggcggcggcgcccaccaccctccttcccccgagcgactgcggcgacacggagcaacgaccggcgagcggcgcccccctccccctcccccgagcggcgataggcggctatataccaaagccgcaactctagagttcatccgtaagcgcacagatataccattgtagcatttcacccgagagtattccaaggatatcgtatttattttatcccgtgggaagatcatgtagagagaacttgactaataatttatatattacttgtgataatcacattctaagcaggggttaagataatccaagggtagaatgacacacaagcatcaactactcattatcataatatattatctaagctaagtggatggaaaagagaaatataatctattcctatacttctaatatacatagtatacatacattctagttaaccgatatactagctaagaccctctatccgatgccctcctggtacttcgggaagtcacccctgactgccgagttccttacgacagcccgtcatgaccatacaaacgggactaaatacgaagaaataccctccccagggaattaacttaggattatataccggcacggaggaatacccgtactgagctgtcaccatcagcggcccacctctcatccgcaatatataaccccaaataataatatcccgtaagctagacaccacgtctaaactaccagatactactctaatatcatcgtcatgacatagagtaattgcatatgcaaacattatacccgcaccaatgcatctcccagataagctagctgtatattcagtataacaagaacataatgtaaagtaggtacttatatacttggaaagtatttcaataccataaatgtatttagaagagtattctaataaaagtacaaagcttacaaaagagaagagaaaagctactagagccatacccgaactattccgaaggctgtaggatcgaatcacaagaactaagccaaccagatgggggttgaatggttggtatacccaaaaaccgaaaacttttagcggaaataaaagttaccctcgaaatcgatggatcgcggtctgaccgaagtagttgcgccggtctgaccgcctgatgaacgtcagtctgaccgatgtagatcgatcggtcgaaccgccgagaaatcctgccgccgattcctgtcgccgccggtctgaccgccgtgtgcccgccagtcggaccaccgagatgcctccggtctgaccgccggtgcgccgccggttagaccgccgaaacccggtgaaacacaaatcgaagaactcttaaagtggatgacgactttattgattctctctgtgtttacaaagtgcaccaacaacactccttacaaaaatttcgactaaactcgaaaccctaactcaaaacttaactatattgctctcaaaagcgatgccgggaatcctcacgctccctctctatttatacgtgaggtaggtagcctaaagccacgaaccaaactcatactaggagtcctaaacaccttaggaaaccctctagtacaagaaagaaactttacataaccaaacgtaccaaatttggactccttccaaattcgactccgcatcccacacgcacacaataactctatcgtatgccatatggaaactccatcaaccacgtgcatcaactctagcctaagtatcccgcatgatctctgaccaccacggacgtcgtcttatccccaagccgactcccggtccatcaccgcaaatactctcccgagacatcgagtcacctacacatggaacaaacaaagaaaccatattccaagaccaagctatctccaacttgactcattagcagcaaacaatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttgactcattagcagcaaacaatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttcgtgaataaattccaaatatcaaaaccaataatctccaatgcccaattgttcatcatagaataataatcaaaaacacctttgattttacaaaggcttccggactcctgattcctactctattcctattccaccagctagatactagtaaactgaacttgagagaaatgagagagatattgcttgaggtgtgtgagtgaagtgagaaggcgaagtctttttataggcaggtatgacggttgtaaccgctgcaaaatgtctgaagtgccccgcaaccgtcatcaagagaagatctggagcgtcactgccaaccccacatccaaggccagcccaacctagcccaaaatcggcaggtggcctcctccgttgcttcacttcgtagacttgtgaattttggcccaattcatcgtgtcaattctgagttctttgcccattcatgcataagtttaattctcgacaccgtccgattgatttatcgtctatgttgatgtcgattctcctccactttagtgtcattctctgcaaaaggttggtatacataatactagtgtaatattattattctaacatatttatgcattgcaagtatcactagttctcctctattttggtaatattgacggtcaaaactgattgataacaaccatcagcaacatatttcaccaatactagtggatacgattagtaataatccctaccactaagttggataccatattttattccattatatgcaagcattgacggtcagatatcatgatttaagaaccgtcaacacccgcgtcaaacacttggcgagcgtgcagacggactttgtcttcatcgagaagaagacgcattacatttgggccctcctataagactcacaacttacatgtcatcccttttaacataaagactccacctagtagagagttatactcttttttattagcattagtgtaatttcttgccttgccctatccctctcgcccaggcgcccaccctttgacctcctataagactcacatcttatatgtcatcccttttaacagaaagaccccaaatttcatgccttgccctatccctcccgcccaggcgcccacccctctctttctattgctctcgtgttgctctttgtcctctccaatcatggatgatctcaaccattactagactatttcttagcagaggattttgccatgccttgcataccgcaagctttttttaggtttgtgtatattgctgcccaaaccacgccgttgcccatcaccctgacacaaatacggttttggtcgaaggattgatcaaactatcctctattttttcctctctatgcgccatcttttggattaacattgctccatgcgctatctttattggatttatattttatttatttatttatttttgcttgttcacatctagtcatgatggagagttttcccgcccttacgcaccaacgggatgagtatgactgtaaccacgttcagagtaccaaaaatgatgcaagatgttccggagggatatgccgaatagatcattgtccgtgtttgagccttatttgatggacttagatggttcttgtgtgcgatttattgattgaactctgagtcctcatttttagatggacttagacgattttttttgttatgattcttgtgtggaatttcctcatacgaggaaaacttgtgtcgttgcagcactgggttttgtatagtgcgttaccaagatttactgtctcacatggttttatttgtatttggtttggatcagtggcaggtttggattagtggcatagggaggggagaagggagaggcctggtctcccataacaaaataaaattgtaattatcaaatatatctacttaatcatcacatgattaaattagcagtaagtgttttaatcccctatagtgacagaaaatccaacacccctctagtgacaggaaatccttctaatattggaagataattggctgtgttttaatccctctagtgatatagtgtatatggatgagcatggaacactggaataatcacgttttatggtcgaatcatgagtttgattactaatgcgataactgcgttaatatacctacttcctcgcaaagtttggatcaaagtgcctaattccctacttaatttcttccatgatttggttgatgtctgctgaattccgttgtgtgacatgagagcgtgactaaattatgtttgctgtttttttaggtatcggcagtacaacacggtcgaaggtggcaattgtcaacgtaaattttaatcaacttttgtgtggagtttttcgagccagcactccttgaaatatatgtcccaccacccagttgaataggaaattaacttttagagataactaattttaaactatataatataacataatatatacttatacatagtgaaagtcataaatcagttgaacaatatttatagcgcactatgatcatcagatttacaacaaatgttacttaccaattatatatatattagttaagagcattctagatgatatttaagaaaaaatatctctcaaattctaaaatctaattaatcaacttggaagcatacagtgtaattaatatgtcacggtaattactactaactcctgtaaaaattacaaataatataatacaaagcatgggcacacaaaccaactggcagtgtttattggctaaagctatcagtatcatcatcaataataaagaaaaatgagataacaaggagatggaagagtggaagaataccatgagaaaatttcatttttatcctacattgtgctaaggaacaaattcgcgttaaaaaatatgaaaatttaataatattagtaaatcattgatgagtatattatacaatgtctttctgaaatatatgacatccagccagggagtgtgagcttgtcatgtgagttgggcacctctttttgctgggagcctctctttattgcgattcaaagtgcttaggttgaggtagttctctatctactgcccctgtaacatactatatttttcagggtaatttttttacgaaaatctttaaagtcgttgttctttgttctttcgaattgaagcctcccaatccttacattccttttgtttccttttaattttccaactccctcgtaacttcgtttagttttccctccaaaccaaatccaagatatcacaaaaaaaaattcccaaaaccatccgaagagctcgtgtttatttttaagttctcgtgtttatttttaagttagcccgaagtcatcatgcaaatattctaagatccccaatcccaaagattcctattcggaaatattttacaagaattcgattaaaaaatctcttcaaaaatttaaatagatcactatgattctcctcaggccgaattctttgcaatctagcccatattcccaatttactttccattgctcctctgtattgggctgttctaacccatctcccgcacaaccacccagctagcagcccattgccgttgctggccgagcctccaactgacacgctgctcgtttcgctcgctccagccaccgctcgcgttacgcgcgtttcgcctcgcacctccctgcgccttgcttgcgcccgctgcccgcatgcgcttggcccgcgctagccgcgtgccgcctcgcacctgcctgctctgctccgcgtgccgccacgcgcacgacacacgcgcttgaagtcgctcgaaggaactcgatcagatggtgccgacgttgtcgcacaaatcttaaaaccgagcaagcaccactgctaccgtcaatctcccgctgcccaactatttaagcaggcaaggtagctgtgctcatccttttcccaaatcactttctgtcttcaatttcttcaagccacgctgccgtggtcatccgccgatccgccgccgcaggccaccgatcgtcgtctgctcgcaccaccagcctctttgttgcttcctgcttctgcaaaattgaccatgcatccatccaattataggccatgtgaattaaatcagtgggatcatttggaagttttttctcaaagcaagctttatttctacatttccatttagaccatatcacaacagcaatcccaaccacaatgagattttttatgaatttgtcagcattcttaatctaggaaccaaacagttcatgcctgttcaaaacaggtttcaaatttagagcacaagaaataatcttccaaatcaatctagccgtgggacaagcaaagaaaaagtgttgaattgtttcttccttatcacaaaactgacatttattatcacctttcctccagcccctcttgaaaagattgtcattttgtcaagattttattattggtaaagagccaaagaaacactttgattttcaaaggtacttttgaacttccagatttttttatgagggtaattcacttgcttaattttaagtgcattacagaaagatttcacagtgaatttcccatctttggacaaggtccatcagagtttgtctctacaattttctttcaaattcaactcttcccagttgtgtataatttttctccaatatctcagtttggctccatacagatcccttctgaattttatagaaccaataccttttttgttcaagtcagcaatggtgatcttttttttttttgtcaaggctatgttatgaatctcagggaattgcaaggccaaaggtctaccacctatccagctatcttcccaaaaaaaaaagaagaatattttctctatttcccacttttttattcacagactgaagaaaacatctttcacctctataatccattgccaaaaatgtgaattaccaggtttgagtttcagaccagatagtggtttgtttttgtaatatttctcaataatgatctcttgccaccaaccctcttcattctctaatttccagatccactttcccagcaaagctttgttcattgcttacaaatcaatcaccccaagacctccttagtctctgggtgaacaaactaggggccaattaactagatggtactttctaataccttgatcttcttgccatagaaatctttttctgaagtaatccattctatctttcaccccttttggcagttcataaaaagagagcatgtacataggaacactacttaaacttgaattaagcagcaccagccttcctccaatagattgcagcttacctggccagcaacccaatttatgctccattttgttctcagccaccttccagtccttgtttagtattcttttttggtcaatgggaatatccaaatatttcagaggtaaatcaaccacattgcaggtgaaaatattgctatatacatgttgtttttccttagcttcccaaagcaaaaaaaaaaaaaaacctcactttatcttaagtccagcaagttgctcaaacagacacaagatgtacttcaaattttttgcatgctccagattatcatcaataaggaaaattgtgtcatctgcatattgcaagata

SEQ ID NO: 61718 - DNA, 1444 bp, Oryza sativa
cggggggcgtcattccctataggtgacctgtagaaaggacacggtgggctttttttataccacatggaaagaggaatttccacaccttatatgtgggaccccggttttccactcccggtttaaaaccccggccattattgtataccctccttaagggatatttaggccggaaactccggtggttcgggattccttttaaggtatcgagggggaatgggtatagcctaaaccggccctcagccagttctttaacaagggggcccattgtctcctagggatttagcattttttgttttgcaattaagggccaataatgtgcccaagttaataaactctttttacccgtcaaaaattcttttggataatgccaatcaaataaaagtggccgacagaaggtgtaatctggtttgtaagcttttaaggccccaaaactgtctgggtaacttggaatactggttttaccatatcatttcctggtatgtataggctgtttcatatgggtaatagtaaagcttagctattagactatttcataccataattttataatatttggtgggtaatctttagagttttctattcggatgcctgtcaagtgtgttcattcgtgaaccttttagagtgttaaccactcggattccttttattatggctaaaaagcagtcggctaagaatgcctctttaggcgccgtgtatgcttttgtcatatgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacaagtagaattaaaacaaccatatttaacagttcgatcaatatatatcttttcttt

SEQ ID NO: 61719 - DNA, 27873 bp, Oryza sativa
gaggtgagggggctgccgccgccgtcgccggcgacggggccgcacgccggcggcggtaggtcgcgcggggcgcggcggcagggggagaccatcgccaagggccacaagaactatgagcttatgctcaacctccagctcggcatcaggtgcgtgcgtctgtcccgtctcttactcttcttctccttcttcttgttctttttatttttgtccgttctttcgatccgggtgctccatccaaattttccctacatggatttcctctcctttttcaatgtatttatgctgattgcgcattttgaatttcgtatgatgtaatgccatcgccaattaatctaccgtgcagataaatttgcaaaaaaaaaaaaggttagaaggtgatgtttattacatgattttaattagattattctggtctcatggtaagcaaaacttttcaatggctagctacaaatgccgaatgattttacctccccctcctgacggggatgtggcaattttacaagaagtcattgtttgcacgtagaggaagcgacgcgttgaaaaattcaacaaaaaattctatgcctaacatgtgcatttgtttattgactcgaagctgaaatggtggcaaattgtgattaattggaattttacgacaagaagaggggattctttttattgaaaaatttaatatgaagtcaagcataataacagcagggcatactgtgggccaaaagcatacttgcatattttcatttaagcagatattatatcttcttacactagaatagtaaaatgcatgtatttgcaacatttcagaatgaatttgtctatgctctaataactttgtctgggcaatagacatgcagtaggaaaacaaggcccgattacgcttgatttgaagtcatcagcttttgacccaaaggagaaagtatggacaaggtttcctccagaaggatcaaagtacacccctcctcacagttcttgcgatttcaaatggaaagattactgcccgcaagtgttccggttggtcatcactccaatgacttatttgtgtgttatgcctgcatttagcttaattcattctcatcagcggtacaacttgtcctggattgaatcacaggacactacgcaagttattcaaggttgatgcggcagattatatgttgtccctttgtggtgatcaggctctccgggagctctcatcccccggtaagagtggaagcttcttttatctcacgagcaatgatcagtacatgataaagacgatgaagaaatctgaagtaaaggttggtgcatcatgtttagtttgtccagatgctttctgaattcacatctggcacttctgtactaaatctacaaagaacttgccatcatgtagatatttcttaagatgcttcgagcttactacaatcatgttcggtcatttgagaacactctagtcaccaaattttttggtctacattgtgtaaagttagctggagctaaccaaaagaaggtcagtacttaatatatatctgtatatcatgctaaagctaatttattagccaatagattcttattaagcttataaatcaatatgtcatgtctgctcatctgtttgctatattattaccaggttcgtttcgtcatcatgggaaacttgttttgttctgattattccattcatagacgatttgatctgaaaggctcatcacttggacgtacaactgacaagccacaaacagaaattgacgaatacactactttgaaagacctcgatcttaactttatctttcgattgcaaaaacactggcaccaagagttcctaaggtaagtgaggctagtgcaagagtgagtggtcatcacatttttactcgttgtgttaatgtagaagttaaatgtgttcaagcagacaagtcgataaggactgcgactttcttgagcaagagaacatcatggactacagtcttttggtgggtgtacatttcagagacaaaagaaatctattagcaagtgaaggtaagatgaaaaatataatcaatttaagtttttgacatggttgttctataccttacgaagtgcatgggttgaaggttcctttgatagtgatagtagcagagcgtcatcgcctcacctgtctagaggagatactgatccaaacaggtaaaataagatacttgattactcttgctcttgttgtcaatacttttcaggcatacacatgctatacgatcttccatattgagatgccccatatatatgcttccttgatgttcgccttgattctaatgttatgttcaacgggcttcattgcagtagagatatacgatacttgtcatcaagaactaataggcagcattcgttgccaccaccattttacctccttttccttgcacttctatatgataagaaataatttggctgtattgatgtctccaagttctaattttaacatcactaagattctttgggtggacaggttttcgaagataaaacttgggtccaacatgccaacaagagctgagctaacagtacgaaagagtgagtgcgagcctcagatcatcggagagcctactggggagttctacgatgttatactatattttgggattatagacatccttcaagactacgatatcagcaaaaagcttgagcatgcatacaagtcctttcagtatgacccaacatctatttcagcagtagatccgaaacagtattccagacgcttcaaagattttgtgtacaaagcgttccaagaagagaagatagacatctgaaaacacattgggactccagagctaccgcagctgccgacatagatgctggtcatatttcagcaggtttgatgcctctacttgtatatgatcaagcagaagccatcaggctgatcaaggccctgcttgcagacccccaaggaattcagatggctccgattgggacaatggtgcttttcaataatctcagattcaacagtcttttcttcccctgaaaaatagacacagcttcctatctacagctactttgttacaatggccagtctagcatagcacatcaatgccaagctatgcctaaatatagctatatacatgcatatagaatccactaatgttagtgtagatgctgacttgaagattcattcttttttttggcacacttgaagattcaacttacagagagaagtttgtagtgacaaagttcagagatgtaaatgttttatgagataacatgtcgctatcctcttgtttatgtgtgttattaacgagggcatattcgccttatgtaactcatatgaatcattctaaagtccataactttaggagattcttcactgttgaagtcaatggcatgcaggaatatctgagactgacaccatttttgctaccacctctgaaatcaatgaaacgtattgctcagggtattttcttagcattcctgaacctgatatcaacggtaagatggtgtattttagctatgtcacttaggtcaaagtaagcacatactgttgtttttgccgggttgtcagatttcttccaagataatggggaaaattaacttaatgatttgccactcggacccatatgtccgacatatgagtgttagaaatataggatcattaggtgcggatctaggggtgatatgctattttttcgcgaatgcgcaaaaggattgcacgtcaatataggggggggggggttgagatgctagctcatagcaataatgggttgatgttcttgaggggtgagcggagggagagagagagagagagaggcgtcggacttggagcttgatgcggccacggcgacggtgtagcggagtggtgtggtgttggtgtagatgacgatggcggcggcagtgagaacgtgagtaatcccctcacttcaacgccttcccagattggagggacttagggtttgtggggagcacatgtgcatgggaaaaactcacttcgcgtgtgccggtgactccccttttattgtggcgctgcgtgagaggggctcacagccatggaacggctagcgcccccgatcagggcgcttacgtgcgtggagtggggaatcgggaaacaatgagggctcacacgtaattgatacataggtgccaaatagttaaacacttaaatgccaaatctaagagtggcaaatagatattggagatgcaacattttgtgagatgcatcttgtttgcgctaaaattgggagcattcttcattcttcggttttcagttacacagaaactcttcccaattcaaatgctattcattgtcaaattatacatgaggaattaccggccagacgctcttgaagtggacgacatttacttagcatgactagctatttatattcacagtaacataacaaatattacttcatgttgacttgcaacaactgactcactaacaacaacaaaaaaaaaagattgtgtttaaaactctacaaaaattcatgctgaactccctaatttcataagaagaaggaaataataaaaaattacatgggattgggatcaccagaatcctctacatgttgacaacaacatctttgctatcaatcgcagcgaaccagcggtcagtgatccgtcgatgccttgccggcagtcgtccgaacagcttgcataccatcaagcaaattaacaatgtcccagaggaccagcatatgccagtcgcggctgctccgtgtcaagggtatagggctcacgcggcgcttcatgatcaagctccgcctaagaccagtcctaacccaagacattagacatagttttcataaactccacatcatcaataaactactactagacactactctttcaatataaacaccattcttccatacttaaatttaattctacttatctctcatgatatgttggatattgtgtagaaactaccccctccatactcgtaaaggaagtcgttttagacagcgacacggtctccaaaatacaactttaacttcttgtttctataaaaatatttattaaaaagtgatatatgtatacttttatgaaagtatttttcaaagacaaatctattcatataatttttacattttcaaattcaacaacttaagagttattcatgatttatattcctaaggcttgacttaagcattgtcctaaacgacttcctttacgagtacagagggagtatgtcttatgcaagatctgattttattctcttttctcatttttttcgcttgccacatcatctttcatcataggtggtagcttatttaatactatggacaccatcctgatcattgagttggaactggcctaaaagccgcgcaacctctcgatccagcgctgtggccggccgccgccgccattgctcacctcccgctctgctggccgaagccgcagagtcgtttcttctctccgtttggatttttcgtcgacatccaacggtaaaaaatatatttttttgccgtaacagtattgagagacccatcatactttcggcccggaacgacactgcggcccacatgaagcctattgtgtttttggtccggaatgggattgccgcccacatgaggcccattaaattctggtccgaaaggaattacggcctacgcgaggtttctttttggaataagttcaccggaggtccctcaacttaacagcgagatttttcgagaactcttaaccacaaaaccagaaatcttcaccccaaaactatacaaaaccgttcactcaaggtccctaggcagtatatatgagtggtttcgctgacgtggcatcctagttagccaaaaaaaaattaaaaaatacgtggggcccacatgtcagctgcacttttttttcctctcttttcttctccttatcttctcttttctctcttctctatttctcttcttcagtgagggaggccggcggcaggcggagcagcgcgcgcagatgcgggtggcgcagcagagggcaagcgccagcggagcggcggcgggcgcaatcgtggcgggccgagcagtggagcgcaagcacggccgcgggcagagaagcggagggcgagcgcggcggcgggtggagcggcggagggcgagcgtggcagtggagcggaggtgggcgagcgcggaggcgcatccagcccaccccaatcgaccaaagcacgccctttgccctcggccataagccccgccgccaagtcgccgtcgccgtcctcctcgtcgtcgtcgagcggcagcgatgacttcgcggtgctcctcgacgcggagctcgagctcaccttcgccgatgactcggcctctgccggagacaacgacttcgaggaagacccctcccagccttccctccttcctcctcgagctccctcacgccggcgccggcgccggcgcctacagggatgggaagccgacagtgctggccgtcgtggtcagctcgcttgccgcggcaacgctggtcccggcgctaaccggctgatgcgtctgcggatcgatgccctggctcatgagcttgcgcttgatgtgctgttccacctgcagaaccaatcaatcagcaccaagaacacaagaagagctaaccggagcagatgacaacacgttgaaatttgttttgcttacttgttgccgagaagggcgtggagcttgatggtgagctcgtcgtcgtcgtcggtgaaagttgctgcacttgaggtcggggataaggtagttcatcgagtggaggcagcagctctttcggcagcggagcagccccatcgccttggggagggagagagggtcgacagggagagcgcgccgctcatcgggcggcggcggggcccgtggtcgagcacccggcacgttcgaacatctccgccgccgagctcgccgtcgcaccggccgccacctctcctccgctcccgccgccgccgtcgcatcgactgcctctctctccctctccgctgccgccgtccccgctccgccgccggccacttctctccccccggtcgccgcgcctgctcgacactcgagagaactcggagagaagagaagagaaaaagaaaaaaaacagagaaatgtggaacccacaccattgtctcacttacatgtgggccacacattaattttatttttttttctggctaggatgccacgtcagcaaaaccacctgtatatactgcctagggaccttgagtgaacggttttatatagtttaggggtggagatttctggttttatggttaagggacctcaaaaaatctcggtgtaaagttaagggacagccggtgaacttattcctttccttttttccggtccatttttctcggtccaagtgagccttacggttcggtttgtccctcgctgtgttctaatttccactacgtacggtacgacacagcatggcatcagaatggacaagggaaaattacttgcaatggtaataaagctaagcttcaaacacagattgtttatgcaccaacagggttctcatttaatcattttctttctcaccttcatcaaaccaagtgttataaaccaaacaaccgtacaaacgcgtaactctattccttccttttgagtagccacacaaaaatacaaatatatactgttatagcgctggaaatttttgttttgaatggcaccccaccttgacacattacatacaggagactataacatcacactcaagttgctaactcgtgcaaagcgatacgataaaacccgtattggagaacaaaaataaatttacattctcaacagcaattcctacaaatgattaacatggatgggaaaagaataactaccaagaatatacaatcgtggaactgaatgaacatcctaccttggactgtcccaaggagagggcggtttgttgtatggaaaaccctgagaagcggatccatgtcctaaatcgagactgtggagttgttccatcagttgcgacctccgctctttgaagaagtctagcctagttgtcagttctaccaaagtggaggaggccaccattggttgcctcccataatcaacaccctgccatacgataaaaataagaacaatcttcctttggaggatattagtagtgctaaatagagtggctgtgatttccctaacctcagtaaactttggggcattgatagccatagcagtgttatctgttggcatgctcgtcgatgcctccatgcctcttgaatcgcttgaagatgcgtccaaagagagcttgcgggtgagtggccttgaagaaccataaggtagcacatgctgcttgatatttctccactgtgatgagtccaccgaactctcctgccatgccaaaatatgatccgatgttagtcagggatacgatgccaatatcagattaaagcgagtgtgtttccttcagtccttctggtggaaactcctaacaatattatcgtgcaagaaattgtttgggtaccacaacccacacatcaaaatagagcaattattatttgtttaggagacatgatcaatagcagtaatatccgtttccaaaactgaaaatgagtaaaaactaataaaacagtataatagagcattcttgttatgctgatgtgcacaggggtcaagttggacctgaaattcaacacacctctgtgttgttattaagctcacaatgtgtagagtaaatagttcttaacaaacctcatttctctgcttctcttggttgcagaaggcaaggttcatgtcgaatcctggctgaacaaagttcctggcaccaataaaatagtcaaaataagatagaaatcattaagctcagtaaagcatatccaatatgtctcgatacattgagctatcaattagtactgcacagattgttttccagtgaaatgttgtccacaatcagatttcaagtaagcaccagttgcagcataattctgtggctgcatacctgcagccactctttacagaaatggggccacttggatgaaacagaacaataaacacaattacagaaaatcaaaaggtgccaaacctactgaactagcaacatccatccgtataaatagcagtagtaaaaaagaaaacaacaaagttgattacttactgctgcgaaaaatggccaggaatacggtggtaacgatcatttgcatctaccatagggccatactggtgttggcgctgttggttgagttggagatgaagctctgcaaccttctgctttaaccttgcaacatcagcttcagcaagagcaatctcctcaagttcagctctcgtcttgagaaaaacaatgagtgaaaatgagactccgtaaagtaattccataaagtagagcggtcactagaggtaccttcgtgtccatagcacgtgaactagaaaactgactggaagacatgctcaatccaacctccaatgcagctctaagatctctctctgcctgtagttgctcttgcaacctagacacctatcaatatcacacttgtagaaattactatctgaatgtttcagtcaccatcaaatatatcacaagtgttcagccaaaaccaaatgtaagggaaagtatcgttttggttcctcagtctatgggctatgggtaaaagtgacttttgtgcaggcattatttcattttagtccctcaattttacagcatttccaatgcaagggatgaaggcaacctcagcaacaaattaatcaaacttatcgagcctctgggtcagggttaaaaaaaactggtggtaagcagtccaggtcctgggactggttaggggatgctcaccaacaggaatgatgttgagattatatttataatttataattattctgacagttatcagtgcagtaaaatccagtaaccagaaggttactgtatttcactgatgaacgataataccaggattactgatattaggaaccctgatctgattcaacgataagcaaggcccaaggagctatcagttcaaatgtcaacgaggggatccaagtctctgcctggacctcattctgaattgctggaaatccaggcaagaaccaggatttctgtgttttgcatgtaactagtgaacagtgaggtttgtgattgctattttcaaggaatatagacagcgctgatgattcaacgtgtagaaaaagaagagacaagcttcaagaaacacacaaaataaaagacaaatgaaaagaacgctagatgcacaatgtcaataaaactaggcattttccagcaaaccagtgggatgttggatttgaaagaattctaagattcagaacctgcctaagggacaaaaaaaaagggtatctttccccaatatactatagtaaaacatatgcacttgacgaccaagcaaatttgatggtacaagggaatgcaacatacatcctgttccagggccaaacgacgttcatgcagtgcttgtttccttctttccaaacttgcctgtagaattgcattacccctagcctgaagccactccttgttagatggcaagcataaaatagaatattcttatgtgcattttcttcacatacctctttggcaattctgttctgcagatcattctttgctatttcgagcctttgaatagcaagcctggaagtttttatttgcaaagcaaaattacaatcaattaatctatggtatgcatattcaacaaatgaacagcagcggcgtacagtagcaatatcagcaaccagggagtgtccttagcaagttattgatcctttaacttctctggattaggttaggcttagttagcaagttatgaatcagcaagttaaaggattaggttaggcttagttaacaaacaagttattgatcgatataggaaggtttgggtgttcaaggtattccattatgacgactactaagacttctgtttcagcctcattcaaaacaatgttagaccctaggttaatccaacgtttctccatttggataggggaattcctattaatctatcgacagcttattagttgggaatattaaattgagttgttaggggcattatcatccttttcagcaggcaactaggcaagaaatgaaaatagaagtccgtagactctcccttctcagccagaggcctcagtgccttggcagcagcaatggagggggtcaaggaagggcaagtgctagagcattggcaaacatttccacagtcaatatagaatggcctaatgcaatacaactgctcagattcacaactattaacaactaaactcaacgaaacagcactgtaaagtgtaaacaaaaatgatttgttggtgctttagtggcaaagggcttactcttcttcaccagatgagtcgactgattcagagtgttgactctttcttgcctgcataaaacatgcatatagaactcagaacagaataaggtttctaataattccagaaacaacttcaggaacaatatggagccaactaaaccataattcgatggagtaggaaggtggaacagcaatgcactattaatacccagtagctccaaaaaaaaggcagaaaagaaataaacatagctaggtttttcttacattattcctcccccagaagttactgcgtttcacatgtgggtgagatccattgattttggctggctgtctgctttctacagaatattcaccactgtgattagctaaagatattccaggatccaaagaagaaagtatttctcccatagacagtggagtctcatggctagatattgggttagaaggattcttttcactcagcaatgtttccatatatgctgaaccgttttcagctgaatgactttttggacctttgcttaactcaatctttacttccgctgccttagcatcttcagaacgttcagcatctgaatcatcagcatgaacaacctgttcaatcaggtgaacataagaaataaagtattaagattgggacattcaaaagtacacagaaataaaattaaaaattgcctctcaacacagtattgaagctagaaagggaaacgcacaaatgagatactcatataacctagaaatacaaccaccaaaacttcaagacatttcttacatggaacaaggtaatattctaaagtggaagatctataggcagaagcatttaacagaagatgacagccttcagggttatattaccatcaatataaccataatagatccatgccgcaagctctaatccataaaatacatggaagtggaaatttacaagcataacccagactggcatgattaaataatactgcaagatgacaaaaacaataagcaagggttctcaaaatattgtttattagtttttctgaacccaggcagtttatcgcttggcgggacattgctgggttctaagtttgcatgcattcaaactcattggctgaccaggtcaaatggttttgagaaaccatatttgttcagacctagcaacaaagatttcacccgagtctttcgtatctgcaatgatatctactggcaggggtcaaaatgggtcatcctatcatatcctttggtcctccaaaaaaactacaataattacatttaaattacatattcacagtttgcagctgaaaatgtactggtgtccaaaaaacaagctcctcatagatgtacaacaactcaacaggaagtcaggaactacttttaatgccctactagtttttatcttcattcttaagaccataaaaaggcatacttatacatgtacaacaataaataacagcagtaataaccagattagagatttaaaaagtaggaagcatatcaaaaccttgtagtcatagaggtcactgccagcgtatccactgctctcactcagttttccactaagtatacgttctgcgccattctcatcatccatttcctgatctacatcattttcagcatcatgaaatccattacccttgacatccaaatttacatcatctgttgatgcctcgctaccgctatcttcaatttgagactctggcgacagggagcatctaaggttgtgttcaccctgtaagatatataaatatgaatgatcaatagattagtgttgtctttatttctagttcacatttcaaaatatgttctacacagaaaagaaaaaggcatagcttccagcagacagattccaatgaaaaagaattagcgcaactgttgatgtgaagtattgttagcttttcgatggataatggtaatatcaacagattgttcacagaaaaggtgaatccacaaaaggagttgagaatcttacatcaaatatactctcgtattcctctaagagagttgtgacaatgccttgagcactgttagcggcatttgcagcagcaagaagctgtgcagaatcatcgccatccatatcaaatacctcatccatttcacattcaccagcaagaagtggacgcaacaacagaggagccatacaggcagcaactgctgatgctgtcattcggttctcggaagtatgagaagcgatagtatacatcattttcaaaattctgcaaataaaatctcaattagaaaaaggagtttttgacatatgattattatccaaattctaattgatcaaacaagacatctagataaagattattgaggtgttgctacttcaaacttaaaattcaaccaaggctaaaataaccaggttagtatatgctctattctgtaagggttccaaaaatcaaattatggaaggtgctcttacgcttcaccctttgagaaccgccacaaagtttgaagcataagtcaagggtggattccaactacttacccttcactagtgcttcaagatttgtgtaacttgtattacaaaacatgaaagcacttgtaacaaggtttttaacccataaacagtataaatcatttagcataagctggcggacttgaagcccaagcgagagtaataaaacttcctagaacatttagatgcgatccagtataacaaaaaagaaaaacagaaaaaaaaattgatacgaggaaaaccatgaaactaacctctgcagtaaccgccgattaggctctggaaatgtctcaactatagctgagcgcatagcatttatccgagcatccttagtctccagccctaggaaagtaaagcagaatatagacagttagtcaaataaaaagacagcaaaggaaatgagaaagcatgtaagatcttagcgataaatgtacatcaactagcatcttagatgcttgcctagatcaactaaaattcagaggcaaagaatacacgggaatagaggagcatactatgaaactatatagaaatataatcatcggccatacaaggggacatgccaatgccaggcacttttgagcaaaataactacataattcaaaaagataattatccccatttccacagttatctacagacttcctggaatagactgagatggaattaaattgtaagtgatacacaacaggaacctaggtgtgtttcctagtatcctatgcatatgtcaatactcaacagtgacggaatatactagagcaatatcacttagtttaaactgaatagaacacttacgaaaagcttccaataatgctgtacagcaggaagcaggaactggagaggatggtagctctcggagaacatgctgcagagatgtttacatgaacatacagttagtgatagaacggattattcaagctcccagcacaaaaaagaagaggtaccgtgacagagttacctttacacaatcaccaacaatgtgagaatcttcatccggtgcaaactccgtccttcctggtaggggatataaacaggcacaataatggaaccatatgcaaattaatcaataagcgaagacaaaaacaaaacagagctaccaataccatcaaattaacaatactagtcatagaataaactaagaaatggttcaaccttgctcgtattcctgcaatctcctgtcaacctcctctacatctgcagcctggcgtagaattccttccacctttatccctacaagaaaagattaacataactattgtacattgtacagatgctaaactagcagtactccaggttctaaagatggtgctagttaaaaattatttgtgcacccaccatatttctcaagaaaacgcagagctttttctagaaaagaagggcttccatcaatatcctcaagtgcgagaagaattggcctgccaacaactaacgacttgatcggcctcttctctctccctgcaaataattggaaaggcatgagttaacaacaaacaaggttgtaatgagtaggagaagaaaaaaaaatgaaatagcataagtagaccaacaatttgggatagctccatcatatgtgtcagtcgtttcattacgaaagatcccattatgtcccatcacaagagctgcatttggagcctgcgcaagagcctcttctaatgctgttttccactcaaataaatcttcagaagtttctgcctgtattaagcaaatatacaacattcagaaaatactaataaggagtaaggagcatgaacatatgtctgatcattcaatctctcatctgtgttgagatgatccaattattaaataggaaaggaaaaaccatcttaccttaagggtgaatgcacgaccatcacggccatctgggaaaaggacagtcaataacttcttgtcttctctgactaccacactgcaaatgataagagcttttaatacagtattatctgtacatcctaaaagggaaaagaaaatctcaagaatgaggtaaatacctcccagaattattcaagtcaattcctcccagagtaacattcacttcaccacctctctggggcaaggtactctacaatgtcaacaaaaggtttatcaagaattaggaaatggttgttgttacacaagttataactgcactagtgggtgggtgggagagagagagaaaggactcattaaataatttaactcaactccctatcgaaaatagaaaaggaaatgcacatcaattgggagaaaacaagttgttcaaaacttaagacaggagagcttatataaccaaagcatgttgtgtaattgatttgttatgagcactagatgttgaaaactcatgcatttcaaagtattgcacacatgcgaaaaatggatcgaaaattgaaactatatactattaactatcaaattatctgtgcatggcaaggtggcaatgaacttttttttccctagtaggacttgtcttacaagcagaacaatttatagcagtttcaacaaataagagtgatggcacttaaagccaaataatcacattctgtggtggttgtgcttttgccggaaaaagttcatatgctatacttcatctataacatcaactaaattcagggctctgagaaacaagttatgcaaaggtacaccaggctaattattgacttctcaagcagaggaaacatataatgatagaaatactaacaggatcactcttgaagaaaaccaatgatgttcgtgtgaggatgaaccaccgttttttccatgatttccacccgattcctgaaaattatatataaaaagagttttctttactgtagaagaatatgatatcatattagaaagttgtagaagacataccaaaaatagacaatgtgatactgactcacaacacatgatttaattcaaatatgaaagggtgattttggtagattaactaaattacaattcgtaggaatcaatctgctcaggaaaatcatgattcagctggcaggagtcatatttggcactctaattgaatttctgaggcataaggcaatccaaactatcatttggtttggattttggagccttccccatggcaacaggtttatctttcccacgtaagttggtgacaaaggcatgatacaagcatatctaactttgagaaaagttattctctagataattcctggattcgtatagttcctttgtgcgtacatgattgctagcaagatacttcaacctgattaacctatgttggaaattacagaacatatgttcctcccccttcgcttataatccaagaaaccaagaaataattaatatcacaaaaaagaagaatattatggcatcctctatataatcatggtgtcggcgttcatcaccaaaaatatgtgagtgcctcaattctttgaagaattcaaacagagacacaagagaaaatgggaatatttggactaactttacatgtttacatcacataaacggcctgaaacaacttatgatacatgtgacagaggtagagagcaagaatgtaccctttgatgaaatgaagagaggtccactcttgaaaacctggttagcacactagttgacatcagaaatgtgaacaggacaataatattaaatatactaagagattgcaatacctagcaagtacgtaatatgtatatagacaaacattcaaaattcatagtagatgaaatggaaaggaattgtatatgtatatccgatacatgaccacgttgttaattaactcttgtgtgttcaactctagtgctaactaaaagcatactgctttatgctcaacatgatgaataaaaacagttccaagaattcccaaattaattttctggagaaaatcactgtgcatggacctaacaaagtgaatatgattaggttttcattactaaaagttgcatcctgtgatggcatgataacaaaattagtgttgaaggtaatgtcatagtagtattggaatttgatcttctaaatatagacgaggtgagcgcagcaagtagaatgtagattgatgctaagatgtctatttctatctagctttatcaagagttagggcttggggaactgaactactgaagtcgatcaatttaccatgtcatctgatctgagtttacatgcatgcttatttacaatttactaatgtaatgggaagccacgcagaaagcttaagcacattcatgaaatgcatatgctagacatcaaaccatttagaattccccaaatctagtttcacgaaataatagatgtatctgcatgtgtgagcttcctaaattctactccctccttgtgctgacagctgatcatcttccaaccagatattatttcttcctttcttacctgtgcaccgctccaccctgctcttatcatttttgctccaaattatccttcacggttaccatgccacaaatctcccgccctcaaattctctctccactcggccccaattcacgcgtgtcaccatcacgtcaaaccccacgcaacatctgacacaccattcagccgtaatcagagccaatctcaggtcaaaaccaggcaagcttcacgatgcccccatcgacattcggcaagcatcaaaacctccacaaatgtagttacatttccttatccattgcatgttccggtgattatcctaagctgcattgccagcaccccgccaatatgaccatcggtatgaaggaaatcgaagctcgtgggagccccccaaaaaagggcagctcatctgatgcaacccgactgaagtcgaaaccttcctattaatagcagctacgcagcatctccttgccagcaatgccagtctagagcagaagcttgcggcggccgctgaaccccccatgaggtccaaattatagagccgcgggaacacgaaaccgagatgcccgtaagcatcagataccaaaacccaccccaaaatcccccaagccaccacccgcgcatgacgcacgcaaggaagctagctagctactcctagctaagcccagtccacacggagaggagaggcgacgcgacgtgaacgcaccgtgttcccgctggccgccggcgcgcccgcccgctggtaccggtcgaacgccccgcccgccgccggcgcggacgacatcccttcctccctcccaccacctcagatcgggcccgctcacccacgctacagcggccgcagccgccgccgcattggatccggccgacgcgtacggatccgcgcgcggcgcgcggatggctccgccccggccccggggggaggtggccgcgacggagtggggtctaggtctagggtttggttttagcgcggcggtggctcgccgtcacaggaaggattcgggcggcggcggcggcggcggcgggggagggaggaaagcgaggcggatggatgcgaagagcgaagagagagagggggggagggagtaggatgccgttgtgttgtgtgtgatggggcgctgcgctgctgcttccgctttggcagctggcttcgctttggagccttttgctcgcctcgtgtgcgtgctgcgttgtaatcgtatcgtacgcctgctcgagcaagtagtagtagcgagtagccgacgagtttactacactggttggtaggtgatggtttggtttggttgatgtgggttttagcaggcttacgctgcgctgctatagtgtgaatcgactgtgatctcggcgattctattatatggattaaaatagatgtaatttaataaaaaacaggtgtcacttgtcacgagggatactagcactgtatcattcagataaccttcacaattaatgttgatgggtattataacgcgacttcgccgaatcgcaattaggaaagtttggattcaaacatggcctaatatagatgtcggttttatgctccactcaatcctctaaaaccattattcgatctatactcgcaccgaagttggtttaagaagatctagtttttaaaataaaggataatataagaggatttagttataaagagacttgtgggatggctctttttttttatctcaaaattatagcatcctttcaccattaattttttttccatatccaaacttctttataggattgcgggtgttcttgaacacctaggtttctacaagattttgtgcattgattactttatttctgtctcactcatgttgtgactacgttctatgatccaatgtcaatcacagaggtatgaaaatgtaaatgtgtaacgagccaagaccatgacaacgacacaaatgaaaggaacgcaacaaaaatctaatcaatgttagcaatcaaaaagtacattgatgtaccattaatgattcttatgaagtagggaggaaaatgtaggtgcactaaaggttaatgttaggaattgccaatttattggttagtatttgtgcttgtagttgtaggacaacgatggtgactcatgaaaatttatatgaaaaaccagtgaaaatcaaatctaaaagttctccaaatttatataaaaaatttataaagataagtataagcgtgaactacattaccacgaaatctcaagtccaaatttaactttattttaaaggaaaaaacaaattttgagcaaatcctagggcactatgtattaaggttaatctattcatgactacttatatactccctccgtcccaaaataaactaacctcgtaccggatatgacacatcctaatttacttatcacttactttgggaagatcttttgtcattactaatgaccaatttatattgttaagataggtcctgaaaaaaaaactactactacgtagataataggaaacgtgcaaatattcattaggttttcttttcctatataacattattatttattacattagcacgtttttacatgtcatcaaattttatgactacgtgtgctgggttatctagaaactttcagggcccctttcaatcctatagaaaaatttcctatgaagccctttgaatcaaaggattgaatcctatccaatcctttgaaattcctatggaatggacaatcctatagagattttggaggaaatttagcaagagcttcaacctcttgctaactttcctttgagtctatctctctcatctaattcctgcgtttttcctgcggttcaatcaaacggtcattcatgtgtttttcctgcgttttgcaatcctctgttttacacttacattcctaccaaaatcctacgtttttcctattcctacgttttttcaatcctgcgattcaaagggaccctcaatatatctatttttcctatattactttcaatataaaataagaaaggccactatgtcacttccttcgtcacaaaatatatcaatttacgattaatactccttatggggcatcatctattcgtacaaatctgagacttatcaagtgcagtactaacatgacagagaacggaaaaaagaaaaagacatttgcagattattaaaccctctaataaagtgtttggtgccgattttttgtttgattaaaagtgggcagttgctggcaggcaggctggctggctggctggattgttgggccgtacgttgcgccgcgccaatggcccgtgggggtcaccaccactaccttctccctttcccttttgttttgttctctcctcagcttctttgtccctttgctcgtttgctcgcctagctagcaacaccggccggtggcggccaccggagccggccggaggcgccggccggcatgccggaccacactcgccgccgcatcgtaggcgctggatgctgccacatgtcatgctgaatctacttttgtttgcttttggttcatttcagacggtacgtgtgtgcaccacacctctgcatatgcatgttataagacgttttggtctctcgatgcatcgattagattcactaataacatctatataaatttagatagatacgtgaaacaaaatacatgtatccatatatgaatctattaaaaaaaccccgaaatattttatgatgtgaaacagaggaagtactaaatccttttacgatatttttagttgtctaggtttttcctcatggtgcggtccaaatgagagtagagaaatacgatagctttggttgaaattaatcggtgtcactttgtgtgttgattctctgatcggttagagaccaatgttggttagtactaagtactacataatacagtttatgcttgtctcgattagttctttttctgttcatcgttggctccttgttgtcccgaagtgaaatgtcaactttctaagagaaataatgagctcacaaacatcattcagacaacgaaaagaaatgcatacatgatacatgcaagaaaaagcatggaaagctaagttagatggtataattgccatgtgagtactcgctttgaacctttttgcgaaaaatcaggatccaaaatgacttttgcagttttgctctcgcctcccacaggagggggaaaaaaggtttgcattttgttgtattgaaaacaacaaattctagtacattaatcatgcatcaacaacaaccaatgaccaacctggatcttaatgtctctctcacacacacagagagaaagagagggcattaacatctaattaacttctataatgtttcagtaaaattttatttctacatgcacttagtactagtacatgtcaatcggcaagtgcatcacatggtgccattaatctcgacctatccatagtatccagggaggacaaggatgcagccaccatattagcttattttgtacttcacctgtttcacaatgtaagttattttagcattttctacatttatattgatgttaatgaatctagcatcaatataaatatgagaaatgttagaatgacttatattgtgaaacggagggagtagtataggagatcatagctgaggttaattacccgtttcagttacgacgtagtaactgcggcgtactgatcatcagcgttaattcgctgatcgatgcatccatccgaggtactacaaaaaaaattgtcccggcaagaatgccatgaatgagttctgggtccatcttgtttttttggtcttggacccgcgtgtagctctggcaatgggactacatgccaactatacggatgcaaatgcgagctgaataataatgcccttccttgtacggtttggtaaggcaatttagtacggtttggtcgcgtcgtgttcggtgtttatcacacggcaaaaataatttagtacagttatattgtttgtaaaaataatatctctattattataaaaacacggtttgttctctcctttttcctgtcaaattatggacacaagtacacacaaccacccattctcaataaaactagaaaaaaaaatcaagtgggttggttaaaaaaattcagaaaaaaacaattaattgttttttttaaaaaaattgaatcatgtcctatttttaggctttttaggcccttgcaatgtatcccaaataggactgtgcatcctcaaaaccgtacttttgccacggttttgtttggcgttacagttagctatgataatttactagaattaatttagatattttatagcttcattgtttcttcagcttatctgccgtaaccaaaatttaaatatttaaagtccattttggtttttttattacggtttatttttttcattaacttttaagtcattaacaacacatatataaaattttgactcacaaattagtttttatcattaataaatgttagtgcctacaatcatcttgaagcgaaacgatggggctataatatgttttgcaaactgtttttctttattttaatttgcaagctagtattattatctttcgaagatatgaacaaacagtagagagagatgacaatattttttaaactttttttaaaataaattctctcaaaacttgcatccagatggcaaccttttgccatggtaaaaggatgctgccatgccgttaaaaaccatgggcgtggcaccaatttgaccaaaagatctttttaaattaagtttcagaagttttatttttaaaagtttaaattaaaaggttttttttttttgaaaagtactagcaatagccctgtagcatggaggacccctctgccgctacaacataggagcgacaaattgccagttcaactgaactaaattaccctttgaactcaaaatagaaattgcttcaaaggtcttgatataccactgagaataatgggcatcttcatggttatttcaattcttttaacaaagccatgccagggactgtactatcaaacaaacaaagtgattttatagactgattatgaggggtaaattatacatcaaggtaactctttatgctgttgctgttggaatcaactcgatggggagagaccatagacactggacttagaaactctcctccctctgaaaaagtatcgaaccaatcataactgcgattccagtcaccgcaattgtgaagagcagacgcttgtgctgtgcaccatgcataggccgtggcggtcttactggtggaggaggacgcacttctctctctggaatgattcgggcactgaaatttgaagcatcttatcagtacaagatttgtagtacttcacatttggactagtaaaattgctagtaacatcttgctaatcatgaaaggtataaacaagaatcatcaggatacaaagcaccagttccattactctgatacacattatcatcttgaaagaagtgggaaacatctaattgaattattgaatgaatctgacctacattgactaaagaatgcagggatcaaggctcaaatgctaagtgtatataatttgcatataatagattgcaataatttagcttgagaaaatctaccttcactgaaaatgaacagtcaaagaagtatgcaactctcgtattaaaatgataagaattatacattacatcataccaaggttacattaacgataaaaaatcagcatgtgttaagagaaacgcctaagattttaccttgatgtctgtgcagaagcatttgcatttgcatttgcatgacactgtatttcatgcccaatccattcacgtagtctaacatacttcttgcatgtttgacaaaattctgttcggtttccgcatacatcctgcatctcaaactagtacgattaaaacatatatctacgacttaaaaaaaaagatgtattccttacatattgtgtgtattataaggtatttggttgatgccatatagtcttgtgtataattttcagaattaagggcaattatttttgcaattagctctagatcttatagtatattacttgttataaatcgaaggcacgggcatactgttagtaaaaaaaaaagagagagattgtttcaaggcaaacaacaaaacagcacctgatgttcatgaagctcaaccgcaggcaactcaaactcacaatattcacatgcaacaatcctttgtgggcactgttcacttttatgaagatcccagatctcgcgtgttacaatttccttgcaaagagtgcaatttacctgtatgtaacatgattagagtgatcatacattgccgaaaaaatacaattgctctatagatcatggaacatgtaaattctaatattcttactattgtatatggaattgtaatgtggcattagttcctggtttcagttggtacgcaaaaatatcatgcatttggcaaacataacagaacgtgtatccaatttgtacgtacaacaaaaagtttacaggctgatgatggttggatgaagcatagcaaccacaaccatggtgtatggggtttgtggtgtgcaattagttattccacaaaaaaagccacactgtcccaccatcaaccagcatgccacagtgcttccctcttgctctacccttccctttcttttcctttgtaatgagactctggatacaatccaggaaacgctgctgatgcctcatatccttggtgtggtggcttcaaatagcaaagagacaacagtggcttcagcgagcaacatgtgaagaaattatggtggagacagacatattgacacaaaaagcaacggctgtagctacagttcgtgctccctcttcccttcccctactctctgccccttggtgtatagggtcactgatttggccaattcgtgcagttcaggtgtcgttccacagcgatcctaaagtcgcaggcataatgcagttcagttcatgcaattgaacatgtggcctcatggcatgattttggtagctatggaacgaaaattgttcttgtttataactgtaagcctcacacatttagttattattattgctgcatgctttgcttgcttcaaaaaccagtaacccctctacggaaagagtttaagaatattaaagcttattgtgaagagtaaatatgtacctaaaatgatcaattaaattataggttggagatctcatcatccaactatggcagtgatatattcaatagcgcaggcaatctcatgttcatctttactactttaaaagagtgtagtggtgacggtgaatccgagtctacacattaccaaaaactactccatctatccacctcttctacctatgaagctcgaagctaccatgtagctggaaaatatgagatggaataacagaaccaccctttgatccaacatgtagagagtacccagaagttactatgaaactccaacatgtaactggagttgtagatgcacaactacaaaaaaactccagggttactctactatagaaatactctcttgattataattaaatattagaaaattacagtgcactttgaaattagttcttttatgttggttgggagattgttacctttgcagcgcacaggcatttggctagtaactaagttttcacgccaatgaccaatggtaagcaatttggtatgtaactatgtatacattaaattttgcacgttcattcatggagaattgtgccatgagatagtggaagccgtatttttcaggagttaatgacaactgcaggtcccactaacagagttacagaggagatgccagatgtgcagggatcttctctctctgtttttctttttcagaaagggaatccagaacatgggccactgtcaaaacctatttcagttttgattatgtaacagagaaataggctatattccccttttaaactaaaaaaaggtttaatcacatccctcgaattgcatcaagtaatacaactttctaagagtaccacaaaagaaagtcctaattggtgcagtcaactgtcaagtgccaacatattgctcaactgagtcctaagataaataaacagatagcactgaaatggaagcatcccaagcaaatcacaagtatggtataatgttttgaaagcccaaaactcaagatttatgatgaggttttgaacatactggagcatggctttcattgtagtgctcgtccataagctttctggccaccatttctccacagtgttcacacttttgaaggttacgtgcgcagtgtgccgaatgtaagtcaatgtttgacgatggaatttctcgctggctgaaaaagaaagaacacgtaaacaaaactaaaatttgtatctaccatccaacatggcaaatgaagaatgggcatgatgctcatgaaatcagcaccgcaccacatatcataaattgtgttgagctagccttgactaagggtagcaggtagaaaaattctgaaactaaaagctgctgatcccatagcactccaactaatatcatgcatatttttttatgagattagaaacaaacccagaaagtgtaaaagcaagcaaactgtatatcgcattaatacgaagaaatgcatcggaagtgctctggtactaaatatgccaaacgatgatccattattatccatttggtttctgcaaatagcactgggttagtttgatgaaacaatggtctgcaaacccagtgcaagcactatccccagttcccgtaagcgcattaaccaagcataaaatgagctccgttctcctcaaaccaaattggtggtttctaacggaatcagtgctaccttagttcaattgtaagggtatgcagttgcttctgctgagtgctaacaattccagataaaagtcccagcaacaataaattttgctctttatgaaaaaaaaacactcactcgtaattacagcctatgtactttgtttcgtagaccaatgaatagattattcctcaattttttttaggaacacgatactataattgtctgatgaacttcgatccattacattgcaacgatggagaagcctctattctattccgatagcgcaaacgctcatcgaatcgatcggatcctcatcctcagctcagatccactcccacacgagatcaaacaacgaatcagagcagcagcctcacctccccccctccaccgatacgcacacgccacatgacagggaaaagcaacaaacaaacaaacaaacaaacaaaccgagccgagagagggaggtggggcgcggggggggggggggatcg

SEQ ID NO: 61720 - DNA, 2329 bp, Oryza sativa
ttgaactgtatatcatgaagtaattatgatttctctacacagatctgtcggactgtcaaccatacaacactgtctaggtgaagtggatttcctgtggatggtagcgaagtgaaagcccatgggttctcgaaattcaccggttccatggcaacggtggcagtaatctaacccgctaccaccacatatacggcacctggaaaatggaagtcatgccggagaagcatgtttctcagtaccagcagcataagtatggcagacagcttttgagtatgaggctatgagctcctcaccattgtggccattcgcccttcgggagcatgacaagatcggcatgattggttctccctgtaaatcccaggttccatggtcatgagagaactggtttgtaggatcatgatactagcaagagaagagaacatggagtacaagagatacctcgaccaaaacagttgcggcaatctattttgcctgtgcctctgcagatggtgcatggaggatcaggcctttttggtctctccctcctaatatttgactgcatcatacttgcagtgaagatatcaggattggtgtataaacatgtcaaaagttaacaaatgacaattcttaatgtacaatatggtctgagatggtcttgttccatctgtctggcaagttgaaggactcctaactcagtgacaaacagagagggtatcagttggcacagaaaggaaaatagcatgccctttcttaaccccattccccttttcccctgccatgtttccctcgcaatgaatctatgataaatctcatgtactatcacaatttttttcagataatggataacccgaccgctacatcaaaaaacacataaatctgcaaggccaaccttggtatgtttggagttaagaaatcactacaggctagagcaaacacacagtaagcattgctggctgtaaaaacgttggaacaagatctaagtcatgaagtgaatggcaagtaaattttgcttataaagtgttcagtggattgcatatttgcatggtgctaagcttcaggtattcaataaaaaagaagtggaatcaattgctacaaagttctgatacacatgacgaccttaacattctgtaagatggtttgaaatatattcaggtggggaacgcccccctccggcgacttggtcagaaaaaaacaattccgtaaatgtaatgccgaaacaatttctaccaaccatggcctaatttcctcatttttggtactcaattgccgattcctcatgattcttcccatcgcgctagcttctgctgcaggcagcacaatcttacccgctaccctaacccatccccacacctcctctccatgtcccgctgccgaggaaaaacctaccggtcgattcaactacgcttcctgtctacgaagtgttcgacgaatcgcaggcacgagaacaaaaggggagaggtgcagggaaggattgagctcacctcgctgcggacgatccatgaaggtctcgatatgagcacgctaggaggggcctcgtgaaatccggggagcgagctcgaaggagcctgccccgccggcgacgccacgccgttggggccggccgccggcgtcgaagccatcagcggctacaggttgcggtaggggcggtcgggcggatactggaaaggcacggtcgcacagagagaccgacctgttttcatcagttcaggctgcgttatccgcccacgattgggcctctttgggttctccttaactgggctaggctgggctgggctctattctaacgaaacaatgaataagttcactttaggtccctcagtttgctatcgagttcagagtccctagatcacaaaactggataaaacgcatccccaacttacaaaaccgtacaaacgaggtccctcggcagtatagcatctgattttaactgacgtggcatctacgtggcttatttgactaggtcttcgtcccacgtggcatttgatgtgccgtttacgtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttggg

SEQ ID NO: 61721 - DNA, 19901 bp, Oryza sativa
  unsure (1)..(19901): unsure at all n locations
tccgaaaagcaacaacccttgatcatatcgtaactctatcagaaaagtctgagcagctaaagaacaaaacgcctgaacatataacggaatataagaagagcttgtacaagaccaagtttcttactgtgacacaatatattggatacgcattcctaagatttcaaaaaaaaaaaaagagtcataatgaccgcatacaactttaagtaagtctgataaatttcaatgtatatatctgtatttttttggtttgtgactaattgaaccgtcatagcgatcattacatatgtttattgctctacctgaagtacggaccgataccgtcttggacccccttgattataatcacatgtcgtgcagccaattcctaaaaatctgtcggcacccagggattgaattcccgaatacctggagcgtacactgtactagtcccatgatcagtgcgtagtacacgcatccacaatatatattgttaccacatccataccatgtacatggcacacaagtaaaaaaaatgtagctcttataacttagcagtgtaagagtcatgcaaagtggttaggccaactgaccactgaaatgagtttaaaacgcagcggaaaagatacataaattgttcagtatacccatctaccaaatgacacaggcaaccgactaataatcaccctagaaagaactatccaaggaaacgtcggttagcagcgcaaacacccgattcctgtaaacaagactaaaaacaacaatgagcggtgggtcaatacacgaggtactggcaagtcctacccaaaccttgggaaacctaggactattgcaagctgagatcaaaatgagcggtgggtcaatacacgggggaatttactatttgctactctctcaaaatgccagtgctcaaatgccactctcccaaattttcattcccaaatgccacccaggcccacatgtcagcctcactcggtcatggggtcccgcatcacttttgtttgaatggagagtgaggctgacatgtgggtccggatggcatttgggaatgaaaatttgggagagtggcatttgagcactggcattttgagagagtggcaaatagtaaattctccccaaagatggctatatttgtagctcattttcagtgtaaaacaatttttgtttcgcaatataaatataacatattgaaacggaatttttaaatcaaagagtaaagcataataatagtaatataagtatcatcatatcatccttgtgccccctccatggtagcaagtaatcattatattatcagcccacaccaggcaaaatcatcaccattattcaccatacccatatcgcaattcatttaacaaatcaccaacactatacttgtatcatttcaccaagtcgctcatgaccgtgagcaccggctaatcgattagttttaaactctgcagagtttgtacaactttacccacatgatgtgatagaagccaaaaggctacactctagttgtttcggtacccgtcggtaacccacactctacacattgagcacggtctagaggtcacaacgaagccgttacattgcgtaaagtctagccttgcatgagcatggagagtgtttctccacattggccatgaaccaatgccgctaggaaaggtgggccccatcctaatactaatgttgtaacacatctattccctcaacaaggcactatccattatattggatatgcttagatgcccatgccatatggagaacacgatcgttcccatagagggtcacatgggtagctcctatgagctatcgctcagactagtccctactacaacggccttccaatgcaatgctaaacagtaaacaacttagtaagccaaggttgccccataaccgacagatgtggttgcacggtaagcttagttggtgacacatagttcggtccttaattgactcgggcgaacactccccctatcagcgtagaactatcaccatatgcacaccacttgccgcccaagtttgaaatcatcattttcagtttccaattttcacataataacagaggcaaccgctctgtacaacattttaaaataacccatttgaaagagttaatatcatgtcatttataaccatagcaaattttctaagcatggctaagcaatagctatagtagtagctcgaatatacccatattggtgcttggataggaccacaacccatcctaggtccatcaacaatagggtgatcaataatcaaggtggataatgcaacaattaggagttgttctaccaaagtcccacatttttgcaaacaccgcatgcaattttaaacataataaagcatttgcgaaaatatatgattcaacatgatcgaaggaggaattgatctaatagtacttgcttgctcaagagttactcgaatatttcttgatcctgcacactcccatcaacggcaacaatcgatctgtcctctatttaaatttaaacctatattcaaatgaaaatccaataaaactccaagataaaatatcatgcacggtgcatgaacatgttcagtgtatagatgatggtttaatataaatttaggagaaagattcgcctaaatccgatgttgaatgtgcaagttatcacgtttctaagatattaaaatacggtacgtactattcgaatttaaattagtgaatttttttacaacagtgattctaagtttgagtgtgcagtattaaaaagagagttggaaactaacaaaatctggttcacctcaatcggagctaaaatgaattttctatgattttccaaattttcagcattttatagtgcataaataattaacagaaaatcttttctcagatttaataatttgtttataaaagaaactaaagggcactgcttgaagtacgttttcctatagggaagagaagacgcatttctgttctgtatatctctactctacttttatttaaaaaattcgtagtggtgatggtgaagcacatattttcccgacatgcgatccaacataatgtacatcgacacgcttcagagcggcacactactcctccgcatccctctgcaccacccacgcgcgattcctacggattgctcgcaatccgcaatcagcgggaaaaaaaaacacgctagcgccgccccacatcgccgcgccgttcccccttcgccacggttcatcctcctcgtcgcgagtcccctcggcctccgcaatacgccggggaaccacacctccttcccgtcccgcacctcctcctagatcgccgcaccgataccgcgtcctccaccgtcgctgaatcccttttgccgcgcgcccatcattggatcgagcgttgtcgtcatatccacctccaccgttgtggagtcccccgccccacatccccgtccccggcgtttctccaccccgcatcacctgccgtcgacgctcatcgtttaatctgctcctttccgccaccgccagcgcccggatccacgcctgcccagatcacgctgccgacgccactccccgatctcaactgaccaatgtcgtgcccttacccccagcgccacatcccaccctctcctccccttttggccttcgaggcttcgcttcggtcccacaccgacacgaggtaccgcggctgcagcgccactgctgttttctcagctatgatttgggatcctgtgtgcaaggagtggctgattactccatcctcaatttgttgatttagactttggaggcttggtctgctttgctttgttatttaatttgctgttccttatttttttaaatagatccattcctgttcagaggaggcatacggggcagaatattgttcattcatagagaggcataatgcacagttaatttcaatcactttccattttcactgtaagttttaagttgttccagaaaggccatgatgatattactattagaatgttagattaaaaatgcatgcccagtagatgtttttattaaatgcctctgaaacaatctggatgtgatttcagcatacgtttgtgcaaacagaccctttaatttgattgtctaacagtatcaaatgatgatttttcaagaaaatccactgaggaattttcataatttatttgcaatccacagatgaaattgtactcttcaatctttataacaactaactataatcttttgcccaggggtatttcaatccttacactaatctatttactgtcaattagagaatgtaccaaaagaatttttgtttttgttatcaaatgttgcacatttgatgataatctatatttcttaatactgtctgcaccttttgtttgcaagctccaaattctataaaaaaaaaaccttgactgcaagcttgtttacaattgtttggccagcacagtaggagcagggtctgatcgggtgctccctgtgcataactgctattggttcactgctgttccaaagtgagcaatagtaatttggaatgaaaatataccaatataagaggtttccagcctcgatattcagatgttcataatatatctgaccaaagtagagacaagtttcaggttcatatatctgatcaaagtagtgcccttgccaaattcagttccagagcaacatgcaactcccactaggtgacccaaaaatttcattgtggttccactacaaccaagttaaacacgtcaaagtgaatttcttcttcatgttcggacagaagtgcatagctagatcaagataagctagagagcaacccaatagttagatgacttgaacatagccttataaatagcatgcaagcctataggtatatataatttgattggttttcctgaaaatactaaccaaaatactttttttttgtttttatcaatttggttaattattttacatgataatatttccacgttcggtcatcaacttatggttgttgcacccctgacagaatggctgggcagacaccggtggctcttgggtgaaatgagagcaagtcaaccgatcattttcatgaagagatgaattagacggaacaacagagcctcatgggtatgcaacaaataactagttttttttcctaaacaatacatgatttttcattatgacttaaaacctactctagatgggtcaacaatgggattgcatatttctttacttggtctcagaatgaactgaaatgtttctcttttttcatttaactatattagaaagcacatattgtttgacaatggtattagttgcatattgtattttcaaaatttgaagaactaaagaggttgacatactaaaatgctttgcatgaacattactatgacttttacaccttaagctcaaagttgtcttatttgtccagggactcaaacttttgagatatgtatattggcatgaagagaaaaggatacaaatatatgaagcctctgacttgttgggttgttgtatgtgttagttcctggcaatgcagagctagcactgtaaggaaatgactgtgttgaggcaagtgtcaagcactaacttcttccacaacaaccctgtcttccatggtaaccattccgttactccctccttcccaaattgatcatcacactatgaaattcaagatttctcaaattgatcatcatataaccgcatggacacggatttcatcagaataccattaatacaacatggaagaatgtgtgcatgctaaggtgtaattggcatggtgttaatcgatgcatgtattgtgggagaatgtgtgcatggtatcttgattgatgtgatttaaattatcattggtcttggtgcataaacatatatgatgatcaatttgggaaggagggagtatttcttttgctatgtaatgagaaccattgtgtagaattttgtaaacaactttaaccattgcttctctgcatgcaaatgcagatccattcctttccaaaaggattagttaccatttcttttaatttttacacatatgattagcaattgtctataagcattaggaatgagaatcagatgaaactatagacaaactttccaaagtagtatcaatatgtggccaataatgtgctgttccattcattaattttgttatatgtggtactagcatgtgaatactataaagatgtgaaaattataaatatgtgacgtaattattattagttctatattaagattttttgttacagccgatttacactcaatgattatttaacatcatttcacacggttgtattcattttaaaactgtggggtccatctctcagtgaggggcactcctctaaactttcagccaagcactaaagttttcataaattacatataagtcctaggcctaactgtcagtgtctggcgctttgcagaaagaaccccttttaccctaataacaggactaggtccttcttcttcaacctacaggcagctcgataggcagagaggcacaacggctcgggaatggctcgccggcgatgagcggtggaggggatggctcggcctaaggccggggaaggctggagtcggcgagcgccatggccggtggtgccagcggttctagatgacgggcgggcggtgtgccacggtctatggagattcgattaagggataggggatggcctaaggaaggactactaggagacttaccctgtgcagtgctcggttagagttgaggcggtctgaggcggcgtgacgacgagctcccatggcggcagaggtcggtgacggtggtgacatgacggcgctctagagagggggccctataattagttgatgaaatgggttgaagggtctcctagggtcattctggcgcaaggagatggaagggaaatcaccgtggtggagatttgattggcgtgggttggggggcggtgctctgttcggcgcagaccgtggtggtggtgcggccgttcccggctacccagaggggtttgagcttcggctatgcatggtggagaacgagtgtggtgtggggagttagctggcgcgcttgctcaatttataggcgagggaggagccagaggcggatgcggaggctgttgtgacgcgttcggcgccatccatcctaaaataacaaaccaaactctctcaaacaggatccacctcgtgagttcttaaatgcatgagttcttacaaataaataaatataataaaacctcacccctgcggccctacccggctaccctgcgagtgcgagtgcaaggcgagtccgagacggagtccgtctccagcttggtgctggagtcctattcggaattgtaactcgtgtactgttgtacccgttgcaacgcacgggtattttttctagtaaccttaaatattcctgcatgtgttgtagccgccaccgtctgctagcttctggactgtcccatccgccatgttcaccgcgaagaccgccattggcctccccaacggtgtacaccaccgtaccgctcttctcaccgaaccaccggagctcgatcggggtcgtcctcgccggcctgaggtctggtactcggacgtacacagtgcacgtacgtcgtgtctgtactctccatgcatcagtgtcgtctaattgtgtcttcaacgagcagaatacaagctgggacactcggcgagaagtccccacgttgatgtagcgcaactccgtcctgtccgccaacacccccaagtatgcggagaaccggccagtatcccccataccaatgttcaaaatagccggctatagccaccgctatagcgggctatagcgtttgggcagggttggagctaggatagttagccttttgcgctaaacgattttttccgctcatagcggcaattaaccggctaaatccgctaaactgcagatcatttagcgccactcactttgtagtttagctcctgggccaaaatcagagcaggccttgggccttcgccagtggcccaaaggggaggtagaagatcaagccagcaatctgtgttgtctagactgtaatgaaggcatgaaagaacacttaatttgtttcagtccgtgattttttcttgattccatgttcatatgcataattgttgactgatttctgtctggcaattacaaaaccgctaaatagggttagctgggctatagcccgctatagcctttcttagcctccctagatactagccgctaaaagccttagccggctattttgaacattgccccatacgtgtaaggcaccgaacacacgtccatggctgagtccgatagcgcgcgccgacgaacgcctcccagtggaagggccagtaggccacgccgccgccaaggcatggcctagccgggcgcagtatggtttccttcgttccgggccccagctactgtcgtcagacgagtagcaccgcatagccgtgaagccggggcggttgtagatgatgagcaggcggaagaaggagcgcgatggcggcgtgtcgaggtcgtcaccggtgagtattgcgcacacgcgtagtactgtagtagcctggacagtcgccgccggtcatggggttggagacgacgagcgtgaggccgttgctggcgcgggcgcgcgtcgcgccggagctccaatgacgcggccgttgcggccttgcgggacgccactggctgggcgtagtcgagcagcaaggcctcgccgtccgggagctagaacgggcctaggaaccgcgaggcggatgccgccggaaagaagcgcggctgccgcgagctcgaagccgcgagccacttccgcccccacgcgcagcggccgacgtcgttctcctggtggaagcagccaagggcgaggcttgggaggaaccgagtggggaaccgagctggccgcggcagtgcgcgggagattgtagcggcgtacgtgcgtggccacgaacctgccccagctagcggggacacgtcgacgcgaagcgcgcgacgtcggtggcgtcggagaacacgcggtctggcagagtggtcagaagcgcgccgtcgtttcggcctctctggtggcaacgccggcgcgacagccacccgccggtgtacggcgtggcgtcgcgacgtgcgcgggctcgtcgcagcggcggcatgactagctagagcctggagggtttccccaattgtagttgtgcctgctaaaaggatgcgcttcgatcgttaatggatgacgtacgtgcatgttagggtatatatataggccggcatgtcgagtccgaaattgtgacaatttgtgagtgtgtatccataccagcacaacacgtcgactatcacgggtcacggcaccgaatgagcccgacgcagcgaatccggtcttcagctgcgacgctgcggaggattcttttctcttttcattattatcggtcgacgatctcagccgttggatgttgatcaaacgacttccacatcgtcttcttcctctcgcctcttttttctctctctctattttcgttctcctgctagggcaagctcccccatctctcgcctgacaagtggcaactcctgtcctcgattggcaggacatcgctcaatccatgcaccagcaccaccacaccggctatcttacacagcaccgcgccgagcggcgtccccatcaccgtcttatgcccacacctcctccccatcggccgatgtcaactctcctttaagcccatcggatcaaatcctcgccggcagcacccttcccctaaccccaacaatcaaaaacttagtgtcagcaacccggcctgcttaggaagcgcgtgttgtttgttccatattgtatttgcactcgtattcaaatccagtcgcacagaggcgcgtcaagcgtgcgcacgcgcgataggagggaaagcaactaaggaagcggagtccttggcagtcgcatcgtgcagatgatgctgctacggacgaaaatcaaagggtgacggaagtaaaaatactaatcttttaattcttactatcaaaatgcccgtgcttcgcacggtgtattaaaactaaaaatatttgttcttaaccgaagttattttcgcactgcttctgtacttttgctcgctagaaaaagtatcaaatgatagagagaaatatagtagctcataataaattattattctgaagaaagggagataaaaaaagacaaagccggtttgatttccacctttacacgacgcgagtcaacatggactctgaagatataggtagatctatggggtggctcagtagcacgatcgactagcaaatcagcaagcacccttagaccaattgacggccgaacgatgaccgtagcatggtaggtagcagccgcgtctggctgcaacggacgaagactttggtgaatgaggcttgaagtttgatgttataagaactcgaccgggatcataaccatatcagtgtgtactacggccacgagccacacatacggagctgatcagcacaacaataattaatttacggtgctcggacatgaccacaaagctggagatgaggtgtgtgcaatgccgtgatgatgcgtttggagaggtgactccaagatggtggtcggcgtggtgtgtgtgcgcgctgagagtgtaaggagatcattgagttgatcaacgaaatgggaacatggttgtgtgaggcatgtgccgtggctgaattaaagtggtgcacaatattactgccagaagccgatgcccatgggtatgacgcgccaacctaacaagtgctctggttcctacaacaagacgttgatcatgggcaatatatattgataaaatagcatgccacgagttgctacttgatctaatctcctatacaagttttagttaatttgatttgtacggtcgatttagttaatttggatgtagaaggattcaatttggactttggtggaggggaggggctgctgatgggctttggcctagagcttggacgtgagacatattataaacttttgtagagattgattgatctactgggcttggccaaatgaaggaagagggaggctatgtggactttggaaattatttttcgagctgagcggtagaatggtgggtcccacggagatggggttagagcagtgggtcccctggtaggtcccagtcccaccgtttttctctctttccttttcctcttcttatcttctctctcacactttcccttccttctctcgcttttttcttctctctcggctgcttgcaggcaggagagcgccggcagcgatccaaatggcgtaggcaggagggcgccggagggcagggcaccggggtgcgccagggtagagggagggagctccggcacggttggggatgcgacgagagcggctgtgctcggcgggcgcggcaacgataggaccgcggtggctttgggccggcggcgcagcttggttcggcttcggcgatggcgtggtgcgagctcgacgcacgcgtggcgtccaggagccagaaggaggatgggggcggcgtcgggcggctcggcggcgctcgggaaggaagggcgtgacgttggcgggcagatagaagacctccttccccacgccacttcttcgatctagaagtggttagcatcgatctgcaactggtgggcttggtgggcttgcttgctgcacatgattcgtggatgcaccgctattccaattttatttgtgcgattgaattccaattgggattttttcgggggttgattgaattccgattgggatgggatttgggggtgttgtgacggacaaattttattgggtggattggagttcctcatggatccctatgctgattttattagggtggattagaatttgattcctggtttctcccatgaatccgtctactgattttgtttgggtgaattagagtccgattcttcgaaatttctgaatcggacaccggcattgcaggcgcggtgatgaacgacgcggtgatgaatgacggacgaagaagtgacggacgaaaaatcacgtgggtgaaaaagatgtgacgaaaaatcacgcgggtgaaaagatgcgacgaccggaaaaatatattactagcaaaaagtgtccgtgggttgcaacggaaagtgtacagactagaaaattaagaaaaatttaagaaaaatttacattatgtaattaattaaaatacaaatttgctaaaatatttggtatttttaagtaggtaagtgtataattaaatcaatttacaagtaaagccagtgtgagaaataaaatgacattgttaaatttaattttactaaattctccacgattagttacgctctttgaaattttattggaattatcaaagcttaattgctaatgtttaataatacaaacatcatttaacaattatttaattggaaaaagaattaaaatccttcattctaggtttgggccgaatatagaaaagtttatattttctcccttttgtctattcaatgtgcctggcctgtttcctttttccgttgaagtccattttgtgtcctccattcggtggcccaatatgccggcggcatgacccgggagcagctggagccgtccgatcgaatggacggtctagattaatcctaacctaaataaatacacctaaaccctaaccctaaccctaggattcatttttcccctttcccccgcccccaatctcctcgagcggaggcggcggcggcgcccaccaccctccttcccccgagcgactgcggcgacacggagcaacgaccggcgagcggcgcccccctccccctcccccgagcggcgataggcggctatataccaaagccgcaactctagagttcatccgtaagcgcacagatataccattgtagcatttcacccgagagtattccaaggatatcgtatttattttatcccgtgggaagatcatgtagagagaacttgactaataatttatatattacttgtgataatcacattctaagcaggggttaagataatccaagggtagaatgacacacaagcatcaactactcattatcataatatattatctaagctaagtggatggaaaagagaaatataatctattcctatacttctaatatacatagtatacatacattctagttaaccgatatactagctaagaccctctatccgatgccctcctggtacttcgggaagtcacccctgactgccgagttccttacgacagcccgtcatgaccatacaaacgggactaaatacgaagaaataccctccccagggaattaacttaggattatataccggcacggaggaatacccgtactgagctgtcaccatcagcggcccacctctcatccgcaatatataaccccaaataataatatcccgtaagctagacaccacgtctaaactaccagatactactctaatatcatcgtcatgacatagagtaattgcatatgcaaacattatacccgcaccaatgcatctcccagataagctagctgtatattcagtataacaagaacataatgtaaagtaggtacttatatacttggaaagtatttcaataccataaatgtatttagaagagtattctaataaaagtacaaagcttacaaaagagaagagaaaagctactagagccatacccgaactattccgaaggctgtaggatcgaatcacaagaactaagccaaccagatgggggttgaatggttggtatacccaaaaaccgaaaacttttagcggaaataaaagttaccctcgaaatcgatggatcgcggtctgaccgaagtagttgcgccggtctgaccgcctgatgaacgtcagtctgaccgatgtagatcgatcggtcgaaccgccgagaaatcctgccgccgattcctgtcgccgccggtctgaccgccgtgtgcccgccagtcggaccaccgagatgcctccggtctgaccgccggtgcgccgccggttagaccgccgaaacccggtgaaacacaaatcgaagaactcttaaagtggatgacgactttattgattctctctgtgtttacaaagtgcaccaacaacactccttacaaaaatttcgactaaactcgaaaccctaactcaaaacttaactatattgctctcaaaagcgatgccgggaatcctcacgctccctctctatttatacgtgaggtaggtagcctaaagccacgaaccaaactcatactaggagtcctaaacaccttaggaaaccctctagtacaagaaagaaactttacataaccaaacgtaccaaatttggactccttccaaattcgactccgcatcccacacgcacacaataactctatcgtatgccatatggaaactccatcaaccacgtgcatcaactctagcctaagtatcccgcatgatctctgaccaccacggacgtcgtcttatccccaagccgactcccggtccatcaccgcaaatactctcccgagacatcgagtcacctacacatggaacaaacaaagaaaccatattccaagaccaagctatctccaacttgactcattagcagcaaacaatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttcgtgaataaattccaaatatcaaaaccaataatctccaatgcccaattgttcatcatagaataataatcaaaaacacctttgattttacaaaggcttccggactcctgattcctactctattcctattccaccagctagatactagtaaactgaacttgagagaaatgagagagatattgcttgaggtgtgtgagtgaagtgagaaggcgaagtctttttataggcaggtatgacggttgtaaccgctgcaaaatgtctgaagtgccccgcaaccgtcatcaagagaagatctggagcgtcactgccaaccccacatccaaggccagcccaacctagcccaaaatcggcaggtggcctcctccgttgcttcacttcgtagacttgtgaattttggcccaattcatcgtgtcaattctgagttctttgcccattcatgcataagtttaattctcgacaccgtccgattgatttatcgtctatgttgatgtcgattctcctccactttagtgtcattctctgcaaaaggttggtatacataatactagtgtaatattattattctaacatatttatgcattgcaagtatcactagttctcctctattttggtaatattgacggtcaaaactgattgataacaaccatcagcaacatatttcaccaatactagtggatacgattagtaataatccctaccactaagttggataccatattttattccattatatgcaagcattgacggtcagatatcatgatttaagaaccgtcaacacccgcgtcaaacacttggcgagcgtgcagacggactttgtcttcatcgagaagaagacgcattacatttgggccctcctataagactcacaacttacatgtcatcccttttaacataaagactccacctagtagagagttatactcttttttattagcattagtgtaatttcttgccttgccctatccctctcgcccaggcgcccaccctttgacctcctataagactcacatcttatatgtcatcccttttaacagaaagaccccaaatttcatgccttgccctatccctcccgcccaggcgcccacccctctctttctattgctctcgtgttgctctttgtcctctccaatcatggatgatctcaaccattactagactatttcttagcagaggattttgccatgccttgcataccgcaagctttttttaggtttgtgtatattgctgcccaaaccacgccgttgcccatcaccctgacacaaatacggttttggtcgaaggattgatcaaactatcctctattttttcctctctatgcgccatcttttggattaacattgctccatgcgctatctttattggatttatattttatttatttatttatttttgcttgttcacatctagtcatgatggagagttttcccgcccttacgcaccaacgggatgagtatgactgtaaccacgttcagagtaccaaaaatgatgcaagatgttccggagggatatgccgaatagatcattgtccgtgtttgagccttatttgatggacttagatggttcttgtgtgcgatttattgattgaactctgagtcctcatttttagatggacttagacgattttttttgttatgattcttgtgtggaatttcctcatacgaggaaaacttgtgtcgttgcagcactgggttttgtatagtgcgttaccaagatttactgtctcacatggttttatttgtatttggtttggatcagtggcaggtttggattagtggcatagggaggggagaagggagaggcctggtctcccataacaaaataaaattgtaattatcaaatatatctacttaatcatcacatgattaaattagcagtaagtgttttaatcccctatagtgacagaaaatccaacacccctctagtgacaggaaatccttctaatattggaagataattggctgtgttttaatccctctagtgatatagtgtatatggatgagcatggaacactggaataatcacgttttatggtcgaatcatgagtttgattactaatgcgataactgcgttaatatacctacttcctcgcaaagtttggatcaaagtgcctaattccctacttaatttcttccatgatttggttgatgtctgctgaattccgttgtgtgacatgagagcgtgactaaattatgtttgctgtttttttaggtatcggcagtacaacacggtcgaaggtggcaattgtcaacgtaaattttaatcaacttttgtgtggagtttttcgagccagcactccttgaaatatatgtcccaccacccagttgaataggaaattaacttttagagataactaattttaaactatataatataacataatatatacttatacatagtgaaagtcataaatcagttgaacaatatttatagcgcactatgatcatcagatttacaacaaatgttacttaccaattatatatatattagttaagagcattctagatgatatttaagaaaaaatatctctcaaattctaaaatctaattaatcaacttggaagcatacagtgtaattaatatgtcacggtaattactactaactcctgtaaaaattacaaataatataatacaaagcatgggcacacaaaccaactggcagtgtttattggctaaagctatcagtatcatcatcaataataaagaaaaatgagataacaaggagatggaagagtggaagaataccatgagaaaatttcatttttatcctacattgtgctaaggaacaaattcgcgttaaaaaatatgaaaatttaataatattagtaaatcattgatgagtatattatacaatgtctttctgaaatatatgacatccagccagggagtgtgagcttgtcatgtgagttgggcacctctttttgctgggagcctctctttattgcgattcaaagtgcttaggttgaggtagttctctatctactgcccctgtaacatactatatttttcagggtaatttttttacgaaaatctttaaagtcgttgttctttgttctttcgaattgaagcctcccaatccttacattccttttgtttccttttaattttccaactccctcgtaacttcgtttagttttccctccaaaccaaatccaagatatcacaaaaaaaaattcccaaaaccatccgaagagctcgtgtttatttttaagttctcgtgtttatttttaagttagcccgaagtcatcatgcaaatattctaagatccccaatcccaaagattcctattcggaaatattttacaagaattcgattaaaaaatctcttcaaaaatttaaatagatcactatgattctcctcaggccgaattctttgcaatctagcccatattcccaatttactttccattgctcctctgtattgggctgttctaacccatctcccgcacaaccacccagctagcagcccattgccgttgctggccgagcctccaactgacacgctgctcgtttcgctcgctccagccaccgctcgcgttacgcgcgtttcgcctcgcacctccctgcgccttgcttgcgcccgctgcccgcatgcgcttggcccgcgctagccgcgtgccgcctcgcacctgcctgctctgctccgcgtgccgccacgcgcacgacacacgcgcttgaagtcgctcgaaggaactcgatcagatggtgccgacgttgtcgcacaaatcttaaaaccgagcaagcaccactgctaccgtcaatctcccgctgcccaactatntaagcaggcaaggtagctgtgctcatccttttccaaatcactttctgtcttcaatttcttcaagccacgctgccgtggtcatccgcggatccgccgccgcaggccaccgatcgtcgtctgctcgcaccaccagcctctttgttgcttcctgcttctgcaaaattgaccatgcatccatccaattataggccatgtgaattaaatcagtgggatcatttggaagttttttctcaaagcaagctttatttctacatttccatttagaccatatcacaacagcaatcccaaccacaatgagattttttatgaatttgtcagcattcttaatctaggaaccaaacagttcatgcctgttcaaaacaggtttcaaatttagagcacaagaaataatcttccaaatcaatctagccgtgggacaagcaaagaaaaagtgttgaattgtttcttccttatcacaaaactgacatttattatcacctttcctccagcccctcttgaaaagattgtcattttgtcaagattttattattggtaaagagccaaagaaacactttgattttcaaaggtacttttgaacttccagatttttttatgagggtaattcacttgcttaattttaagtgcattacagaaagatttcacagtgaatttcccatctttggacaaggtccatcagagtttgtctcaacaattttctttaaaattcaactcttcccagttgtgtataatttttctccaatatctcagtttggctccagacagatcccttttgagttttatagagccaacaccttttttgttcaagtcagcaatggtgatctttttttttttttgtcaagggtatgttatgaatctcagggaattgcaaggccaaaggtctaccacctatccagctatcttcccaaaaaaaaaagaagaatattttctctatttcccacttttttattcacagactgaagaaaacatctttcacctctataatccattgccaaaaatgtgaattaccaggtttgagtttcagaccagatagtggtttgtttttgtaatatttctcaataatgatctcttgccaccaaccctcttcattctctaatttccagatccactttcccagcaaagctttgttcattgcttacaaatcaatcaccccaagacctccttagtctctgggtgaacaaactaggggccaattaactagatggtactttctaataccttgatcttcttgccatagaaatctttttctgaagtaatccattctatctttcaccccttttggcagttcataaaaagagagcatgtacataggaacactacttaaacttgaattaagcagcaccagccttcctccaatagattgcagcttacctggccagcaacccaatttatgctccattttgttctcagccaccttccagtccttgtttagtattcttttttggtcaatgggaatatccaaatatttcagaggtaaatcaaccacattgcaggtgaaaatattgctatatacatgttgtttttccttagcttcccaaagcaaaaaaaaaaaaaaacctcactttatcttaagtccagcaagttgctcaaacagacacaagatgtacttcaaattttttgcatgctccag

SEQ ID NO: 61722 - DNA, 1299 bp, Oryza sativa
  unsure (1)..(1299): unsure at all n locations
aggtgctttgatgattcttaatcttgcatgtcctgcggccgactctagaggtattcactatagttggaggttgtgttgctggaatgctgatggcaacaacgcccgtgcaggctccccattcatctatttgctgctatcactttgatttcagctggtttgtgccctaaactagcattttctttggccttctgttacattctgttttccaggttgtagtggggagtttcattgctgaaggtcaaaaaggcaaggaagaacatctgaaacgtgagccaacatctgccccgactccgaaccacgcatctggctttggcgcagccacagctgccagtcctccgtctgatggatcatcaagcgaccactccgatgacccacggagtcccatgggacctaatggcagcacattcaataattcaggtcatcccatgcattcttcgtatgctcctgatagctggtcgctatctgggaatcaaggccgttacgatcccgacctgaagatgatgaccgactagataatcctgtgtttttaagctctgttagctgttgacccagtagagtgtagggatcagggattcagagtttactgcaccgacaccaccggcagaggtggccaataatcacgcgcgctagtagtaatcagtatcacaatgcctgaacaaaagagatcaggaacaaataagtagccccagcgcatggctttgcctgtcagggagctaatttttatttttcttaatcgggggcttaaattagcatgctttgtcagctggtaacctactggtacggtttttttatgaatgttcggcacctttttcttttatcgctagcattccgcgtgtacccattcttaattaagattgaatgacatgttattggatattgccaggttatttttggtggggttcacccgggaaaaaccacttcacttcctgaagccttttgggggtaaggatcccaaaggacaagaattttgaacgcctttataccagggtcccaccaactgggtagaattaattttttggaaaatggcnnnnnnnnnnnnnnnnnnnnnnnncgtgaattaacctttaggggcaagtcggaaaataaatttttgtgggtttgggacccctttgaataaattgtatttgggttaaaaacaaagggtttggcgttaaaatgggctacagagttacaaaggtggggaaccagggttattttttttttgggcaagagcactataacccctttgttttttgtggagggtcgcncccggaagcctttgaaaaagaacaccgggtgtttgtttttgctccgctgtct

SEQ ID NO: 61723 - DNA, 43707 bp, Oryza sativa
  unsure (1)..(43707): unsure at all n locations
ccacctcctcctcctcctcccccgcacccgcacntcggcctcctccgccaccaccaccaccaccaccgcaatgccgcacgtggtgcccccatccagagcaccccctccccccgcaaactcggatctcttcaaagcttttccgcctcctcttctctctcctcccacccgggagttttgctccccgcgcggacgccgagctcgcgcgcccgctcgctcgcttcaaccatggcctcccctgctccccccgccacgtgccgcctccagggcgtcccacgtcaccccctcctagctcactttctcctttagccgcagccagccgcagccagcacatgcacacagatgcaccaaatggatccatatgattttacaatgttaaaaaaatcctccctccgttgacgccgttggtttttttaaacatgtttgaccattcgccttactaaaaaaaatttaagtaattattaattctttttctatcatttgattcattgttaaatatacttttatgtatacatatagttttacatatttcacaaaagtttttgaataaaatcaatggtcaaatatgttttaaaaagtcaacggcgttaaacatttagggaaggagagagtatataagaaactatcgccgcaaaacttgagataagagatgtgtctatacctatattaattgcactgcgtatttttccttttgttgcaattttgtaccgttacccctttttaactaaagtggtactccctccgtcccataatacaagggattttgagtttttatttgcactgtttgatcactcgtcttattaaaaaaattagaattattatttattttttttgacttactttattatccaaagtactttaagcacaacttttcattttttatatttgcataaattttttgaataagacgagtagtcaaacaatacaaacaaaaactcaaaatcccttatattatgggacggagaaaatagcatcgtgaggtaatcttcttgattttggaaacatcttaaattttttaagtaacctctgggttgtcgttgtaatcgtgataccaccatcggataacggtaaccccgtcaaaaatagtaaggaaaatcttgctttctactaaggtcctgtttagatcccacgcaaaaattttacactctgtcacatcgaacgtttgaacacctgcatgaagtattaaatattggctaaaaaataactaattatacagattgcgactaatttgcgagacgaatcttttgagcctaattgctccatgatttaacaatgtggtgctacagtcaacatttgctaatgacaaattaattaggcttaataaatttgtctcgcggtttattgacaaattttgtaattagtttttttattagtgcccgaacaccccatgcaacaccctatataatatccgatgtgacacgataaaactttatacccttggatctaaacacaccctaagaataattaagtaccgccaatgtcaaatataaaatggttagagggagtattacaaaaactttaatgttcatctacaggtgtagtgcaacaaatgaaacttaaatagcaaaatttactacatgacacttaaagtttgtaatttttagtttggacactgcaaagatgtgacacactcaaggtcatataaaatagatgatagtaatttgctaaaagacaacgtgaccattattttatcattttcaagccaaatggaggaaaaaaaaacacttagaaaagacgatttatctctcaggccaacaacatgtaacccagctaggtatgtttcacagcagacttcaatttctagatttttggagatggggtcagtggagggaatggggcttgggtctggtttgaactagacccaaccaagttacatgctgctctccggaggggcaaacttgtcttttctatgcattttctgtcttgatttaacccgaaaatgataaaataatagatatggtgtccttccgtaaattatcagttttgggttgtactcgagccatatcatgtttctgcggagtgcaggagcaaagaccagaaacttttggtattctatagaaaaatttgtcaatttatattacattatctataatgtagtgtagaaaaaaaattgagccaccgaaacaatgatcaggtcaaatcatggaacatttcaaacttttaactgtcaaactgtattatttttcccagcaatactcagattttctgtcgttttacctaacaaaatgaatacgcagacagatatgagcagaaaaaaaaaagagaacaaaaccaaggtaatataagtgtattgcacatacacctccaacaaattctttttggctgggccggcaaaagatgccggcttagtttattcagatcttacatatgccttccatgtaatagcagggttgtaattacttttctatttaatatattggatactgttttggaaagaaaattaaaaaaagaaaaacgccagtccagtatattcaaaaaggagagtacaacaacaacgtactacctccgttacaaaatataagacattttggctttgcgatggaagtagtatagttgttccccaccaacaaattctcgcatatagaattttgctacaaacagttcatactctttaaaattgctgattaaacctgctttgagctcacttccccctgctcagaggtcacaacttcacattattatggcctttgaatgatctaacaacctgcagttgaaaccttggacatagctgtttgatctgtctctttcatcgccacagtcaggtacacactgtgcaacttgcttctgtgttttttttggcttgaagcagattgccatcatcacaaacagacctgcaagcagaccaaatgttgatgcccaagctgccaccagtggggtcatctcacaattgcataagctgcctgggattaggcaggtagcacaggcattgtcactgtcaatatatcatcaccagattatattccatctggaaatcaaactgagacagaatgatcatgccccttcaattgcatctcacattctgaacacaccatcagcaaacagttcatcacatcttgccttttgtagcatcaagagagaaattaagagggacgtgatcaatttgttacagaggcactggtagaagaaaggggatgatgactcacaatttggatttaatgtcgcgcaaaatcaagaacagaaaaaaattccttccaatatgtcaaaggttttcagtacatgaaagaatgatctcctcaggcaaaggagcatttacattttacaacctctgactggcttgtgcacccgtggtttacatgtttctatgtgtaattttgaatctgtatgttacatctactcttgtaaatattagtgaactccgtgtatatgtacgtagctactcatatttacaggaaagtcaatcccgattcctggaaggcgaggaaccagcagcctgaatggtgctccagcaactactgataccttctacaaaaacagccgaattccagatgaccagtttggtgcaggcaatcgaatatgcgagcttgtgtagcgccgtgctgtcctgcgctgtgcttgatctttggcctttgcaaagtcctcactttggagctacattttgtcagataaactttcagctctctgctcgatcttcttggaacgcgttgtatatgaaatctctgaagcgcctggaatactgtcttgggtctactgctgagatggatgtcgagtcgtattgaaaagacttgtaagcatgctcgatctttttgccgatatcatagtcttgaagtatgtctattatcccaaaatataatatcacgtcgcagtactgcccggttggctgtccaacgacatcagtgtcattctttctgattgtcagttcagcccttgacagcatgtttgccccaagtttaatcttcgaccacctgaagtcagatttgttgaattactttataatgtagcattttcaaatatacatagggcataaaaaattccatttggacaattgcaatgaacagttgcaccatctgtttgatacttggaggatttacatttcttggcatttacataacaaatacaatttaccaagaaattacagaaagtgagataatatacctaaaatactttctactccggagaatgaatacccccaacagaatactacagtgaacttgtatatttaaaatggataagcagaaggttacctaaagccttttcataacaaaattactggtaaaaatcattagttaccaaactaagacggctatagcatgaatcaaactatcaatgagtagggttctccactacatacatactaactaaatgattttgaacgaggaaaactaactaaaactaggattgcagtatagctgagagaggaataatttagtactccatatctcggttacctgtttgggtcagaaagaaagtgatccctgtcccatcttgaaaggcgtggtgatgcaggtatgtcaccatcaatatcaacggcacctttttaaccaaggtaaataagtcagccttaagattgtgcaaactattgtcagaagcacactttcttacctctaaaatgtacacccactaaaagactgtaatccatgatcttctcatgctcaagaaattcacagtccttgtctacttgcctgcttcaaaatatttaaaaattcattagcacaagggatagatagcatggttatacagaaattaggcactaaggtgtatgggtatcacttagcacctttggaactcttggaaccattgtttttgcaaccgaaagatgaaattaagatcaagatctttcagagttgtatactcatcaatttctgccagtggcttgttagttgtacggccaagagatgatcctttcagatcaaatcgcctatgaatagtgtgatcagagcagaaaagatttcccattatgacgaaacgaacctaggtagtagtacagcagcaaacaatcaggcatattatgcttgaaaaatagcatattcatgagggcggagtggataatcatatattgttctaaccttcttctgatttgctccagccaactttacacaatgtaggccaaaaaactttgtcaccagggtatcctcgaatgcccgaacatgattgtagtaagctggaagcatcttcagaagcatctgtgtggcaaagtttgtccatgtattcagaatagaacttctaaatatagaagcttaaatggtgctatttgaacaaagacagcaaaggacaacctttacttcagatttcttcattgtctttatcatgtagcggtcgtcatttgtcaagtaaaagaagcttccacttttaccaggggacgagagttcacggagagcatcatctccacaaagggatagcatatagtcagctggatcaaccttaaacagcttgcgcaatgtcctgtgattttgtaaagaacaaatgtgcatgttgacatggatgaagccataaaacagtcactaatctataatgtatctatcatgggagtgataaccaaccggaacacctttgggcagtaatccttccatctgaaatcagaagaattgtgtggaggggtgtattttgagccttctggagggaatttagtccatactttttcttttgcgtcaaatgctgatgacttcaggtctaatataacctggccttgccttcctactgcatgcctatgtacaataagcatactcagtgataataagttactttctgagcttacaaagaaatatggcaatcttactgtcgaataattacatcttctcaaaagatatggaagtgctacaagttctgaaaaaacaataacaatcttggtttctaaagtaaaatatgttgtaaacacaaagattggtaatggagaaaattcaatgataatccttacatgattaatcgttgataatgaactataagaatttcattttataactttgtaagagtactgtctatggagtctatgatatatgatttcattttcaggatttcaaactactgatagaaggactagtgaggcagtgttaagatgataagaatgccataagagtccacaaaaatgcctcagccaagtcatcgaattgtgctcaaatcattactactttacatgcaaggcctcggattctttcttgatgtccacactaccaacgcatatgaattttgtcgctgaaaatgtttgtccattctagataaatgcttcaatgcacacccctaatatttcgcccaaaattcccatttcgttgtttaccgacgagatgacaacatgattgttcatgcgagatttcctaatttcacatttttaaattcctcgcatggaaacaaattgaagtattgcgagtgcaatcaaagagacagaaaatcgcgggaaagaaacacacgcacctgatcccgagctgcaggttgagcatgagctcgtagttcttgtggcccttggcgatggtcaccccctgccgcttcatcacccgcggcggcgccgcccccttgtcgacgtgcggcggcggcggcggcgccgccagcgaaggcggcggcggtcccctcccctccctgacgctgctccggcgcctccagtcgtcggcaatgtcgggcttgacctcgccgtcggagccccagaggtgcggcacgcccaccacggagccgatgctccggcccgacgacgagctcccgcggccgctgatcgaccgcgccagccacctcagcgaacgcagcgacggcagcgccgactgcccttccgtgctggagcggacgcactcggggagctcccgcgcgaacacctccctggggtcgcgggactcgcccgccgccgccggggacgggtagtagacgcccttctggtggacggcgccgccgggggcctcgcggccccagaagccgacgtagaggctgccgtcggaccagcggaaggtgccctggccgcgggggcggccgccctcccacccgccgtcgtagcggttgccgttggcccagacgagggcgccgcggccgtggatgaggcccgcgcgccagccgccggcgtactcggtgccgtcgcgccacgcgtagcggccgcagccctccgggaggcccgcgcgccactcgccgtcgtagcagtcgccgttggcgtagcgcttctcgccggcgccgtgctcgaggttcttggcccaggcgccgcggtaggtgtcccccgcggcgcccacgtaggcgccggcgccgtgcatgaagccgtcgaggaactccccctcgtaggtggcgcccgacggccacgagaacctcccccgcccggtcgccttcccccgccgccactccccctcgtacatgcacccgtccgcccacaggtacttcccggcgccgtgcggcgagccgccgcgccactgccccgtgtacaggtccccattggggagcacccgctccgcgcgctgctgctcattcccctgcgcctgcgcctgcgcctcgccttcgtcggcaccgctgcaggacgacgccgtgtcggcgtcctcgccggggggcatcggtgacacgcgtcctcctcctcctcctcctctccctcgcccacgccgttcgtgctcgcgcattggtcgcgtcgcctcgagccccacggcgaggccgcccgcgcgcgcgcgcggcgaacgtgggatctagcagcggcgccggctgctgctgccgccgcgcgcccgcgcgcgccgcggcggcattgtctcgggagtcggtgggtggagaggaggcgccagggtgggatgataattttctctcctttttttttttcagaccattcccaattccgaaggcttggggagagggagtggacgaggagaggagggccacaacaacgtgcaaagacgtgtgttttttctattattttttctcatgttctatttcttcattttgaataatatcaatatggagtacttctacttgttatattttcagatctacttggtttgactcagacaagttttgggagtacgcgtagaacattcgatagttttgtagaagaaaaacttacaaatgtaactagtatataatcacaatgcaactagtatgtaactaacacgtaacgtgatttttttttccaaaaacacccagcatcataagtggctagggcagtggacttgcaaagcagcaagtcaaggattcgattctctattcgcgcatgcacaattattatatttatctcggtagcatgaatcttaaagaacatttgacggtggaaaataaatgtgtcgaaagtttttaacaaaacctaagtcagatatattttggtatactcgggccttgtttggatccaaaaatttttgcctaaaaacgtgaaaagaaaccaattgcacagtttgcatgtaaattgtgagacgaatcttttgagcctaattatgttatgatttgacaatgtgatgctacagtaaataattactaatgatggattaattaggcttaataaattcatcgagcagtttacaggcgaaatctgtaatttgttttgttattaatttacgtttaatactttaaatgtacgtccatatacttcaaaaattttacacccaaaaaactaaacacaccctcggatattatttccaagttcatgcataaataatgacacctgtaaaattgatgcatgtgtctgaagaggatggctaaattagtgcaatttaggtgaaattggagtaagccacttggacaggaaaatgaaaaatagggtaaggagtaattaaggtggggcagaaaaggaaatatcaaatatggggcataaatagatgtatctaattttctaagagaaaaattagcaagagaaatagttgaattgttgcgttgacacgtttattaagccaactcaatcaaatattccatccaagatcttctctgttttttttttatttttcgtttgcttcaatcaattctcacacagctatgtgtacagtacatgtgtctgtatacaagggacagtgtgtatgattatttaatatgcattattgagttgcacatgactctttttgcatgtatgtttagacttttgatgaacgtaaagtcatgggatctacaccaaaatccaaattagtggcgtgtatgaataagaacggaatgtgtatcacccacaatctggggcaaaatttttctggtcttcctctccaccggggaaagtgaatgatcgattgatcgggtactggataatatcagactaatatacttttaatgtacaaccttagactgtttttctttcgaaaaacagattataagtatttaaaagtatacttacactatcaaagttctttgcacgttaaatatatataactacatatactacttgcgttcatcaaaatgtactaatttaaaagttttttttaaagtggacgaagatgagactgataccagaataggtaggagcccatggcgatatgttttttcttcctctgtaaatctttcggtttctttatcttaactcgacaaaatcaacttcttttgggaggctgatacatatttttttcactaaacaataatgtttacttcatctatctcaaaatataactatttataagtgttaaaattatcttaaaataaaactatttctccatgtacctctcttatttaatttcctcatatactttctcgtatcaatcgatcacaaccatctctaacgtctaacattaatctcttaaaaaggcacacttagttgtactttgagaccaactctccaaatgtccaaatgcattgcttgtaattaatgcctgaattccataggactctattatgcatgaaatcatatttctatatttttcatgttcatgcgtttttaaaatcttactacgttctaaaagagctaacactaaaacgatgagggagggggtgctctcttctccgctcctaaagaggagtccccgtatggttaccgtgttacatgtctaattcacttatctattttttctttgtccttaatttgaagtacaatagtagaaaccgtggaaacaactacaatagttttcttttttttattattttcttacctcgtaaggaaaaacgatttagttttgaaattttatagcgtcgttttattacccctgctggtagaggattatgggtgcatataacttctattgaaatgttcgtaacttgtacacgcgtgcaaaagaaatttactgagatcaaggaatcatcattggtttcagactgaatcaaagaatttatttaggaatttcatatgattcaagtcctataaaaaattttcctatttgaccttttaatttaaaagattgaagcttttcaaatcttatgaaattcctatggaatggcacattccatgtggattttgaaggaaacttaacaagagctccaacctcttgttttacatttcaattcctattaaaattctttgttttttcaaccctgtgattcaaaggggcccaagcatatgttaataagtgtatctgttgatgtatactgcgtttggcagctggagaaagggagagagcttgtttcgttttccgcgcgcacgcttcccaaactactaaacgttgtgttttttgcaaaaattttctataggaaagttgctttaagaaattatattaatctatttttaaaatttaaaataattaatactcaattaatcatacgctaatagctcacctcgttttacgtatcttcccaatcttttcaatccccttctcctcgttaagtatggtgtgacctatgtttctttgagcatgttttgaagtggacgtattttcgaatatgtgagagtggtgcatgttcaacgccttccgtgtaatttcaacggaacaatagtaccatcccatactgccatacattcgaccgtgtaattccaacaaaaataataatatcaccccatacattagaactttttttttcaaacaaaaattgaaaagtggcttctactacgtactgcgcgccactagtggtcaagatttccggtgggagcgcaccatcatcaattcgacggttcgggcgtctccttctcctctccccacccctctcctccgtctccgttacccaaccccaactctccccaagcaaacgaagacgacgacgacgacgacgaccgcgccaccgtggccgcgcgcgatggtggatggataggaattgttcagggagatcgaggaacagcgcgcgctgcccccgcgtcgggctacacgcggcggcggacggcgtggggctcctctctcgatcgctttcgccggccgaccggccggcttggcccttctgctcctgccctgcctccccactaattaatccgcgttcccccctccctcttaattgatccgtcgatttctcggtacgtactatagcatgtatgaattctgatcgagatcgggatgactgggaggatgcagtgcattagtgcaaccaaacctactggaattaattgatggaaacgctactcactctactctcgatctctgttttttttttaaacactgttacagttctgctatccctttgttttcttttggtacaagcttttctagatcactaattttggctaattggcataactaagggcgtgtttggttatttgtatcactctagccggactcatctccctcatataggttaactggctaagtttgcccaggctgaggatatacatatgcacttgtttggctgctagcataagatgagtcagactacggttagatgttttggttggttgtattgaatatactggacgtgtaagattttgtttggttgattgcgtggactttgagtgtggttacctctttatttagtggtagagtgaagttaccactgcaatatcgtatataaaataaaatcatattaattagtatctgatttgacaagttgtattaatttgtataacatnnnnnnnnnnnnnnnnnnnnnnnnnnnnaaatcactgtagaaactgcgattatctctatattaataagctcaactttgtttgacagtatattggtgtaaaaaaagagaaaaagtaaaacaagatggaggagaacggtgtcctcgtcgtagtcaacgacgggcgtccgccgctcaccagccattggaaacgccacatccggtggccacgagttcgccaccgccggatctagtggcggcgagctcgtggccgccgaatccggtggtcctgtggcagaagatggttgctgacgacggcgagaaagaagtggaggcagcagcagcggcaaggaaggagcggaggtagcggcggtggcaatggagaggtgagaagcgttggcagtagcggagcggtggcgctcttctcgccggatttggcggcgggcttcgagtggccatatccggcatcggggagcttgtggctgacggagctggcgaggcgagtggcgatgtcgatgacgacagccgtgcgcggggtggaggcgaatgacggtggccgtgcgcggcgtggaggcgacgacggcggccttgcgccgtgcagaggcgatgacgactcggaaggtactgagcgggtaaatggtggaaaagaggtgatgagatgcgcgattccctctcgcctcctgcacgcacgtgaccccgttctacacgcgctcgtccccgtgcctgcacgcgctccactccgacgaggagggaagctcgattcgggcgtttccctttggcctggttgggaaggtgattttgtatgcgatgagccaagccctggaggctatggcaggtatccaaacatccctccactgcacgcgcggatgcgagccatgcaacatgcaggtaaccaaacgagccccaaatgaatccatacttgctgaaatgagaaggcctgaaacttcttaagttagtccctgatatttattgggacattttatataacattcgatagaaacccgcttaaaactctgttaaatgtaactataatacgactgcaatgtaattacaacgtataattaacttgtaattataatgtaaatagaatatatataagtgacttacattatgaaacggaggaagtaactattaaggacatgtttggtagtactctaacttctaaatttaactttaaaaattaggtctagagtaaagttgtgaaactatataaatttagctatatatctagtttactttaggagaacactctaatcaaattcactttttctggttgagcgaaaagatggagctaaaggtgaagccatgccagacgggctccacgctagctcagctgctcagtcagcatagatggaaaatgtctaatgcagtagaaccgaaccaactaaatacaaagatatgataattaacagcacttaagagttactccatccgctccataatgtaagactttctaacattatccatatttatataaatgttaatgaatctaaacatacatatatgtctaaattcattaatatttatatgaatgtgggtaatactagaaagtcttacattatgaaatggaggaagtattatactaagatcatacaagatcacagtagacagtagcttattgagaccctgtttagatgagataactttttaagtccctatcacatcggatgtttggacactaattataaatattaaacgtagactattaataaaacccttctataatcttggactaattcgcgagacgaatttattaagcctaattaatctatgattagtctatgtgatactgcaataaacattatctaattatgaattaattaggcttaaaaaatttacctcgcgaattagctttcatttatgtaattagttttataaatagtctatatttaatactctaaattagtgtcagagaataaattaagttactgaatccaagtaccacctgacttaactacggtctacggctaattgcatgcagtctataatcgagccccgttgtggctgtccatttccaagatccatccactgtctccgtgttgtccccgttatagtgtcggcctgtcagacaaggacaccggctagttagtagtacaattaagctgacactgcgctgccgtgtcaccattacttggctggtcgtatgggccccaccttattcctaggtgatcctgatgggccctgatattctgcatggcctgcatcttcccggcccacctctatagctgatttcgtatttgctttactccctccatcctaaaaaataatcaatcttgaagggagtactatacgcatgtgtattagcgtatgcattgtctctccttcctctcagtgtcctgcggcaaagtgtcaccaattaagtgattaattaaatcaccctgttgccataaatcgtgctggcaactttttgatctgaggatcaatgtagcgcgtaagcatgtaaacatgcccttactagtagtacaagcctgaagtgcctcaatggataagtaaatatggccccttacaagtacagacaacgaaaataacggaattattcttttattatattatcgtggtagaattaatttagtactatctccctccgagaaggagttaatttatactagcaatttcaaaacaaactaagtatagaggaaaaaactaaagtatcatcattaatacgagcattgttagatgggtaggtaagtagaattgaagggataaaactaaataagtacttttcgatttgtgaactaggatatatgtaaggggctagagatcaagtgtttttgggacaaagggtgtgcttgttgacggggtatgcccgataatggtattttatggtacggctgatacgaatgtatgcacgagtttggaataaagagataaggacaatggtttttatattggtttagactcctgagaaggtgaatatatatacatttgagatgtatcacaccgagtacaaaggtggagcaagctagctattctaacatatcaaactaatctcgatgagcaaggtgcccggttgtagtccacggttagcagaaaagcggtgggctacacatgctggtcggaatcactgtgagggatgtcggtcttgggcaacaatggttatcggggaagcggcgtccaaaggagtcccattaggcaattggtgcggggcaggccagtccaacgaccatggcaaggagtgccatggctgagatggttattgcatgactgcatgctatccatcgtgtccagcgggacgacttcggtcctgatgatgatgaagacaatggtactgaatcccaccatacagcattggttcgaagacctcatgcattactttggccattgtcttaatagtgctaagggtccaccaaagggcaaatcagtggcgacgactaatgagggagggagatcggtagatcgaggcggcggcgttgtagggagaatcggagtaccaattggctcggcttttctgcttgtggttctggttctgggagccacgcccacaagtgaagcacgagttgagccaagcgaggcacagttgtggataccggccagcgtgaggtacgcttggagtcacgaccatcgtatgggcaaaattgctatttagtgatcagccacgcgcgtcccaatcacgttttaggcctgctttttttctgggttgttgagccccctgacattccaatttaagatttttaagccatccatcatttctgaaacaacatgtatctcctatgcatgatcacaagaacatcgaacattctccaatggcaattcattaaaacaagagataccaccttacacaatacatatggggtggtgtagttccttacaattttcccaaaataactactcctgtcgtgcacgaaccatcatgaactactaaagcctagctgaagactaggcatcattggacatgctaagcatccaaacatcaacaccgacagcactaatatctggtagggggtatgtaggaccataaacgatacagagagtcaagggtacattagcactaagcagggagccgccacattcgaatgcaagcaagaaaatcagaccactctggctgcgtgccatcggtctcccctgccacatcaggtggcagaggcgtgcctccatccatcctggcgagtgcccgattcccttcaccacaaccatcggcagaggagcctcaaagtgcttgatgtactgatcagcaaccacatcattgcccaccagctctccttgttgcaaaatccccatatccttgatgatacggacttgagctcgcagtgaaaccgggaccgaagataccccccttcgagactcttggtctagcagcttgctaccagaaccttcttgcactctctttagcaccgaagcgacgacgtcgctaccacgagcaatgactgcagtgtagcgaacaacactaggtcctcttgggccgtacctatgcctccacgggaaccccgacttgcccaagcatgataagcccaagcggcccatcaggcgacaagaatggcccatcaaacgacccatccaagaaggtgagacctagggcatacgcaggcatctccctcattgatagcacaacagtagccgttgccagctccagaagcatcgggtcgtcgtctcgtgccggcctcctcgtcgtgtccacgtcagagcagcacagggctgggtcaaccctgactggcgttggcgcgatgcagctgatcggcgttggcatgatctggggaaggatgcccgaggctagggaggcatgcttatggagcaggcctttgtcgttttcccctccacaattacaattggatttgggcgaaacagacaatttgggcctaatttttgggggattgggggagggggggtgggtctccgagccaaattctggggtagtctcgagcccaccgagactaccccttggctacgcccctgtattattgcgcagcgtcattcatgccattgcaattgaacatggcatgctactacatactactccctccgtcccaaaaaaatataaaaacttaggatcaaatggaacattttctaatactacgaactacgaatctgtacataatgttctatatggttttagatttttatattaattatattctgagatgatgggagtagctaggtgcggcctgttaggttgcaccattgctagctacccacctcccacccactaagtcctccccctccacccacctctcccttcactccctcacctcactacctctcctcacctcctccatccagtcgggcatcaatagtaggcggaggcggcgcccctctcctctcctcccctccctcctagatccgactggaggaggagagggcggcggccacagcaaccggcggcgcataggcagcgctcccctcctccctctctccccgctcctagaaccggccggaggaggaaagcggtggcggtgcccctctcctctcctcccctccctcctagatccgactggaggaggagagggccgcagccacagcaaccggcggcacgtaggcagcgctcccctcctccctctctccccgctcctagaaccggccggaggaggaaagcggtgccggtggcagtggcggtggagatggaggctagctgcactcccctccctctctcctagatttggccggaggagcaacgacgcaggcccctcccctccctcccagatccgaccggaagaggggagccgtcagcgacggtggaggcgatgctccccctcccctcccccctccctccctcccgcacagatttggctgaaagagggaagccgacggtggcggcggagtcggctctcccctccttcccagatccaaccggaggaggggagccagggagccggccggcggtagcggcagaggcaacgctcccatcgggtggtggcggcggatggaggaaaagagccggaggtcagagggggagggcagcagcgggggacggagaaggagaaccggtggctggaggggggaagggtggcagcgggggattctttttgttccgtgagattgttttttgcaggcgagtggatgtagcagcctacgaaagtgactttttgcaggcggggataacgatcggatgcaaaaatcgtctatttttgcaggttttgaagtgcaagcggggctaatggccgcctataaaaatctttttttcccgtctgaaagaaatcagtcttctagtagggaaatatgggttgattttttttaagacaaatggcctatggtcaggccggtcataaaatatcggatcgatgtccggtactcgatcaggttaatgcacgcacgtactacctccgtctcaaaatgtagctatttctagcacagtactttatcctaaaatgaagctatttttctacctaccttctcctctcaaccaatcacatccattctttttcacctactttctcttttcaaccaatcacacaccttcttcaattattctcacctactttcttaatacctatgccaatctcaaaaatccttacattttgggacggaggaacggaggaagtaagccgtaaggtacgggttcggctgatacactagtagcgccgcccatcgtcgtcgttgctgtaccatgtcaacacgcgcatgcagtgaagtcgtactgaagtacgtggatcggcgtgacggccgggcggctttcatgcgtgccgttgcctcatgggctatacattacccggaccaaaacgtctctttccttgtgggctagctaagctcctcccggcccatcggtcggacgtcgcagcccatcgaatcgaggctcaatttcatcgtctcgtgcactgcacacccgtgatggcaattggcagcagaaaccaccatgcatgcatgacccaaccaccgtgcaccaacgcctccccgcccacccgcccgcccacgcacaaaacacccgagagagtccacgcgcgctcgtacaaatcccccatcccctcctcgccgctcgcgccacgccgcggcctgtacaaaaggcgccgccagtatcgtctcgtccccccacgcgcgcgcgcgcgcgtgcacaacgatcgacttcgaacgccgcgccgcggccgcaccgatcgatcgatggcgccggcatcgacgacggcgacggcgacgtctgccgcggcggccgccagagccatctgcgtgctgctgctgctgctggtagcggtcgtcgtggtggcggggcaggcgccagagccggagggcgacgatcaggccgcggcgatcgaccaggcgggtggcggcggcggcggcggcggcaacaacaacggcacggccggccgcgcgagaggcggcggcggcaacaacaacggcaccgggcgcgcgagggacggcggcggcgaccgcgaccgtggcgcagacggaggcggaggcgggcggagcaagctggcgagcagcatcgactgccagatctgcgaggcgacgtgccgggtgaagtgcctcgtcaacagcctcttccagtggggcggatgctaccagcgctgcaggtccgacaactgcaacgactggtgcaccagaggctaacgtaacctagctgatgaacggatccatccttcggatcggacggcttgcgatcgtttagccctcgatctgacggttacagctgcagtactaatttttttggacaaagatgatggtatataccagcttgttttttttttcaaaagatagaaaatggtattacttatgtgctcaggatagatccagcatgggtgtgccagagggacttgagtcctccgtgcccactagatcatcattgataaaaggagagagagtcgaaagaaaaagagagataggaggaagagtaggggttgaaggaggagatgaatttcctctctagttttattctagattcgcccctgatactcataatgttggaattaatgaatgggccttagcccactagaagattaattctttggaaatcacaaaagcccacctcatggaatggcatgcatgtggagtttagtaccaccctgcttattctaggagagggggacctccttaaaagggatgatgcccttctagccacttgaagcatgtgtggtggagagaagagggggaacacacgcgcgcgctcgctcgcctggcctggtaggcgcgcgtgcacgacgtacgcgtcgaatggtccgccaaaattggttcctcgccttgcgcagatgcagcctccttttgcagttttattttgctgcaaattcggattcgtttttgttttggaaacgttccgaaaaatccggtgcgtgcaaacggcgtggagtccggataagttacgcgcgacttatccggttcggttacgcgcagtggagatcatgcgggcgccctgatcaagcgacccttctctatataaaccgacccgccgtcttcacgcaacacacgcgaaatcaatctagggtttgcctcctactctgtgctgcgccgtcgctcgtagattactccatcccgctcgccgacgtgcacctacgatcgggagagtagatctccggaacctctgccttcgacgtcctgcaccgggagaaggcggcaataaagttttttgggaagcgctttgcgcgactgctccctgttcgtccgcgacggcttgtcttcctcttcgctcgcgtgctgcgtgccttcatagatgcctgcgaaaagtttcgaccgagcagccggtctttccgccacctcgatacgtgttcaatatgttgcgcatatttgatctgttcatgttatactgtgtagtttacatgtgtagatctaatgatgcgttcatgctagttttcatctgtaatatcatgatttatttatggaatagattaaatcattatatgcctataatctcaacacataacgtacgtaaactcacccctataaatatatacacatacttctatccttatccaatatatggtaatctcgttaaatgaaaattaaacggtgtgttaattagttgtccgacccagtactagacgagtaaataactgcgtaatttgcatggcagaaccgtgcttagaccaactactcaaattaattaacaagctcaggttgtgcataaatacagacggtggccgttgaacaaggtacagaggtagatgtggttaccggtgtcgcaaggactaaatgcttcatgtttgtctatttaattattggttcctgtacctatctcgtcagacttttcaaagactatacgaataaaaccaccagcatgatctaaattatgaattcatatacatatccggattgaatttaacaggcactccaaagtctaaagatgacgactcactgtttgaatctaacatcttaatttagatcatgccaaaacaaagatcttaagttagctatttaaatatactctttaattagttagtctatagggatggatggatatgatcatagatgctgcgatatagagtagttgtcactgtactttaagtaattgacttgacctatgtagctagctcatccggatggattattatttgtttatatatgtaaatcatactagtatttgccacgagattttctactctcggactagtccatatatatatatatatatatatatatatatatatatatatatatttgcacgttttttctcggcgtcatgcatgcatgaaacggagtttggcgtttttcttcgccttttccgagggccgacttggtgtccacatcagcaatcacatgtcctgaaaagaaaaacaaatagagtactcagtcgtcactgcagtctctgtagtatggacatgatattgaagcgtgggtacacagaatttttttaaaaagcaatatgattttaatggaaaatcgcaaaactataggtcagttaggcaaaatcgcaagtttagcaccctatcgaacaaccgcggttcgacagggatacctatcgaacaaccacagttcgacaggtacatgtcgaactacgtgagttcgacagggtaggtggtccaaaaacaaataaaaaattacatgaacagtatcactacaatactaggcagggacatatcgaacagccaaagttcgatagggttgcgtgaacagcgcgctacagtgatgctacagtgctcgcaggcacatatcgaactgccatagttcgatagggtattgtgaacagtgtgcaacagtgatttttctctttttttaattattttaatcacctgtcgaactaccgtagttcgacaggtaccctatcgaactgtggttgttcgataggtaccttgtcgaaccacggttgttcgatagggtgctaaacttgcgatttcgcctaactgacctatagttttgcgattttccattaaaatcatattacttttaaaaaaaattctgggtacacacatctagtctgagctccacctctccacacaaaaaagtattatctattaacacatgattaattaaatattaattaaaaattaaaaataaattaatatgcttattaaaacaaatattttttagaaaacttaaaaaagatcatttagcaggttaaaagtgtgcaagaaaaaaaaaagagagatgtgagctagaaatgaaggggaagaacatagccgtagacactccttaacttcaagctggctgcttagagaaaggatacgatgacaatgtccaaaatatgtttcagtaaactacatcagcatgatatatttatttatatacatcgaaaataactactgtactaattacctcgtgagcgtatatgacattgttgattattattttacttcctccgtttcaggttataagacgttttaactttggttaaagttaaactgtttttaagtttgactaagtttatagacaaatatagtaatatttataatactaaattcagtgacggacgtagctttaaaatatagatggggcggagaacggagatgttcactcgataagagcattcgaacacaacagatatcatattaatagttcattcgcataactccctcaatttgttgggtgttcacaccttgttatatctaaatttgatggcccataactactataagggggtaaggggggtcttgagggttgacccaccccacctaatgagtagatccgcctgacggagcgtggggctcctcaccgggagaccgcgcaggcccccctttgccgattcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctcctttttttttctctcgtgggatctcctctctagatcctccccccttccaacccccctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacggctgctgcccgagtgacccttctgatgggacggcccatacctacctccactccgccggaagcaggtgcaacgtgggaacacggttgtcttccggcaacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgccagggcgattgccctcctcgagggaagcggtcgggcgtgacgccacttcctaaggcctggtgacaggtggggccggtctaaaaatcgggacaagccggttcgtttttcctggagatatggtgatggcgctttggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgtcctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccagaatctgccaccggccgggagatagtctcactgggcgagggatgccctgcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcataatggcggcggggcctcagaggaacgagctcctaagggccatgacggtgcgagcgggagccacaagggagatcaatctaccccaggagggggttgtgcttccgggccccgtgatgggggctcggggggcagccgccctgccgacgcccgagggaagaggaagcaagagggtacttcctccccatctcctccccgagggggcggggcggcgcgtgtcagcagcaggcgcccggagggggccgcgccgacgccgcagcccgagggggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgaactcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgaatccggcacgtccatcggcgggccgagccgcgcgacatcctcaccgaggcggctctcccccacgccttccgctgccccactgagcgcagagcctcttctgcaggccttggccgtcgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgccactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaaacccttgaggcccgtgccatggcgctggaatagcgtgcctgcgtcgtggagagggacctggcggaccgcgaggccgccgttgctattcgggaggtcacactggcggtgcacgaagccgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcactgaaccagcgggccgctgaactcgaggcgcaggcaaggaagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgagtctctggggcgggcggactgtgaagtacgccgccaaccaagggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatcctcagttttttcttcttttctttcttccaaggccttcgggcctcctttttgtatagattaacttaatctgcaatcaaaataaagaaatttatgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgattcccccccggagttcaccacgccccggggcacggctcggttctgggccccttttgacgattttagccgacccgagcccccgagggcaggattgagcacaagtgacctatttcaagtcaagattcttcaaaaggaaacaacagcacagatacagcctttaggaaatcgaaaatgcttttattgaaatacagatagaagaaaaaatatgcatatgtggtagcccccggccaaccctgcacgcctgaagggggtgcggggttggcccgagcccgaaacctgacacccgaactccattaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgtgcccggacgtggcgctgatggtagcgccgcaggctctgctggtagcgtgcggctcggagggccgcgcgccgccttcgctcttccaagtagtcgaggtcatctctgcgaagctgatcttgatcaacctcgcagtacatggtggcccgaggggacttcagggtgagctcggatgggagaaccgcctccgcgccgtagacgaggaagaaaggcgtttccccggttgctcggcttggtgtggttcggtttgcccagagcactgctggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaacggccatgaaagtggtatgatctgcagtgcctgggccggctgatggatttgcttggcatggaactgacacgctctgcatcgccggaccaggtcgaccgcatcattgagagctgttggccaatagaaaccttgacgaaaggctttgccaaccaaggtgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgctgtacttggcgtacgtaagcatccatctgcgggtcagagcaccggtattccttacagacctggttaacctagctgggagtcgcctaacaccaggaggcggcggatccccagtccagctgccaccctgagtcccgcaaggagtccctcgtactctgccatattattggtcgcccgaaagtcaaggcgaaccaggtatctaaggacgtctccgctcggcgaggtcaatatgacccccgcaccggcgccctgaagagacagggagccgtcgaactgcttcacccagtgggcggtgtgaggcagctgcgaggggcccgagctggcctcggggactgagacgggctcgggagccggggtccactctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcgatggggccgatcctcttcgccaggggccgcatccctggggcgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggattcgcggaatgagggttgtcctcatcgcgctccacaactaacgccgcactaactacctgcggggtcgccgctaagtagagtagcaagggttcacctggctccggggcgaccagaactaggggagagctaagatacgccttcaactgagcgagggcacgttcagcttcctccgtccaggtaaacggcccgaagcgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagctttatgcaggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgtagttttttcctcatcctccctagccatgcgaatctgatggtaaccagagtatgcatctagaaaacacaaaaggtcgcaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaagcttgacgttccggggcctgccggcgcactttctgccggaccggctttgcgcccggccgcacggcgagacggtgctcaatcacctccctggggaccccgggcatatccgccggtctccatgcgaagacgtcagcgtttgctcgcaggaaggagacgagcgcgtcttcctatttgccatccagaagaccaccgattcgtgtggtcttggacgggccgtcgcccagggcaacctccttgaccgggacctcgtcgcacgtgactatccgctgcctcggggcggcggggacggaggtgccaagcctctcgtcgccaccctcgggcttggacgcagcggcgaggtggtccgcgcgctgctccatacaagcgagcgcgactttgaggtcgctatggacagagatggggccaccggggcccggcatcttcatctggaggtagacgtaatggaccgccgccatgaacttcaccaacgcgggcctccctaggaccgcgttgtagggcagactgaggtccgccacatcaaagttcacccgttccgtgcggaagttggcgcatccaccgaaggtgaccgggaggtcgatatgacctagcggccaagtgtgccccggcgtcacaccgataatcggctgggacggccggagcaccatccccgaggccttgatggcgtcaaaggctgcgggggaaaggatgttgagggctgctcccccatcaatgaggacacgccccagcttcacgttgcaaacagtgggggaaaccaccattgcgacctgtcctccccgggcaatgcacggtgggtggtcggtctggtcgaaggtgagggcaacctccgaccaccgcgcccggcgcatcgcctcatgagtaggggccgcggccagaagctctcgcttcatcgccttgaggctccggcgagaaacgtgagcacacgctcccccatcgacagtggcaatggtggccccaggctcttggaaacccaggtcatcatcgccgtcatcgatgtcctcggcgggggccttctgtttggcctctcttcgccgattgccggaaggaaccgccggggacttgccctctcggcgctcctgcctcctctcctcctcccacttcctcgtccgctcagccaaacttttgactgcacggcagtccgcgaggtcgtgaagggaggtgttgtggacggtgcaccacttgccggttgggcgctccctgctgggagcgctggcctcctttttgtcgctcgcaggcctcccctttcgggtggcccgtgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctccgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcaccacaaaggctctacagccgacaccaccaaccgggggcacggagggctgatccccgcgtccgtgttgaggtgacactccggacgaggaggcgccctccgttgcgtgggcagcacgtcggccattacgccggcgctcgatactgatgcgggcatccggctccccacgcagatcttcccgggtcggaggcgctgacgaaggagtggcggccgaatggcgaacagcggccgccgctcgccgcgccctccgtcttgacgacgcggagccggtggtagcagtaccagaggtcttggtggcggaggaccgcccaccagcatttaggcgctgccgcgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggaggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagacccccctacctggcgcgccagatgacggagcgtggggctcctcaccgggagaccacgcaggcccccctttgccggttcggccgggggccctgggtgagattctaagctcctagtctgtggaaagttcgcgagaatggaaaaagcacaagacacgggcgatgtatacaggttcgggccgctgagaagcgtaatagcctactcctgtgttctggtggatctgtgtatgaagaagctacaaagagctggagagccagagagctcttattctaaaaaccctcttctcttttttttttctctcgtgggatctcctctctagatcctccccccttccaaccccccctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggagatcaccctgtcatctcttcataaatgggcggagatttgcaacggctgctgcccgagtgacccttctgatgggacggcccatatctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgttttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccctcccgagggggttaggccacgtgggtgatcgtgtctgcctcaagtctctaagtcatgatactcccggtcccatgttaccgacaccgcccctgactaaattagtgtcatcaaatcaataattgaatgtattttcataataaatttatcttgggttgaaaatgttactttttttctataaacttaatcaaacttaaagctgtttgattttgatcaaagttaaaacgtcttataacttgaaacgaatgaagtatttcataagcttctctacgtgcaccatgtttttttttagggagtgcatcatgtttactctaattttgtagatcatatactatttcatctcaaaataataggataagtctccgaaatctcaaatcccaccgcattatatatttattactcgcgttcatcctcatgagcgcaaaaccctaattatccccccccccccccacctttcaaatttgttcgcagtcttaattaacatgttctctctaaccactggaagagaactcgatcggtcaggtaccagagccgcaatctgttcttttaatgacgctagaggtgcaccttttcagcaatatttcgtaacgtcactgaccgtgatgtttaacccaactatacatgtgctaattattggaattacgaaaatgagtaattggtgtgacgaataatcagcgttgactggtctatttaattaatgctctggctctacaaattgaattagacttagcgctcatatagtcgtatggagtactccctctttttgtaaaaagaaataatctaattccaaatatataatctgaacatgttcagatttatctttagaattaattttttttatagagggagtatgttatttttggatttgcttaattaaagcacaagctactattattttcgacaaaatcccagctcaaattatatttttcatatcattaattttacggttgagcctatagtttgttcgtgttaaattaactcatttttcaagtattttaacatcgtgtgtgactgtacaattaatcaactattaatgcacatgtacagaagtggcatactggcatatgtagatctcgatccctccccacgcccttgtatatcatgcattaattaattatatcatgcaaaagcattaaaattctagatctgacagaggttcaataataattttttaatgctttgtatggttttatggaaaacaaatactagccggtggataggacattaatatgcatgggtaaataaagatggaggaaaaaatcaaagtatagttccctagctactcggatcctactataatgatatggaattttaattaagaatattaattattagctgagtaatatataccactcgtcctaatatttaatggttgccaagctaattgaattgctggagctgaattgattagctggtaatattttctatagataggacgttgttaaattctgccatttgggctaagacatagtacattcaagcacaattaatggtttagccagaaaacacaacagaattgtaaacatctgtaaaattatatatacgtgatgggtttaccggcctgtcggaaaccattgttaatttgttagtaaataaatccctttatctcctcaaaagtatcatttcagtactagtaaatttattcatgaaattacttactaattcctaatgtgcacgatatacgaattctgctatagttaattaattaggtcgatcgatccaacatgaaatctcctttttgcttcattaatagaaatagtatatttatttatggtatcattgttttcttataattttcagatattatttcgcgtttatttatatttaggctagaagggctaaattttcagatattttctctaccaaaataaaaaaaaactgtatttcaataagtctagtacttccctgcaaataatggacatcattttagagtgtcttataatccaggattttgattgagtaaccccaagcgaataatgccaatactttatagtgttgacaatcttgttaccaaaataatcatgttagctccaacccagtagtggtcttgccgtggtgactggtaattgcctcgctagaagatgggctagctagcaacataatgcccatacctgtacggcgtctacaaatacatttacgtactctattcgtccaaataattttatcttttatatagaaatagactattcccagatataatattaatttataagttacggagagagtgcatttgttggcatatggtctacactctctctgcattgccatacaagctatgccaggcaagcactgaacaattaactcatggtgttgttcggcagacggacgcgcgctgcggccgcaacggtactgttcaagctgactgtggtgcagccatgcacaaacttaggctgtgttcgggaggcgaggttgggaaccttgcctcctgacacggaaaacgaagcacgtgattatagtgagactaattaagtattagcctaaaaaacttgaaaaatggatcaatatgatttttttaaagcaactttcatatagaaaactttttaaaaaaatgcatcgtttagcagtttgaaaagcgtgcatgcggaaaacgagagaagtgagctgggaaagaggggtaaagaacacagccttaatagcccttatgggtgtctttaggccatgttcaccctcaactttcaactttccatcacatcacatcacatctaaaactttcctacacacataaacttttaacttttttttcaaactaccaactttccctaaacttttaactttttttcaggaattaaacacatccaatatactaaaactctatatttaaataatactactatatgatattattgagtttattggatcttgatatactttagtgattatctttctataagaatgtgatgatagtatctaacacaattatgttattgtaaaaatacttataaagaaaatatagattttatgttttcaaactaaatattttgagagttaggatggtcagagttttaaaattttacttatctaaaattaacagtggcatacatttatcaataggcggagtaccgataatataattactttgagagaacagaatgtacattaattaagtagcattagtaataaccattttaatttgccggcaccaacctcttaattactgtaaagtgagagtagtttaattggttaggtttcttgtggtggaatcagcccattcgagttaggacctggacttagacatcgatgctcgtatttatggctaaacctgttagccgtcgacgataagacaccatatggtgatttcatcaatctgaagatataccgatccaatctcttaaaggtgttcatagatataagatatgcaattgttcattaatagagatgaatgagcatctgctttatattctctccgtcccattataagtgaagctataagttttcgtgcccaactttgatcgtctgtcttgtttgaaatttttttataattagtatttttgttgttattagatgataaaatatgaatagtattttatacgtgacttatgtttttaatttttttttaaaaaaaataaataagacggacgattaatgttggacacggaaaatcatggatgcacttaaaatgagagggatatagtactatatttttttaaaaaaaaactcttaattaccaacgcacgactttctcgcaccaggccaattgacccttccttacccacatatacatgcagatgcggtcatatctcatagactcatactacgtaccctctcagtaacggaaaggtgtttgtcttctggctaactgctacagtgttacttatatacgtatctctcaacttgtgaaagtctgaagctgtcgctgtgccgtcgctgctagttaaaaaaggcttgccttggactttttccccctcctcccatgatcccatccacaccacacgcagcaacgcatccacacgctggatgctgctgctgctgctactcctgctgccgtgatcgatgatgacgcggacgccacgcgcgcgaggcgcgatcgatcgaattcgccgtcgactttgaccgccgacgtggcggcgacgcgcgcgttcatctagccacatagctaagctagcttacttcatttcatttcaagatataagacgttttgactttaaatttaattaaatttgtaaaaaaaaaatagcaatatttttaactaaagataaatttattgtgaaaatatatttaattattgatttgataaaactaatttagtattataaatattattatatttgtctataaattttatcaaacttaaaataatttgactttaactaaaatcaaaatatcttataatctgaaacaggggagaactacctagcaaccttgccttacttccaatggcgcgcgacacgcgcacgtcgacaaaaacctaccccttctggtgggtgtacccgatcattccaatgcatattaatacctctcttgctcagcgccgcgagaccagtaaaccctagcaaggttatttcttcattttttgtactttggattatttctgctttgcttgccatggccgatgatgatggctaccgatgccagcagcggcggcggcggcggctggtgcagaggatggtggcgtgcttcgggatgttgtcgcggcggcggcggacggtgaggctggtgctgtggggaggcgaggtgcgggcggcgaggcacgggaagatggccgggcaggtgatgctcgacttcacggacagcgtcgtgtgccgcgccgacgggttctgcatcggccgcccggcgccggtgctggcgatcgaggaccgcctcgtcgccgggaggacctacctcgtgctccccgtcgaccgcctcccgcagggctacgacgccgtcacggccgcctcgctggccgcgctctcctacgacaggggcggcgccggcgccggcgccgccggggcgacgtccatcgccggcggcgccaagagccccttcgagtacgtcaagggcgacgacggccggacggtcatcaaggtcacgccggagttcatcgtgagatccatcacctcctcgagaccaataggcgcctgcgccgccgccggcgacgaggtggtggagggcggcggcggcggcggcggggcgcagctgtgcagcacgccggagctgaggaagcactacgagcagctggtgggcgcggcgaggtgccgcgcgtggtcgccgaggctggagacgatcaaggagcgcaagggcgccaggaggatcgtcgtggcggcggtgagccccgggcggctgtcgccggtggcggcgaggctgctcggcctggaccgaggagcaagctagctaagctgatcgatcgatcagaaagccttgtaattaattaagctcaaaatttccgttcttgattgccgcttgatttgttcatttgatcagattgctagctgctcctcttgtttaatttggcagcaactaattcattttgatctgaacaaatttagcgatgaatttgaattcggttattattggagagtacaggtatagttttaggagtttgcttgggatcgatgtatgatccgtgtaattgaattgaaaaaaaatataaatgtgaattaatatgcaccgtcaattaattgtcacattatcaggaattcatctatgtgcaattaagctaggtacatcgatcaccgacgcgcttggcgttgttacgtcataccaggtactccgtagtccgtacgtgcgtaattagttagcagatttgcattattgtactgacccgatctatctacattacgattttgttcgaaacagcaaaatttaatgagaactgcgtgctgtccatttcaagttttcaactcgaatttttttttaaaaaaaaaagagagagagagaaaaactgttacgctgcttggattattggaccggtcaatgtaatctccattggggagttaggagatgtgggttggtggtttttatgttgttccctcagttttaattgctaatttatgcatatcaccacgtgatcggttcgattaattcggcgtggacataagtttggttaagttgttttttcgcacgtgattgaattaattcagttgcccaaaatagtacggctagctagatggactggtagagtcgtagagaccgaggggagctgtcaattggtgtttgattaattagccggtggttgctaaatagctaattgtttactcaatcagcatgtagctaagtcatgcaggacgttctgatctagttatatttgttggttaatttataagttctccttcatttagaaatgaagctactagtgcacatgcggttcatgcacatgtgtgtgaatcatgaatccgcttcaatgtaacacgtgccacaaagcccccgtgcagctatgaagagagcatatattatcatatactccttccatccctaaatatttagcgccgttaacttttttaaacatgtttgaccgttcgtattattcaaaaaatttaagtatttattaattttttttcctatcatttgattcattgttaaatatacttttatgtatatatatatatatatttacatatttcataaaagttttttttaataaaataaacggttaaacatgtttaaaaaagtcaatggcgtcaaacatttagggacggagggagtatatacgtgctaaaacccatgtccctgtgtgtgtgaatcagcgaagcgtatagagtattaattttcatatacttctaaaaacaaataacaacatcgcactattgtttcctcgaacttttcttcttttgataccaagtcaacgtaaggtagtaattaacgcgggattattcgtgtgtgtgaacggtgtcacagacgatgaaccaggacacgcagatcaaaggacaggataaaccgccgatcgcgggccgcagccttgggtttgtgaaaggaaaaagtataatttgactcccttaactatggcacgagtatgattcataacctccaaccacaaaaccgggtatatcgactcctccaactatcaaaaccggtgcaaaatatatctgagatggttttggaagcggttttggcttacgtggcgcttacgtggcagtgttgacccggtctccgtcctacgtgtcgttgacatgtcacatatgtggcattttagaataaaaaaaacaaaaatacgtgggaccaacatgtgattcacacttaaaaaaaatagtgggacccaccgacatgtgggccccacatgtcatcatcttcatcctttcttcttcctctctcctcttctctctccttttccccttcctcttcctttttctacggcctcctaactcccttcgttctcctttctctcggcccaagcgcgccgccgcacacctgctgcgccgcaccggtttatgcctgaccgccgagcttcggagctgcccgcctcacctcctatccacgacgccgccgaaaaccacttcggtcctgacgcagccgcctgtcctagagcaccgccatgcacagggttcgacttcccactgtcgtcgcatccgggaccccgccggtaacgacccctcccaaatctcagcttgaggaggaagatgctaaccgtccaaccaccttaagaccaaacgattaaacaaaaacagattaatttaggagaacttttatggtacaatgtactaccagtatatacttgtagtataaacaatctaacggtatagattgccttgtgatgatgtgcaagcaaacggtaaaaaaaaatcgcagggataagaaaattcccaggagccgaatcaaaaggggagggaagaacaagaactgaacagatggaagaacatgtatacttggcagggtaaaccaatgaaactaatctcaaagaaaaaaagcaacagatgcgctcagaaagccaataaaagagagagaaacacatttttaataaaaggaaatgcttgcttaattgttctgaaccaaaaaaatcaaaggaacaaagaagaagaggaaggacacaccaagatcagcatgaaaagaaggggagggggccgccgtgtccgccctagccgccgttgtccgccgcctcctcctggagccggcgccgccgagcttctcactcgccaccgcctcaaccatggccatggccgtcaaggccaacacagccggcgtcgtctctttctcgctcgtcctcaagccgttgcggggcg

SEQ ID NO: 61724 - DNA, 1714 bp, Oryza sativa
  unsure (1)..(1714): unsure at all n locations
atttttaaaagaatggggggctcctttntttacccaagggaaaagggtattttccaaacatttattgggaacccggtttttcccatcccagtttaaaacgcggcctgtttttttaaccctccattaggggaatttgggcggggcacattttttttttaaaaaaaacaatgtatttttttgggccttttcccaaaatcatacccaaaattttgtgggtgttttttgaaaaaaaaaaggtttttcaattaaaacagtttgtaaaggggggaaaaaccaaccaatttttggtggaataccaaattaaccggtttgttccatggaacccaaaggcccctttgatttaaaaacctactttttgggaaaactaaccagggaagcactttcaggtttaacaaaaggttgaagaaaggactggccctttatgtataacatttttcatatgaaactgacatgcagttactgcagaatattttaggagctttcatgtggaccattacgttgtgttttcaacattactatttttattgctttatattaggagtgttggtagtagtacaattataagctgcctaatttagctcaatgactagcatctacttaattagttattcattccatttatatgccaagccttctaataagctgtatcgtatacttacaccttcctgttatgcttgaattgcagcctttgtttgtttgatggcctcacctgcatcaccgagagagttcactcaggaagctgcccgtcagtctctgattgcgatctcccggtctgttccagcggcaggagaagccgtcaacatcaagtcaccgagcggcgccatggtgaatggccaccaccacgacgatgacggggcagagaagtacagatcaaagctcatctccatctccaacctgtcgcctgatgcccagcctacgccgtgctctcccaaggacaccgctgctgcttaggcttaattaaccgtgtgaccatgttactgcttacacttccaagtgtggatatcgtgtcccagcgtgtgtcgctaaatgctgagactgtgatcaggacccttggccttaataactgccatgactgtatatggtcttgtgatgaactgcccagtgggatactgcccttcttatgtgtgaaagatgcatcatggcttgaaatcttctcgcgtgtaaaatcagtacagcagttacctgaaaactgttttgcaaatgcagtggatcactatcttgttcttcttttgaggccctggtgtagcagtaggacgactgcattatgactctatgagtcgatgagcagtttagatcgaagcagatatgtacagtagctgctgtgaggcaaatttttcatgatatgtgacggttcctcttactttgaagtcttactttgaagtcaagatgaatctgtgaagtgagttgaccgtgaacccacttaaacaaaattacttaaacaaaattagtgtacccacttaaacaaaattagtgggcaacctatgaattaatccacgggttacttactaaccaacttgacgacgggaaccggccgtgggttgcctatttatttaatttaatctataaagcttcgcgggtgatccacttgtatacttacatcttttatcaggatcctggtgcaagaaatcatacggatttgctgttgtgtgcgtacgcgccaacgggtcaactcagcgcgcgtttcggacgttcgcaggctcattagtaaagcacg

SEQ ID NO: 61725 - DNA, 1154 bp, Oryza sativa
  unsure (1)..(1154): unsure at all n locations
aagaccatttctagaataagtctttttaggggtctatttgcgaaataagttttttaaatggaccaaattatgaaaaatacagggccgtgtgccgttcccctggccaccgcgtgcttggccaccaacgagtgcgcgcagcgctcccctgccgctgacgccgttgaagttgatgcgggcgccgtctttgttgccgcgcccgccgccgcgattagcgacgatagcatgccctccctgaccggtgttgctgtagagatcaaggagagtttcaaagttgaggagttgagactacagctccccaaccgtgatgtgatcggacttggtgcacagagccnagacgatcgggctgaagtcttcatgtaaccctgagatgatgcactgcgccatatcctcttcatcaagaggacgaccggcggcagccatctgatcaccaagagctcgcatcttggcaacgtattcatcgaccttcattggtcccttcttcgtgtctgtgaaggcgagcctggtattcaccgatcttgcacgggtgcggctggagtaaaagacctcgatggctcaccaagcttcagccgccgccttgcacatggcgacttgaatacaacatcccttctaagagatgacaggagatggcccagaacatgtgatcattggctacataacattcaatgcgcggctcgaatttgtacaggctcccatctaccgtgactgtaatttggngttagagctctcacagnaccatgaggtaaccttgatatgggtcaggcactggagggctactttgggttttccaagggaggaaggctttacggttccttgtaacgaatggccttaaccaggttcacattccctccctaggaaacaacaacgttaaaggggaaaaagaatcattttcccgggggaaaggtttttttctctgttaaaaatgggagccttaacctttgtttggccccattttttaaaaaaggggaaaacacctttcccgggtaaattttaatttagagtaagggaaatccaaattggaaaaaaacatttcctaaacctttacacggaactttttatggttaacaatttgcatttaaatttttcccttccttgggaacctcaaaaccagggtcctttttgtgcgttgtgcaacattgttcccaccccaaagggct

SEQ ID NO: 61726 - DNA, 1434 bp, Oryza sativa
tactctctccggcctaaaatatagatagcaatgtactagatgtgacacatcttagtacaacgaatctggacagggtagaatgtatcacatctagtatatagttgttatattatgtatatagttgttatattttgagacggagggagtagttcgcaccactcgatggaagacatttcaaccggccagttccgctgttccgtgtcagtgaagataagctagtatagccagctagctagctctctccaaccctataattaccacccgaacgatctcgccaacaagcggccggcagctcgatcgatatatcacagccaacaagcggcagctcgatcgatcgatatatcacaatggttaggctcgccgtggacgccggccttggccgaggcttcgccggcggcggcggcggcggctccgtgcccgacatgagcaggagtgttgtcggcattgcgctggtcttcgtggcgaccgtagcgatcgtggcgttcgtcgtgtttaactgcgccgatggcatggatagctccggtggacggaagcggctcaccaatccaggaggcggtactgttggcgttggcgccgtctgtggaggtagtgcttgcggtggccccgcctgtggaggtggtggaggtggcggtggcggtggcggtggttgcggcggcggcggtggaggtggctgttaataaaggaacagagcatatggaggagagagatagcggtgtaggtgatggaatttcatgtcctttgatctacacaccagtttgattttgctttgcagtgtttttcatttacatcagtcgtgaaataacaaaccctttggtaattctgcttatgtatcattatgggcctattcactttgataccactttcaaccttactaaattttggtattgtcaaaattttgtgataattaccaaaatttgacagaaaactaaatgtagatattttttttggtaactttaccaaaatttgataatgttaaaaatgacatcaaagtgaatagacctcctatatatatataaacatcgtcttacgtgtttatatgtattatattaccaacaaacacccataaattcttttgaaacggtggcttccaaagaaggcgtattatttttaggtcagaatgggagtttagtgtaggtccggcctataattattgggccgaaacgggactcctatctacgtggtgctcatacaagttgggccagaatggattcccttccacttgtaggcttgcagcccatctttttgggctgggatggaattccgatcttcgtgcagcctagtagttaggccggcgtgcaggccattcttcttgggccagggcgtaacgaggagaactatcagaaaaggatgggccaggccgaccatctcatccttttcagcccatgttaaaaataatggtacagaacttcgtttcggccttgtttacggagataa

SEQ ID NO: 61727 - DNA, 2042 bp, Oryza sativa
tcttgctctctttacgtccacgttcatttcatgcatagaagcgtccttgtgtacaatgccgcaactagggtccttcatataggggatatgcatgccctcaacaggtcctccacgtggacctagttagtgtataaatcattggtagtgcgtcacattgtcttgatgcgcagtgcaggtctgtatgcccgattcaataatatagatggtggtacagcttttcagtccggacatcaagcgccggtcacaccatccctcacccatgatagttcgcgctttggacactacggtcaaaccggcccactcttagggctccgagtattctatggagttttgagctgtctctccttctctaatcgtagctacctattttgggtagtttgacatgccctcgggccgatctgataacatatgtgaatctgcaagcatacaacatgtttttggccgaagaacaataattcagccagggaccatagttcatcgtaagggtcgcgactacccttaaatatttattggtggcccgcatccccttaccgccagcgaagatacaataccttcactggtgtgagcttaagagagccgcaagagaagatatcctatcttcgctggcggccttcttaagtagaccgctagcgaagatgtgtttccgctagcggcccttgaccccccaccctcaagattttctgcgctggcggtttttctacgtggccgccatgaaaaatattttccaaacgccatgaaaaatcaattttctagtagtgagtacaacactgcccatggtatgggagtgagctgcaccaggaatatgcatgcttggtttggttggtcagttaggatcatgcacaaaagaatggtacccacttccattatctaggaacaacaaggaatattcccatagcttctgtatttttggaaacgccaactcagtagaagctagaatgttgacatgtgggttcaagagtatttttgacatttcatgcggtttctctctcctattcaaccgaaaattattattttaatgagcgtggtgttcaccagcaaatatcacatatttgagagggtattctatcaaaagtcacttggcgcgatatcctacagcaaaaaccatgaaattgcgatgttctgtagtaaaatttgccatcatataaatacatatacgcggcctccgagagatcaaatgagaatccttaccgaaaaagttaaacatatgtgaacaatttcactcctatttttctcttagactcatccagatacgttaccggatccacttgttttttttcgtagtggaaatgaattggccacctggacgtgcatgatcaacgctgtgaatggtggttcgctcaaaacgagtggtgttggccggcacaccaaggccacacatttcccgaactctccttcgccaccaacagggatgctagaccagcggatctctgagcagcaacacatcaccattcgacacggcacgggcttactgctgttttcatggagctaatcgaggtacggtggtgctttgacgaggtgtgttggaaggtcttagatccaatgcttcattcttctgctgcttgttgtcaactgtttcacttttcctcttttgcaataggtgaccgctcgctgctcataactactttgttctagtatatcacaattcacaagtgaagcattgaagctacaatataatagtatattcggattagttttattgtagaacttcatgtcttttcctattatgtattttttattttatctcttatatatacccttgtaagtcgtatgggaagtggtgacgtcctcattgttactcctctatgtttgtaatcacactactacaaaacatcaaatatgtgccgccactataggtgccggtagtgctcataaaaccggcacctataggcattttcccatctccgcgggttgaaatcgtaaaaaaccggcaccattaagtaattataggtgtcggttctaataaaaaccagcacctattatattttgtatcgtttttttaaacacacgccccttttaatatttaaagggtgccggtttcctaa

SEQ ID NO: 61728 - DNA, 5639 bp, Oryza sativa
gggggggggtgacgaaccgaggggcgcggtcgtagtggcgcggagctagcagcgagactggactggaggcggacggccacgaccccgacgaccccgggcggcgcaccacaaacagcggtggagagagggcagggctagtgtgattttatatctcaggctagactcgcttgagctgtcttacattagtgtctttactttcgtttcgctaaccgcccaaaagcaggtgcgcacacacaaatgctaggcgagatgaggtcgggcggcagtgatggagctccatggggatcttgagccaccgagccacagcgcgcctgccttcacccgagcaagacgccaagacccgcgtgggagggaggggacgtcggatcggacgcacattcagtgacattccccgtgacattctcggtgacattgactcaccgacacgtgggacccacatgtgtctggatccacgtgggtcccacacgtcagtgactcaatgtcacggggaatgtcaccggagcaatgtcaccgaatctcaatcccatcggatccgccatcgcgccgcctttagctgcgccggatccgcctcgctgcgaccagatccaccgccgcctcgccgagcctccagtcacccaccaccaccgcgcccgctaatgccgcgcccatcgccgttcggcggtggcggaggtggagccgccgcgcctcccgcccgccgacgccgcgcccgtagtcacttgttgccccgaaccgctactgccgccgctccttctcaccgcatgacaaactgcatgcctccgccggatccgtaaaaagtggagagggaggggaaagtgagtggacggttagattcaataataagctatttactccgtaaatgtaggagagggaggggcgcagcccgcaggtgggcttttgggggaggggtggggggtaggcggggagggggtgggatgtgagaggaagcgttttagttattacgcaccccaggtacggtatagtatgtgtgtgtctatatatatatatatcactattataaaaattgaatatgtttttgtcgggattttggtacgtcatccgtgttagaaacggttttaattttatgtttcagttttaatctatatctatatctctataaaaacaatttccgtcttctgtaaaaaaagaaagataaaagtccgactaaaaaagaggtaaaaaaagaaagaaaaaaatgtccgactcaatgagcgattaaaaaaaaaaaaagcttccgtcgtcctcagtaaaaaaaagagaaaaaaaccatctcttgtccgactcccatacaaaaaggaaaaaaaatctcccagtaaaaaacgaaaaagtctgtttgttttttttcaccggtatttttttttccttttttctttttctttgcacgcaaaagagttttctacgttttctctttgcacacaaaagagtttttttatgcgcacacgctaaggcttttggttttttttaatccgatcggttcaccgtgcacctcccgtgcgcttttagttttttcgtcaatctttgttgtcatcggtttttctcccgtgcgcttttttttttcttatctggttttataatcccatatgttcaccgccgttatatcgatcgtgcgttttctcccccaatttgatttcaaaaatcaattccccactcctctctcatcattttctctatgattttcccttcgattcggctttaattgccggatttaatctctgttttatagttaccgatgatgacggtgatcttccccggtcatttttatcccgagttttatgctctgattcagggaaaacggaaggagtagctcaagtggataaaaaccctcgactaattttggctgaccaagaaagatttagccaaatttgatggggatattttctctggcaaacgtacgggcgcggacacgggattatcttcgggagattgaagatggtagtcatagtcgggaagttgaaggtagttgggtcgaagagaagaacaccaaatgaaggaaggtagcggactagcgtagggctgacaaggaagaaaggctttcggctgaaaacccaggaaatattttcattaccttttcttaattataatttatagcgatcccaatattaagatttttattaaccttttcaattatagtgtatactgaatatccaaatatttcagctgtgtttagatttcaacttttccgtcacatcaaatgtttggacacatgtatggagcatcaaatgtggaaaaaaaaagaaaaactaattgtacaatccgactgtaaatcgcgagacgaatcttttgagcctaattacattatgattagccataagtgctacagtaacccacatgacggattaattgggctcaaaaaattcgtctcgcagtttacagtcggaatctgtaatttgttttgttattagtctacgtttaatactttaaatgtgtgtcaaaaaaaaattggccaaatttttacagcatctaaccacggccttcaatttgttactcgactcttagtatatcattgaaaaaagtctttacccgttgcaacgcacgggcaacttttatttgataatgtgtttgtttgagcgtccgtttctatactatgggcctgtttggtagagctccaactccaaaatttaattacatgagttaggtctggagtcaagttgtggagctgcccaaaccctactccacctctctagttaattttgtgagagctccatccagttccactcccattttaggtggagctgaaactgtttggctgacatctaactctaggagaggtggaggttgagctggagctgtgccaaataggccctatatttcattgacaaaattaaatgccttgtggcttgtacaacctaaccatcacacatataatcgtggcttgtgcaaccaaaccatcacacatataatcatcctcaccatcctacccatcagagattatttatagctttttgccaccacatgtagccaccactaagacaaataataatatctggccaccaccataatatatatatttccgggtgaacagatattgtcacacctgaaaatacggcatcgtcttcacatgctctgaacttaggcatatgcctagcactagtacacgattgattttcctggacgctgcccccttttatttccatgcgattggtaagtaaaaccgcacgagaaaatcgaaaaccggtgccaagctaacgcctgcacgagaaaatcgattttcccgtgcggtcccgcacaagaggaccgcacgggaaaataaacagattttcccatgcggtaatatcctcttttcccacttatccacatcgaaatttcctcggtaccctccctctcctttattctctcacgtgtcacgtgttaaagcagacagcgatgtgtcaggcctcatatcctctcctcactcctccctcctctcctccctcagcgacagcgacgagacagcgtgcggtgggcataggcgactgcggtggtgcgcggcgacagcgtcggcagcgcgcatctgccgtggaagcacgggatatggtgggcagcggcgacgacgaggtggcacgcgacggctgcgtccgatccagcggtggccaccccacgcgcggatccggaggcggcggccacccccacgaggattcggctgcatgacggcggcggcggccatggcaacggccgccccccgcgtggatccagcggcggcaaccgccccacgcgcggatccggcggcggcggccctgtgccccccacggatccggtgacggcgtccgcccctcgcacggatccggcggcggctgccgcccctcgcgtggatccagttgcgctacggcggcggcagccgccccccgcgtggatccggcggcggcgtccacccccgcgcggatccggcggcgcgacggcggaggcggtcgccccacgcacggatccggcagcggcggccaccccacgcgtggatccggaggcgcgacggtggcggcggccgccccccgcgcggatccggcggcggcgacgggagcgcgacgacggcggcatggccacggcaacggcgacgacgacgggaaggcggcgatggtggcgacgggtagggttagggtttcgttttttcaattttgtttttttttcgattttttgtttttgcgtgcgccacccgcacgcaaaaatattgattttcgtagacgaattgctccagacgggctgaagctgcacacgtgaaaatccaaatcaacagcacgggaaacgatctgtgtagtagtgtagtctccttgaggaagatatatttagtacaatcctatactactagcaacaagattcatgacgattgagcaagatttagtacaaccctacaagcaagccagacatgtacaactagaatatgcaaataatgcacatggcaagttaaaacaaaaaatgcacaagacacaagtaaagtaaggcacatgcatgggtgattttgcgtaagggatcgaatagttttcaacaattcaagacttctacaatgcagatcagtttcaaacacatagtctaacctagctaataagtcataattcaataacattatcttggtagtgtttggtttggggacagggtgggatgggttaggtccatccctgttttttggaatgggatgatcttgttttttgtttggttacagggatggaacgagcactgttttttgtttggtttgaggtatataatgggatggaatgatcctatacattgtttggatggagggatgaaggtgggatgcttgatagggttacctattgatattagttggtgaggttaccctcaactagtcatgaataccacacagtgcaaaataatacttactcatgaacaccacactatttgaaaatgaccattgtgaatctgttcgcaaacaatatagctccataggttattaaaaagatttaataaaacttcatgtatgccgatactaattgctgcaacagtaggcttcacagggcacatataatacaagccacccataataatagcaaattttagtcttacacatattagcaaccgaaggtcttacacataatagcacattttaattcttgcacatgatagcaattttaagtctagtaagttctctgcctcaaacatattggcagtttaaagtcttacatataataggtaaataagccaaccaacaacacataacaccaaaagaactatccaactcatccaagaagcctatgttgatccagggaacttttcactaatgaacatagcaaaccaatgcatcttgttttcaaatggaagtccatcgaatgctctagcaatatgagggttggcaaccaaatgagcatagtaaaatgatctatggacctcctcaaaaccaggaagggttttcaatgtgtcaaataaaccttctggaagcttattgtccggctcggcgacctttagtatagcagaggcaagcttgtcaccaacactagtgaatgcaccaatcagcccgtcatcttcattctcttgtgtttttgctttctttggcttacttgcagatgatgcctccgcacgatcatcagtagtggcaggaccatcattttcttcatcattgtcatcttggacatcctctgttcctaggactgaacttgagtcctttgcatactttcctgtagtgatgaactacatgctgacgatgccaatctacttctctc

SEQ ID NO: 61729 - DNA, 4514 bp, Oryza sativa
gtgcgtgttttgcagcgagattttgcgttgggggtagctttgtcctggcatgcatgaaagcaaccactcgggtcgacgagacttgctactgttgggaggcttgcattgcatgcatgtgcgatgggacgcggcttttgtgtgtctctctgcgtgggctccatcgtcaccgcccccggccccagcagtggcagagaagggcgtacgtacgctgctgctgggtctgggtgtgtgtgcagggatggtttgccacgatcgtgcaaccccgcagccagcccagcgcagctacgtgcatgcatgcgtcgttgcatctcatgcgtcgtcgtctgcttcttccttggttcgatcgatagctccgatcctataattaattgcagcattttaattttgatgtatatatcagcgtccaatctacatatgtatggattgttaatttcctgtctacaacttaacgactagcaactatatatatatatatatatatatatatatatatatatatataacaaattgagacagtctcagcatgtgtgtacgtccacgtacatgcatttgattaagacgtcgacctcacataaaagtccatctcacagatatatatatgccgaggatctagctagttagtaactacgagcactacattattcatgatatttaagagccaatggcatgtcatatgtgtgtgtagctactatcttggtacacgacagctaaagatcttgacatttggtagctaaggtggtactacgcattcatgtccaattgtaagctgattcactcatcatctttgatccggcccatggatcccaatcaccaacgttttataacacttttttaagtactagaaaccgagaattatcaagaaaaaaaaacccctactggcctactccgcatatctaagatcatttgggagtcgactatttatgtttagtacattttgagttaattaattaagctcgttgaattgactcgactaaactttctattaattgtttatgcctgtatcccaaataaaagaagacaatctctatatgtttcatattatttatcatcctagcatttattttttttaatcaaaatatttttcattcttgcattccaagtttccaacataattttagaggtgaacttcccctctctacccttcacgaatgcagtcacaactcttattagcttatttgctttggaaaaactaatgggatgtacttataatgagagtaacaatgtaaactaccatatatcaattggtttgtgtgaggtttgctagaatgataagtactccgtccgtcactaaaagagcgtagttttagcgagtccactactgaaaaactgatctctgctcagtcgccctaaaaccacaatagtcccggttataaaaagaaccgggactaaagatgatttttagtcccagtttaaaaccccatagccattctacgatctttagttccgattggtaataccaaccggaactaaagatcatcccatgtcagtcccttattagaggggcagggatctttagttccggttggtgtcacaaaccgggactaaagatcacactttagtcccggttggtattattaaccgggactaaagatctcctatatctcacgcgtagtatataatccctattccctattctctcccccacaaccggcctcaatctcctcaacaaccgacctctcctctcctcagatccatcgccctctcctcctcccctcctccccttcctcctcccatcccgaccctctcctccccctcctcccttcccgcacgtgtcaggcggggccctgcccggcggggccgcacgcaggccgcgcacgggccgagtagcgagcggcagcaggcggcgctaccggcatccattctttttttctttttttataatttgtgattcactgagatgtataattttgtgatttgttgtatggatctgatatgtataatatgtgatgtatttggtttgtgtgtaatctttttaagatttgtgatgtatttgatttgtgtgtacaagtaacttaagatttgtgatgtgaatgttttgggatgttactttgatttggggtttgatttgggaatatgcatcccactcgatttgggagaaaatacagggattaactctggctaaaaaataacgaaaaaaaagaaagaaaaggagacctaatgggactgccgctacccgctctttagtccctgttggtaacaccaaccgggaataaagataggtatctttagtcccggttatttcacccgggactaaagatagcgatctttagtcccggattcgtagtcccggttggataaccgggactaaaggggggttacgaaccgggagtacaaagggtttctccactagtggtcaaaaaaagattaagcaagagatataaaagactactatgtcgtttattaatgctgagagaaaggccctgtttagatttcaacttttttctttaaacttctaatttttccgtcacatcgaacttttctacacaaacaaacttttaactttttcgtcatattgtttcaatttcttcaaactactaattttgatgtggaattaaacacagccaaagtaagaagggaaaaaacaaagaggaggagggagtaacgacaagaaaaaaaaataaagtactgaagtattaagaggtttactggacccactttaaagatatggacagagagtaaatgagtaggagtataattcagtagttttcatatatgggattatgggttgcctccaagtcgaacccaaataagatggactaattggataattacccatctgtagtaggaggctggtgattaattcacaacttatgtcttgttgacttgtggatcctccagctctagattgaagcttattgccatggcgcaatgaatgaaagggggtttgagcaccgagcccccagtaggtccggcactgttgttcatttctgatgaacatatgaatggattaattatgcgtacgctttctaaacttttgaacatatgatttttaagaaaattatatatatatatatatatatatttaaattcatttttttaattttataatagataattcattcattgttcatttaaataattatcacacattattcaccagccattcaacataaaagaacagggaagaagaagcaactatatggattgtgtccccctgatgataatagatactatgtactctctagcccgatatttaattataaagggggtgatctataggtgcaaatgaagatggtgacctggtatgatcaatgtggacaagtgggacataatcataaaaaggagtccagatactgaccaatgcaaatgctgcgtcagagattgtgatagatggagggccagatcgagtcatgaccgggctgtgcatgctactagctattactcaaggagtactgatccagtagtactacatgggaaggaattaggaataacaggcagcataaggcctcaatgacatgaaaatcttgtatgatgtattaatttgggtgtaagatcactgatcacaatgacctgttaaagttaaacacctatttctctgaaagtttctcgaaaacgtgtggggttgctgcatataaatccaccactgtctcgtcctgctctgctcactttcaggacgtgtccttggtgatcaaaatttcaacaatatatctacatattgcccatatcaccatctgcatgattgaaaccttggtaaattttaattttacttgtgttcagttgatcagttcacatgtgtctgtaccagtgaaatggagtaaaagagtgacagtacccggccgatcgatatgatatgatcgagccgctcgcggtcccctacatatcgatctatctatctatctatcgcacaaaagctgccgaaaattgaaacaattattgggatgataggaccagcaatgtaagctgcatcagaggcgagattgatcggttgatcagagggcgatatgtttgcgccgattgattcgagattttgtggacttcaagggggttttcctgtgctgtgctgccttttcgctcattcgaatcagagcagctgcaacgcatgcatgcgcttctgaaacctgcaaacgcctgaccctcaatgctcaatgcaactttgagtatattatcgtgcacgtggacggcacagcgatcccaatcaggttttggtggatagagtttgtctcattcgatccaatttatggctctgtaaatgctgtttttgcagagaaaaattcagttcattgttttccctgaatcacttaattaattaatctcgtagaggtatattggaaaaaaaacaaagaaaaaaaaggtaggagatcgatcaagaaggatgggcggcgaaaggtcagatttattcggatttaattcgttttgaaaattgtgcaagaccggcttgaaaaacaactctcagctacaaggaaaatcttcacgtcctttaacacttattgaaatcaatatgttttgacaagttatgtaagtgagaaatcgattaatcaatgcgatgttgtacatcatgtggaagaaattgccct

SEQ ID NO: 61730 - DNA, 9226 bp, Oryza sativa
tgggtaggggggcatgtgaggggagcattttagttattacgcaccctggatatttttttaaacaatcataattttacaaaacaaagaatctaccgtcatataacaaagaaacttcctttcaaatattgcactattttaaaataaattttacacatttatattctgtacctattaaacgcactcaagccgccaagtgatgctctaataaaatagagaaaatcctagaaattctaagaaaaaaacaaaacatctaccccttgattttcacttaaattggtgagtccaatattatacaccattagatatatcgatcttaaaacaaactaaatatcatgggtcccacctatcctcctcccgcgcgttggtaggtggcaggtggagtatatacgtacgtacatgtatgtatgcttcctttcttttcctttttttcctttttacatttatatatatataatggatatattttttaaataatcataattttacaaaacaaagaatctaccatcatataacaaagaatcttcctttcaaataatgcactattttaaaataaattttacacaattatattgatatgtacctattaaataaacaatatctatattaattaatttatacatgcacataaactgatggccccattacataaatcatcagatctacttttcattaccttggtctattattcactgtttcaaaataaggtctacaccattatattgtgtacccattaaattaacaatttaaaatctatattaactaatttaacttacactagaactggtggacttattattataatcatcggatctattgtttgctaataaataaagtgtccgaaattctctttttgcccgctgcacaatacacgtctgcacctttgcctttcccatgtgtgacaaagtgtagtgtctgagacatataaggtgatcacaaccgctgtaaagcttccaccttgccacaaatcaaatcatatatggagatgattaattttgttataacatgaaaagaaaattaaatgtgtgatgcagtgagagaataattaagtaccatggattgtgtttttctcaacactaattagctctatttaaattgaaaccgagagttgattacataataattataatgtatctgtgttatgtcgtatttggattttgtactatttgttcgtataggtgaaaggaatcattatgttataaatatgagcgcaatattgacgaatattaatagaactcttactacgacaagggtgataaagggagtttaaggccctctctttttttcccgattccatattttggaattttgtttgcatgctttctaagtttctaaatagtgccttctttaaattaacaacattctaactttttagaagtcaattcattcatttataccctcaaaaaaaatatcacataaattatataattcatcaatttcaaaaaaactatcacataaattatataattcatcaatttcagctatcctaaaccttaagtactacatattttttttcatgcgagtcatggtgataaattattaaagtcgtaagatgaatatgtaagagttactctgaacaattgtaaataggtgtcaaaattaattgctattaattagacatctaatggcttgcaagccacaaaattaatttcactctacatgtatataatcatggacgaagctggaacaaatattaccatatgtcccatacatatatattgcacagttaatattctaattacatgtgttaagtcatttaaaatttcttaaaatgctctcaagctgcgacgtggtgctctaataaattagggaaaatattagaaattctaagaaaaaaacaaagtatctatttcttgattttcacttaaatcggtaggtccaatattacaaaccgttagattaaattgatcttagaacaaactaaatagtacgaggtcccatctctcctcccgcggcataggtacgcacctacgtgcatgggtacgtacgcttcccctccctttttcattttttctccttcttcctttttttcccatgcatatgcttccctctctttattactatatcatgcgccttcatgagacgatttaatcaaaagaattttgagtatcttgcactcgtatttttcatttgcggtcgtactacacggtatgcgtatagatggattatatgataattaactagcaatagttttttatttactcgagaaaaaagaaacatgattcaaaaatcgtaagtacttaatccatctcctacttaagtttgtgaatggttttttaagatacgttaagaaaaatagaacccttaaattattataaaataacattatccaaactttagtttgcccttaatctatgagacaaaatttctgaacaaacaataatcttaccttttaataatataagtgcccgcgcatacgcgcgagccaccttcctagttgcaaaaaaagttgcatgatagattctgttccaaacttctcctgtcacaattctatgctgatgtgaattggatgctgtggatttgtgactggaaggagcaataacaatttgaaatttttatctgagctgaaattatgctacattgtcccttgcagccctgtaaaagatgaaaggttaggggacatcggaacagttctgaagaagaataatgtttctcttgatgttgttgaatttggtgaatctgaaaactagaagctcttgttgctgcagttggtggcaacagccacatagttcacatcccacctggggaagatctttgtgtcgtcctttcgaagtgaacatctattatgttatctgctggttcttacccaaattcctagtgctagaatatgctatcactaatcagtaataaccctattcctttcaaaggtcaccaataattactggagatgaaggagggggtgctgcgttactatccttattgagatcacctctgctgtcaaaaaaggattatgaggtagattacaagaaggaggcggaatctacctcagatacacctactgacaatgagaaggcaaaggtatgctactgcgttactatccttattgagatcactggctttctttgtgcacaagtttaactactatcagatcatgaactctgtgactgcagaattccatcagggatatatttgtatttgtggtattgtctatctgtttattgcttcggagcacccatccctcaaaatatcccaaatcactgttcacccttgtaagttagtgcctatagctacacactatgaacttcactaacttaactgcccttgggagtggtagtcctgtcctgtctagtattctccaggacaaaaaaaaaaaaaaacaacaacaacaactccagcaacaatctatttccatgtcaatttttagtaaatagtaactgaattatatgaatatgaataaacaggaactgcatttagacttgtaatcttggatctgtttagaattttatattaacattttcttatctgggaacttaattttcttttgaggctggccttgaatgtgttgctaggaacctgagccacttcctcatttgttttcttcaccttctaacgatgcaagttgtcttgaaaaaagatcggaatgatcatgatactaaccatcattatttgattgcttttgtgctattttagtggcactgtggcaggacaacgttaacagtgtaattggtgagataactataaatattattatcaatgatttttaagctttgaaatctataacatatggttatcaccatctttgtaatatgcaaaatgtagtaacactaagtcaggattacttttatggcttccttgccttttattttttagataatggaagctttattaagactcagttaaatacatcaagatgatacattccaactgagtccacccggggcctctgcatagaatgcacacagccaaaacactggatctaagaagacttccccatcacaaaacacaaaaactagtggctatcaatccatagactagatcgccacccatgctcctgggtaaaaaattcttgtaccacctagtccaactgttgcaataccaccgcaatagtatcccgaagtcccggtttgtggaggatggcccaggtgcgtagccaccgggtgactaaagtagtaacctgcaaaggagaagacaacactttgttataaaaaattaccccgtttctgcttagccatatggaccaacaaagagacgttgcacacatcaaaagcagatttctcatgtctttaggaacacaagtaacccaatgcccaaacaagtgagtaatattttgaggaggttgtatgttcgaagccatatgaacaacataccataccaagcgagaaacactacattgaaagaacaaatgttgaatggtctcttccttgtgacaaaagcaacattttttactacctttccagtttcgcttggctaggttatccttggttagtattactccccgacgtaagtaccataggaaaatcttaactttgagcggtatttttaccttctaaatacgtctattgatatttgggatcttttgtgtgttgtgaggttggtggtgtaattttgttttatcttctattggtcgttacaatgttatcaaacaagctagttatttatgtcatgcatgaagaagggctccatacgatacaagaagctctttcaaggtttgaaaatgcagaacatgcaggaatatccgacgattcctcatccgggcaggagttggaattaggttagttattggcttatactacgtattttctgattttacaatatcgttttcctcttcagccttgctctcttggtgctatatacgttggaatacgcgtaggctacgatagcataatcaaaatttttctactgcgtaaacctggtgtttacacccaaatttggcacctatgaacgaaataggggaaaattggcaaagtttggaaagtgacgggtttacttactcgagaaggcaggtttcgtgtttcctttggtttctatcccgagttggatgtggagaagggcctgtagagggcaagaccaacccctatttaagggacaaggccggttcattgtaaaaccctccgaatacaatatacttgaatcgttcttttactatgttttctattttaccctagtttagtccatctttgtcggtttgcgccgtaaaccgtccaccgccgctgcgagagtgcgacacccctttgtaggtttgtcctgaaaaccttctgttttgcccacgagacgggtagttatcctcatatcgacttaaatcggcctagaggctgattttgatctctaaatcggctccgctagctggtttatcttttctttttgtaaagcccatcttgatttggccctttggctagatcgaggtggttagcgactccatatcaccgcaaggcgtttaggtgttgcgatcgtgcttgtcgacttgtcaaaaaagttgccaacaccaggaaccatacaagtattagaccatagatcgttatcactcgacgtgcgaccctataggttcatgtacactcggctgtaacctgaaaactccttttcggtccacgtgtcaacaacggcccctagcagaacgtattgaccaccgggcatacataaagattatatcgcctaaacctctagtgcatacttgtatgaactcctttgcctcacgatatcgattaagctcaaggctagatatgtgccatcctctattagctcaatcattcactcgaacctatgatagattatataacttgtgatagactcatcaatcacctttggcatggccatgcacttccataatctatgacatcgaggggcccagagatatctctccataggaggggcaaatcccatcttgattattcatatcccattacatgtttcatagcataccccaaaactacttttatagctacccaattacggagtagcgtttagcagtccctaagtaagctactacaaatgttgggaaccatgataatctcgggtctaagaattcaacaccaacactaaatgagatcactgatgacacaacacatatggctcttgcagtgtctcatgttgggtctatccaacaacatgttccccaacatgtgtccacattatcaatttggtatctctataccataatgcatgagacatgatcatcaattaatacatgtgctgatcatttaaacattttttgttccacatattatatttgatcagggatcctttagaaatagtaacatacaacataaagagtctcatgaaagaatcacatattcattaaccaataatgagttatctatttcaaggaacaatgttggataaatatgaaaacatagtatgtgataacaatcatctctatgattgcttctagggcatatcaccaacaatatattgagcaagaagtgaggagatttactaccatcttctttctctcctctctcttctcttcttgcactcagctctcgtcctctcctgtgctatatatctgcctcctttcgttccgattctacttcagcaagatttcagtcttgagtgcttcagtagattattctgttcacattgcctgagtgacgtatgtgggctctgctgcccagagcacgtgcccacccaccatgccgacgggaatgccgtcgttattgaggtgagtggatcaagagcgcttcttgtcttcaatttactctttcttgcttctgaattgaccttttttgctttcttagaaggtacatatggtggaaggttcctctgctctaagccaccacacggtcaggagtaatggacttggctataactggataaaaatacggagagtagactatcaagataatacgtgggtcatgatcggacaaggccgaccaagaagcactcgctctagcatgagagggtaatgcaagggatgtcatggtcttatttctctgaggaatgaatattgtagccctgcatgcaaggtaataccaacacagatgatttctatcgcagtattcttgttattgagttgaacactaacgaattgcagttcagtttttgccggaaaaaataatttgcattgtctatcgcattattcttgtgattgagtcccaaatttcagtttcattggttgaagttattgttgagtctacagaggagtcataaattaaatttccattgtatgacactgacagattgttgtttgctttaagtaatggttgtataaacctgccgtagcaggaacataatgcaaagccttgtgagcattgacttccatggttcacataccagagatagattctgtaccatttgtttgagagcattttcatctgaaaggtgtctagaccactcaatgcatcatcctgttgctgagcaaccgaacgtttatgtccttcacgttattcgacgtgatggatggcttctgataccatatcaacaactaccttcagacatgataattgggattagggtaagtacccttctaatgctatttgtgcttgaaattgagataacttctactattgtatgtatgactaaaattgatatttgctaattatagaaggtacaactcgaggatggaagttttggtgtaccactaaggccacgtctacccccaattcaagatggagaatacatatgtagcagattggattgtgaagagggggtccaatttgctgctgacatatgtagcattttgtgcaagcatcatgtcccagattaggacgtcaaatcactgatgatgaaggacaacattaacattctcgggacttatcacaagctgtttatctgattacaacaagatatataatttctctctttactctttaccgtcaggaattagcattgtgtgcaaatacatactcaacttttgaaattctgaatccaaatacatacatttcaatactattaaacatttcaatactattaaaagcacatccttgaacagatccagtgcaatctcaggccaactctcgtgagggtatgtttgagaaaacttattgtaatagatgcaagaatgttggtcacctaaatagagattgtgttgcttttgtgttttgattaactgccaacacataatactgaggactgcatctttgataaacaacctagacccataggaaaacttgtgggatatggagctcctgggttatattgcatcatgattcagaataccaaacctatctctttaatggaacactctcaatcatttctgatggagagatgtccgatcctatggcttatatcaatcatttctggtggggagctagacatggaagatttcccaataggttgagatttgaggagctctctaattttgatcatttcactgtaaaatggactaatgtgtatgagagaatggatttcccaataggttgagatttgagtagctctctaattatcatttcactgtgaaagggagaatggacacaacaatgctgtgcatttagtttgggttaatgtgggtggaatccctaacgagatgaaaaattaccaagctctttttaaaatagattcaaatttggggctggtaatggaagtaggtttaaatttggggccagtaatgaaagtagatatgaagctagcaataccattagagtcaaagtaggaatgatggagttgggtgtgctagctttgaagttggtgcttacaaccctaaaaggttttttttgtattaatctgtttttactctgaatgaagtgttagaaaaaggatggttcaaggatgaatgttttgaggagggacatacataaaggaacttcaaacataagacagaattagagagaaggtaagcagccagtcaatgaggagaataagagagaagacaagcagccagtcaataaggattgtgacatggatgcaagaagtctcagagtatatatatgtcagggagggaggttacttgcgagtctgttccagaactgatgaacaaataaacagtgaaagtgtgtgagatcttcagacaagagtggctatagattgtaaaagcataacataaggagcagtcagaaagtttgaatagacagaagatgactgaaagatcccatatgcaagataaaatggaaacacatggtagatgcatgatgggtaaggaattcagtcacaggacatggtgagaaaaaggttctgacatgcaggagacacacaaggatataaatattgaggttagtgtgcaaatgaggaagacagagaaaaggtagattttggggagagtgaggtgtttcttgatttacaagattctgaatataaaactaactctgaacatttctggcagtagtagaaagaaaaacaaaagagaaaaccttgaaattat

SEQ ID NO: 61731 - DNA, 31035 bp, Oryza sativa
gacaacgccattgaccaggggatcatccgccaagcatttgactttaacacttgtaaggtgctcacatgtaaatgatctttcttcaagctcgccaatcattctttgtgatgtttttccccaacgatgctatatataccaagaaaaacaggtaagctatattctcctgatgacatgtgtgcttgctaaaaatctttcaagttggatcagtatacatttagagggaaagatttaccttttcaagttccagatttagcttctccagtattggtgagttccgaagaaaaacaattaatccatagaaatttgcatccagacaccattgaccaagagtcaagctgacaagattgatgaattttggataccgttgcaaattgttttcaattgtcagctgcacaatattgaaatgactatgttgcagaaggccatttataaacatgattacctaaattagaaacttgaaaacaaaattcagagcactaacattatgcaataagtattatatttgcggtgcaggtacaactataacttcaacatagcggatcataaaagaccactagaaaaagaaattgcgtcaacaaagaatcagaataaacaatgctacacttgtttggtctcaatgaatctctttagcacgtgtggattaacagtcaagatgcttcagatgcaagttaattaggtagctacatcagcttaaacacaatgctatgtcaaaaattttaaacacaacgcgaatctatagtgaggtagcagcaggagtaagactttcaattgctgaagcatatttatcttatttttcaattttatatttaataatgtcaattgaagttaagcaatcacttagatttctgaaaagaagaattttcagtggccaacccaatattgcagccacacaagaacatgccagttaccaaatgggaaatggtccactttcattgtgaaatctaacagcgaactaagataattcaggtctgcttgaccaaaagtcttatttatgtataaatgagctgaatacaatgaaatagattgcattggatggttgatggcatcagtcatgatttcatgacataagaattggttatgccacgcttagttgtgccggtacaggtaactaatatagtggaattgtgaagtgtcaagaagaaacagcgtgcttaagttttattatttttcatatcaatacctatattaagatgcatgcatataataagggcaggggggatatatatctaagatcaattgcaatacctttttcccatcataatagaaatggcaggtcaaatttttagcagcagaaaggctcctgagattttggcagaaatcactagaggcttgttcgacatgaagtaccagcaatgaattcactagtaatggcatgttattgaacacaattgtgccgctcaaaggccaccacaaggaaaaaatggtaacactcggggtagaaatagtagtcttgtacttccaggggaaccaagtatcaatgatgctcaaaaccttcagtgtctgagaggagatgtgtcactatccacaatgatgcattcatctaaggagagattttccaacgatgggcagcctttctcgagttgcttgaagaaaccttgcttcatagcaacactaacgaagttgattgctgtgaggaagcggcaagcaaacgcagaatagtggtttagctccagtttaccagacaacacaacaatgtccagaactcgggcatatgcttctgcaaagcgtggctaatccatctgctcatatcttccgagttccgaggccgaggcaccttcgattctggtcaatctgtagaacttgaagcagaaggtgcgtatcgacgcggcggggtcgcgtagcttcagcactttgtcaaggaaactgttgaacgacaactccatcttttgatcatacttgataaagccggtttcgttccgcccaaactcatggatgtggatgttgatgcagggcacggtgcgtcagaggttgcgccaccgcgacagcacgcacgtccgcacggcctggcgcgtggtcaggaaggtcatgatgtggaggacgatgtcgtcggggagcgcgctgaaccagtccttgccatcggcgtgcgccggagccatggccgtgagcccgtgagcacacgcgcacgcccagaggcgtttcgtcgaacaggtggcgtgcgtggaaactgcacagtagaggaaaaacaaaatcaaagaatcaagaagccatgaatccgcggctcaaccgtgagcaaagatttgagaccgcggcgctcgagcagagattgaagattgaatccgtgaagaacatcgatagaagaaagatgcgagaagagatggagttgaaggtgatgggaggtgtacctcgaaatcgcgaatggtgttggcgtctcaagcgctcgattgactgcttgtttttgttgggacgctgggtgtatttgcggttttactttagtccctctgatggaagatggatggttcagattaacagaaaatggaggagatttccctttggaccgacaaccaacactttagttctttctttcttgcttgtctcaggtagttttgggtatactgtcgtggttaaatttttaacagtttctcctcaaaatatcgatgaaatttggccggctaatcctttgtcaacccggcaaaaaaaaaactttcaaaagtctagaacaacattattttgtgactataagaggaatggatactgtactcctataagaaacaatatttatgctaatggtgaaacgtcccatcgttggaccatcacgcctgcaacatatatatggtgtcatcccataggcatttgtagatcactatgggtcaatttggagaagcttatggaaattgcattttccctaaaatctttagctgctagaagctttctcaaacagtttagatttttatccaaattttgagaatttgtagttatggaatctagaaaatgaactaaaagtcaaaatctaggttgggtttcatagcttctctagattctcaccagctgtatatcaaaatcttaatctccacaaacaggtcttatgtctctctcaccacctactaactacaacaatgctacgatcagtcagcggcagaaccaaaatatttgcgggcctagggctgatttaacacgttagaaattatatattttattttttttatataatttctaaaagatttacatagagttttgaagcaagcatggtaactcaagccccttataactagtgtttgagccaacctattagctatatggtcggctggccccacaactatttcacaaacacccttgagagtcttaaaattttcatgtgtaaatccattaagatttgcataaatgatcccattaaaatgtgaagtattaatagtcggccccacatgacaaaaattcatggctccgccgtttgctatgacagcttcgctgaaaatcttatcagcttgctacgacagtttgcgacattttctttcaaagaatacaacgtgtgacgcagcagattccataacaatgtgtgcgagtgtgacagttttcattttcataacaaagatataactgcattaaaaaaaataacagttttgtgatgtttcttgttttccactgatataaaaattgttgcagctcgttgatatataaccatgttcattatttctagaaccacctaaaattaagatctcatgtgaacattagaagcatggaaggggatagagccagcagagtcataggagtgtaacatcatgtcagtaaaacataaaggccaaatagagtacccaagcatgtacatgcagacatgcagtatcttctgtacaacagaacatcacagaaggatgcaagtacaggaaccaatacatgattgcttctactgacatcatagcaccaaacaaaagcagtaaacatgtctatgtgctttctgactcaactggaatcaacgaatgtaactgcaagagagcgatttttgaatggaatgttcagagaatgcttgatcctttttgacgtttcatatctcctcagaccagaaaattgcaggtcacgcatactcgatctagcaccagcgtatgatctgaacctgagcagaggtcagtccactattaacaaagaagttgaccacatctttgaccaggggatcaccctccgagcatacaacttcgacgcgggtaaggtgctcacatgtaaatgatctatcttcaagcttgccaatgattctttccggcgtattctgatgatattatagaaagaaaacaaataagctacatccctgattgacatgtgtgtttgtgaaagatctctcgagaagggtcagtatacatatggatgaaacgatttaccttttcaagttccagagttagcttctccagttttggtgcgttctgaaggaagacaaccaatccatagaagttcgcatccaaacaccattgaccaagagtcaggctgacaagattgttgaattttgggtacaattgcaaattgttttccattgtcagctgcacgatactgaaatgattatgttgcaacagaaaacccttgccatgttatagacaaaatttccaacaaaacatgaaaacacaatccagcgcactaacattatgcgataaaagaccataatagcacatgcgatttaattgtcaggatgcttttgatgcaatttaagtagctacgccagtctaaacacaacacaaaaaactattgcaagactttcaacaattgcggagacatttccatttgtatgttgactttgaggttgtcttgattttcaaatttatgtgcagtaatgacaactgaaattagacaaacactcagatttctcaaaatatgaatatgaatcttcagttgacaacccaatattacagcgaacaagaacatgtcgagttaccaaatgggaaatgctccagtttcattgtgaaattgaatagccaacttagatagttcatgtctgcttgaccccaacagcttgatttatatacaaatgaactgactacacgaaatagctagattgcattgatgattgatgtcatcagtcatccttacaacacatcatgatttcacgcataagaattagttatgcaacgcttagttttgccggtgctattgtgaagtgtcaataagaaacaccatgcttgagtttttcctttttcatatcgacaactacattgagatgcatggatgtaataaggaaagggggatgtgtgagaccaataaccataccttcctcccaaaataatcgaactccaatcttttagcagcagaaaggctcctgagattttggcagaaatcactagagtcttgtacatcataaagtactagaattgaagtcactagtaatggcatgtcgttgaacacatatatgccgttcacaggcctccacaacttcagataagtaacactcggggtcgaaatagtagtcctgaacttataggagaactgagtgctcttgatggtcaaaaccttcagtgtcctggaggagatctcaacatccgcaacgatggattcatctaaaaagagattttccaatactggacaacccatctcgagttgctggaagaaacctggcatcataagaacattgatgaacttgattcttgtgaggtagcggcaggtaaacgcagagtgatcgagcttcaatgcgtcatacagcacgagaatatccagaacccagggctgcttctgcatagcgtgggtaatccatctgttcatatctgcctcgtccgaggtgccttcgaatccgtccaatctgcagcacctgaaccggaacgtgcgtatcggggcggccgggttgcggagctccagcaccctatccatgaacatcttgaatgccgactccctctcttgatcatactcttcccactcagtgtcgctccgctggaactcgccgacgtcggcgttgatgcagggcacggagcgccagaggttgagccaccgccgcgacagcacgcacgtctgcacagcctggcgcgtggtcaggaaagacatgatgttgaggatgacgtcgtccgggacgtcgctgaaccagtccccgtcgtcagtgtgcgctggggccgtgacccccctcctcttgctaggcgacccctccatggcggccgagcacgcgcgcagaggcgtttcgtcgaacaggtcgcgcgcgtagaaactgcacgagagaggaaaaccaagaatcaagaacccaacaacccgcagctcaactcccagcacaagaatcgagatcgtagcacaagaaacgacgctcgagaagaaattgattggtcagggaagaacatccagagaaggaggatcgatgcaagaagagttggaagccgtacctcgaaaccgctcgggcaggcgtttcgtcgaacaggtggagcgcgtgggaactgcacaagaccaaaagaatcaagaagccatgaatccacagcacaactccaagcaagatttgagatcgtaacacagcaaagcacactcgaggagagattgatccgtgaagaacattctaggggaggggatcgatgcatggagagatggaagggaggagggagctgtgtgtacctcgaaatgtcgaattcgcgattcgcctcgcgcgctccggggaaaggttcactgctccctcgatggaaacatgggcggttcaggttggataaatgtgtctgccggaatgaaatactctgtccggttaaataatatggactccgtttcacaacgcaagtcattctagcattttccgcattcaaatttattttaatgaatctagacagataataaatctagatagatatatatatctagattcattaatatcaatataaatatacgaaatgctaaaatgacttacatggtaaaacggaggaagtccttggagtaatgtggttatagaatctagtctactccataagtcccaaaaagatcccttatagaacaacgaatctgagctaccatttatccagatttgttagttttttttggacggagggagtatgtaattcctccatttcatattactaaatcattttgactttggtcaaaatcaaactactctaaatttaattaagtttataaataaatatagtagtatttattacaccaaataagtttcattgaatctataatcgaatatattttcatgatataattgttttcggttgaaaatgttagtatttttttttacaaatttgaccaaacttgaaacatatttactttgatcaaagttaaaaatgacttgtaatctgaagtagagcgagtagtcaataaataaattttgatcataatagttagggttaattggatccatgccactgcaactttaccaaattaaaaacatgccattactattcgttgtataggctacatgccactggaaatttctaaaattgaaaccatgccactcttgtcacgttttccgtctcctctctcatgtcgtttcttttcctccagtttaatcgtttcccctcatgtttcctctcctctcctctcctcttcttctcctctcctctcttccgaccaacctcccaccaccacaccgctcctcctcctcctgctgttgctgcaaccgtgctgccctcgagaaactaagtctttgatcaccgctggtaaacaacaaaccaaataaaaaacccttcttgcggtggtttctgggcagatctgagagagaacaaaaagtgattaggcagatccttttccgatggcttcttccccttccttttcctcctcctcctccccttccgccaccagtgccgcgccggcgtcctcctactactggtgctacagctgtgaccccttcgtgcacgctgcccctcacgaagactccatcgtcgcctgcccggactacggcggcgtcatcctcgaggagatgggtgtgcccccaccacgcaccgcctgccttcgccacccgcgcgcgcaccacaccaacgacctgcgcatgtgacggacacgctacgctgccgcagcagcggcggctagcgaccgctcgccattcaaccccgtcatcgtgcctcaccgctcccccgctgccgtagctgctggcgacgacgacggcgcgggctccggcctccgcccgctcccggagaccatgtcggacttcctcatgggctatgccttcgagcgtctcctcgactagctcacccagatcgaagtcggcggcctcgcccacatgagggagaacctaccggcctgcaaggcttccatccccatgccgcggggccgtccactcacctagctcaattgttggagaggagacagaaaaagtgacgggagtggcatggttccaattttagaaattttaagtggcatgtgactgatatgacgaatagtggtggtatttttttaatttggcaaagttgcagtggcatagatccaattaaccctttaaacaacatcaaatcaaatctaaaatcaagtttgaaaaatttaaaaatgtaacttataagcatacaaacataagtgaaactaatagggttatatatatatatatatatatatatatatatatatatatatatatatatatatatatatgtctccgttaccacctaatactactacagtgctacgacagcttcacccagaatctgataagccgatgccactgcatcgaattcttcaggtgaaactgcaccgccattacacgagtatctgaatcgacgatgttggtaccccatgtttctgaaattttggatcaaagaatacaatgtgtgacacagattccataaccatgtgtgtgacagtggtgtttcataacaaatatataattgtatgaaaaaattaacagttttgtgattttcttattttccactgatacaaaaaattgttgcagcttgttgatatataaccaattaaccatgcaggttacacatccttgatctacatccggcgtatgatatgaacctgagcagaggtcagtccactattaacaaagaaggtgaccacatctttgaccaggggatcatcctccgagcatacgatttcaacacgcgtaaggtgctcacatgtaaatgatctatcttcaatcttgccaatgattctttgtgttttttcctgataataatatagcaacaaaataaaataagctatattctcgattgacatgtgttcttgtgaaaaatctttcaagaaggatcagtagacatttgtaggaaaagatttaccttttcaatctttagagttagcttctccagttttggtgaagtctgaaggaagaccatcaatccatagaagtttgcatccagacaccattgaccaagagtcagtctgacaagattgttgaattttgggtacaattgcaaattgttttccattgtcagctgcacagtattgaaatgatcatgtggcaacagagaaaaccttgccatgttatagacaaaattcccactaaacatgacaacacaatccagagcactaacactatgacaatagaaagaaatgatgtcaacaaaaaaccagaggattgcaaaactcaaagggaccctaaacatgacaatgcaatccaaaggactaacattgtgccacaacagaaagaaattatttcaacaaaaaaccagaatatacgatactatactagtttgccttcaccaagtctctcgatgcaagttaggtagctacactagtcttaacaaaatgcaaaaaactattatgtggtagcaggagtaagactttcaacatttgctgaggcatttccatttgtatgttaactttgagtatgtcttaattttcaaatttatgtgcagcaatgtcaattgaagttagacaatcactcagatttctgaaaagatgaattttcagttgccaacccaatattgcagcaaacaagagcatgtcgagttaccaaatgggaaatgctccagtttcattgtgaaatcgaatagccagctaagatagttcaggtctgcttgaccaacaggttgatttatacacaaatgaactgacaacatgaaataaattacatcgaatggttgatggcatcagtcattcttacaacacatcatgatttcccacataagaattcgtcttaatttgccagtgcaattctgaagtgtcaataagaaacaacatgcttgagtttgttttcttttttcgtatcaatacgtacattaagatgcatggatataataaggaaagtgggatgcgtaagaccaataagcatacctctttcccaatataattgaactccaaacttttagcagcagaaaggctcctgagattttggaagaaatcaccagagtcttgcacatgataaagtaccagtaatgaagtcactagtaatggcatgtcattaaacacacagctatccacaggcctccacaacttcagataagtaacactcggggtcgaaatagtagtcttgtcactggagaacagagtgttcttgatggtcaaaaccttcagtgtttgggaggagatctcaacatcattaacggcgcattcatctaagaagagactttcccatgctggacagcccatctcgagttgcttgaagaatccttccatcaaaacaacactggtgaactcaattcttgtgagatagcgggaagcaaactcggagtggtcgagatacaatttgtcacacagcacaacaatatccagaacccgtgcctgcttctgcacagcgtggctaatccatgcgttgatatcttcagggtccgagatatcatcgaatccttcatccaattcaaatttgcacctgaactgaaacgtgcttatcaaggcagcagggtcacggagctccatcaccctctccatgaacataatgaacgccaattccgtcttttcatcatagtatccttccgagtcggagtcccgcgtgaactcgtctatgtcggagttgatgcagggcacggagcgccagaggttgcgccaccgccgcgacagcacacacgtctgcacagcctggcgcgtggtcaggaaggacatgatattgagaatgatgtcgtccgggacgtcgctgaaccagtccccgtcgtcagtgtgcgctgggcccgtgacccccctgctcttgctaggtgaaccctccatggcggccgagcacgcgcgcagaggcgtttcgtcgaacaggtggcgcgcgtggaacctgcacgagagaggaagaccaagaatcaggaaccgaacaacccgcagctcaactccaagcacaagaaacgacgctcgagaagacattgattggtcagggaagaacatatagagaagaaggatcgatgcaagaagagttggaagccgtacctcgaaaccgcgcaggcaggcgtttcgtcgaacaggtggcgcgcgtggaaactgcacaagaccaaagaatcaataagccatgaatccacagcacaactccaagcaagatttgagatcgtaacacagcaaagcacgctcgaggagagattgatccgtgaagaacattctaggggaggggatcgatgcatggagagatggaagggaggagggagctgtatgtacctcgaaatgtcgaattcgcgattcgcctcgagcgctccggggaatggtttttttactgctccctcgatggaaacatggacggttcaggttggataaatgtgtctgctgcaatgaaatactctgtccggtaaaataatactaatgtggttgtagaatctagtcgtacttcgtccatttcatattataagtcattttgtgttgcatgttataagtcagttttactttggttaaaatcaaactactccaaatttaatcaagtttataaataaatatagtaatatttgtaacaccaaataagttacactgaatctataatcgaatatattcataatatatttatcttgggttaaaaatgttagtatttttttatacaaacttgaccaaacttgaaacagatggactttgatcaaagtcaaaaatgacttgtaatctgaaacagagcgagtagtaattaagttaattttgatcataataattagggttaattggatcatgccactgcaactttgctaaatttaaaaaaaaacgccactactatttgtcatatcagctacaatgccactcgaaatttctaaaattagaaccatgccactcccgtcacattttctgtctcctctctcacgccgtctttgtcccccctcccccagtttattcgtttcccctcatgtttcctctcctatcctctcctctcctccgaccaacctcccaccacaacaccgctcctcctcctcctcctgctgctgcaaccgcgccgccctcaggaacctaagtccttgaccaccgccggtaaacaacaaaccaaacaaaaatcccttcttgcagtggtttccaagcagatctgagagagaacaaaaagtggtttccgatggcttcttccccttcctcttccttctcctcctccccttccgctgccggtgctgcgccggcgtcctcctcctactggtgctacaattgcgaccccttcgtgcgtgccgcccctcacaaagactccgctgtcgcctacccgaactacggcggcggcatcctcgaggagatgggtgcacccccaccgtgcaccgcctacctccgccacccgtgcgcgcaccacgccaaagacctgcgcctgcgacggacatgctgcgctgacgcagtggcggcagccgatgaccgctcgccgttcaaccccgtcatcgtgctttgccgctcccccgctgccgtagctgccggcgacgatgactccctcgccacggttactagcttcgagctcttctacgacgacggcgtgggctccggcctccgcccgctcccggagaccatgtcggacttcctcatgggctccgccttcgagcgtctcctcgaccagctcacccagatcgaagccggcggcctctcccgcgcaagggagaacccgccggcctccaaggcctccatctccatgccgcggggccgcccactcgcccagttcaatcgccggagaggagacagaaaaagtgacgggagtggcatggttttaattttagaaatttcgagtgacatgtagctgatatgatgaatattagtgataattttttaatttggcaaagttgcagtggcatggatcgaattaaccctttaaacaacatcaaatcaaatctaaaattaagtttgaaaatttaaaatgtagcttataagcatacaaacataagtgaaacaaatagggttatatatatgtctccctttaccacctactcctacaacagtggtacgacagcttcacccaaaatctgataagccgatgccactgcatcgaattcttcaggtgcaactgcaccgccattacacgagtctctgaatcgacgatgttggtgccccatgtttgtgaaattttcgatcaaagaatacaatgtgtgacacagattccataaccatgtgtgtgacagtggtgtttcataacaaatatatagttgtatgaaaaaattaacagctttttgattttgttgttttccactgatacagaaaattgttgcagcttgttgatatataaccatgctcattatttccagtaaaatccactccttccgtttcatattcatataataagttgttttgactttttttaaaaaacatttttaaacttgaccaagtttgttggaaaaataaaaatatttccaacgcaaaatataaatatgttcaatgttacatttaataaaactaatttctagatgttattcaatttttctataaactttgttaaacctaaaaaaatgactagtaaaaaaaaagtcaaaaacaacttataatatgaaacagcggaagtaattttttatttcatgtgtacattacacaaaaaggaaaaaaaatctaatgagtcgtactgaaggggatagagccagagtcatggattgggatcccatgcagtttgaatagggactgcaagtttagcagtcttatatcttcagtttagcagtcttatatcttcactaccatcagatcaaaggtttcaacggcctggatttaggagcaatactgtttgtcagcattggtgcgatctgagtccttgttatttgatccaaagatggttatatgactgctaaagttacagtcatacaagcaaaggtgatctcaattccagtcatggtgtataacatcacgtcgggaaaatataaaggcaaaataatagagtactcaagcatcaacttgcagtacgtcttggttataggacaatagaacatcaacagaacaaggtgacagacctttcacttacatagtactactaagacatgattgtttctactcatatcatagcaccaaacaagagcagtatacatgtttatatgtgctttcggactcaactggagcaacaaatgttatgatatgaacctgagcagaggtcagtccactattaacaaagaagttcaccacgtctttgaccaggggatcatcctccgagcataagacttcaacacacgtaaggtgctcacatgtacttgatctacacccggcgtatgatatgaacctgagcagaggtcagtccactatttacaaagaagttcaccacgtctttgaccaggggatcatcctccgagcataagacttcaacacacgtaaggtgctcacatgtacttgatctacacccggcgtatgatatgaacctgagcagaggtcagtccactatttacaaagaagttcaccacgtcttcgaccaggggatcatcctccgagcatacgacttcaacacgcgtaaggtgctcacatgtaaatgatctatcttcaagtttgccaatgattctttgtggtttttcctggtgataatatagcaacaaaataagatgagctaattctcgattgacatgtgaaaaatgattcaagaaggataaatatgcatttggaggaaaagatttaccttttcaagctttagagttagcttatttttggtgaggtctgaaggaagaccgtcaatccatagaagtttgcatccagacaccattgaccgagagtcaggctgacaagattgttgaattttgggtacaattgcaaattgttttcaattgtcagctgcacaatattgaaatgattatgtggcaacagaaaaaatcatgccatgttatagacaaaatttcacactaaacatgacaacacaatccaaagcactaacattatgccaaccaaaaaccagaataaatgatactatactagtttgctttcaccaagactttcgttgaaagttaggtagttacactagtctaatcacaatgcaaaaaactattgtgcggtgcagcaggagtaagactttcaacatttgctgaggcatttccatttgtatgttgactttgagtatgtcttaattttcaaattcatgtgcattaatgtcaattgaagttagacaatcacccggatttcttaaaagataaattttcagttgcgaacccaatattgcagcaaacaagagcatgttgagttaccaaatgggaaatgctccagtttcattgtgaaatcaaatagccaacttcttgcttgaccaacaggttgattggtatacaaataaactgacaacatgaaatagattgcatcgaatggttgatggcatcagtgatccttaaaatcatcatgatttcacacataagaattagttatgcaacgcttagttttgaaggtgtaattgtgaattgtgaagtgtcaataagaaacaccgagcttgagttttttcctttttcatatcaatatctacattaagattcctggatataataaggaaagtgagatgtgtaagaccaataagcttacctgttttcttctcccaacataatcgaactccaaacttttagcagcagaaaggctcctgagattttggaaaaaatcaccagagtcttgcacatgataaagtaccagtaatgaagtcactagtaatggcatgtcattaagcacatatgtgccattcaaagggctccacaacttcagataagtaacactgggggtcgaaatagtagtcttgttgccataggagacatgagtattcttgatggtcaaaaccttcagtgtctgggaggagatctcaacatcctcaacgctgcattcatctaagaagagacctctcattgctggacagcccatctcgagttgcttgaagaatccttgcatcaaaataacattggtgaagtcaattcttctgaggtagcggcaattgaatgcagagtgattgagctccaatttgtcacacagcaggacaatatccagaaagtggctgcttctgcacagcgtggctaatccatccgttgataacttccgagtccaagatatggttgatttcctcattcaaatccaatatgcacctgaaccgaaacgtgtgtatcaagggggcggggtcgcggagctcattcagcctttccatgaacatcttgaacgccaattccgtctcttgatcatagtgctcggtatctctccgcttgaactcgctgatgtcagcgttgatgcagggcacggtgcgccagaggttgcgccaccgccgcgacagcacgcacatccgcacagcctggcgcatggtcaggaaggacatgatgcggaagacgatgtcgtcggggagggtgctgagcctgatcttgccaggcgacccctccatggtggccgagcacgcgcgcagagtcgtttcgtcgaacagatggcgcgcgtggaaactgcacacagaagaggaagaccaagaatcaggaacccatcaacctgcagcttaacttcgaagaaatatctgacaccgtaacacaagaaacaacggttacaacgctcgagcagtttttccgtgaagaacatccagagaagaaggatcgatgcaagaagagttgggaggaaggaaggaaggaaaggagccatacctcgaaatcgctcgctcaggcaggcgtttcgtcgaacaggtggcgcgcgtggaaactgcacaagacccaagaatcaataagccatgaatccacagcagcacaactccgagcaagattcgagatctcagcgcaagaaacaacgctcgagcagtgattgatccgtgaagaacatctagaggagggaggggatcgatgcaagaagagatggaagggaggagggagctgtacgtacctcgaaatcgcgattcgctgccctcgagcgctccggggaatgggagatacgcttccttcgccactgctactgactggtggggacactgctgtatatcatagtaaaaaaaagggaccggtccggctgttgaaccggaaaaactggaactggtgaccatgacggctcggttcagcacaaagaccgtccccgcagtcggaccggtaaaaatcggataaaccgggtagtttttatggaccgctgaaccggtgcggttctgtagaactgggtggttttgtgtttggacacacaatacccttccttttgcttgccttggtcgttggtactatgaactcaggggtaatattgaaaaatggataagccaccctagggtttttgacatactgtagaaatttggaccgtcatccagatccactcaacctctcacattctcaatttctctaagctcaaactcaattgctgaagaaacctttttaatctcggtttgtaacctccagtagtcccgattatgcaaccgggactaaagattttcatctttaatcctggttgaaataacccggactaaagatggatttttagtcccggttggtaacataaggcttttttttccctattttacatatatcgcgctcgatatctcctaatcattaaaaaaatatcatctcccaacatcccaaattatccacaacaacattctcaaatcaaatcatccacaacaacataatcattctcaaatcacaacaacatactcattctcaaatcacagatcgactgaacaaattattctcaacaaacaatcattcacaaataacaacgaaaaaagaaaagaaaaaaaaaatccaccgcctgccgccgctgggcgtggccctcgcaccggcctccaccggacacggcggcctggccgggcgcggccccgcagggcgccgcgtctgtgacttagagggagagggaggaggaggaggagggagagggatagaggagtgggggaggaggagaaggactgaaggagtgggcgttgtgcgtgaggagataagggagagagagagagagtgcgtaaatcgtgggggagagattatttagcccggttggtgttaccaaccgagactgacttaagttcgttgggggccttccaactattgaaccgggactaaagataaaaaaaatagcgctaggcttttaaccaggactaaaaatattttttagtcttggtttttttagcaaccgagattattgtggaatttggccgaccgaccaaagatgatttctacagtagtgtaagacctacccctactcactgctgctcaagttttccccggtgcgtcgcgccttgtcgccgccacctcgcgatttctctctcgacgcagtgtccggcgacctcacatcaacatgccacaacagtagcgcggcaagccggtagcacgaagttgccgaggtgccgacggccgtcgcggcgtcacgccggtagcagagcaagccggtggcaaggttgaagggcacatcattgcgagttgcttcgtgttctagcctcaagaaatatatgtgcatgtgtggttgattagcttattgcaccagatctgttgctagctagttagcctagctgcggaagtgcaggtgtttgatttgctctgttgatcacccaatctagtctaaaattggtattacatatacgatgaactttattggctaccgatttgttttctaatccattagatttgggagttgtgacctgatgtttatccatttgcagcagtgaattctttatccactccagaatcactaccaccagttgtgccggttagattaaccacaatctcaagaggattgctctgctgctgaaactaaacaagaaatccgttccagtaaaaggtcagagggaagactgatcctgcttgggaccattgtgttgaacttgtccccaaggataaaactaaagcaggaaagccaaaacttttatttttacatacatattcatcaatatctggtgtttctgtatataaaataatacaaaacaaatataatattaataaataaaaaggcagcggttcgaccagtgacctgatggttggaccggtgaactggtgaaccagcaacttgaggggttcgatctccggtttggtatttttactatacttgagatagagatggacagttcaggttgaatgaacttgtctgctgcaatgaaatactccctccggttatctctactacttaaaaaaagcctagtggtggtcttgaatagggtttcacttatcgtgtggtaaccgcgcgattaccgcggttatcgcacttaccgtagggatacggtacaggaaaccggtgatatggtttggatgaattttgaccaaattcaaaattctggaaaaaataaaaaaatgaaaaaaatcatggatgtaatgccaatgatgatgaatttttttgaaatagggtaagctaaattcaaatttgagggcgaaaccgaaaatagtttacaaattagaaaaaaaggaagacaatatcggtaagaatcctacgtattcttccaattatcctcaatttctagttttctacacatattcaaccgtattttcgatttttttgcctatttatttttcatttacgtgatttcagctgcacagcccgtgataactgtgcgaatatcgcggttaaccatgcggtaaccacagcgaagccgcgaaaccaccgagttttgaattcgaatttttggatgcgattttcggcggttaccgcgctactgggtgtgtgtgtgtgtgggggggggggaaggggtaaccctggcccaaacgataaggtaaatcttggtcttggatcctcaccctaatagacccatcgcccaatcaacggctcagatcgtgtttcagtcgataaaaacagtactacctccgtttcataatgtaagtcattctagcattgcccacattcatatagatactaatgaatctaaacatatatgtgtgtctagatttattaacatctatatgaatgtggataatactagaaagtcttacattatgaaacggtgggagtatagaagaaaataatagactgatattttgtttagcacagctctcctaatcggccggcactggcatatagtatatcggcaaaagtaaacaatagtttgacataatcatatctggtcccacacaaaataagcaaatcttaactgaaaagaaaactataactaataagatcgggcattgcacgcgctaaataatcagctgcaaaccgacaccaaatcgccatgcttcacgcggtcttcacgcgcatgcacagaccggttgcatccaaattctcctctctcagcaacgtgaaatccttctgtgcatctcctgcttcttctttttaaatcaccagcaaacctttgactgcatcgatcaatgcatcctcacagtccaagattccaagtacatagctactccctccttccctaaatatttaacaccgttgacttttttaaacatatttgaccgttcgttttattcaaaaacttttgtgatatgtataaaactatatgtatacataaaagtatatttaacaataaatcaaatgatagaaaaagaattaacaattaattaaattttttgaataagacgaacggtcaaacatttttaaaaaaatcaacggcgtcaaacattttgggatggagatagtactaacttctcacataacaccaaatgataaaatgaccctctaacttactatacaaacaaccatccagtacatcacaaattcctatacaaataaattgaggccctctttgtttaggcttataagccaacttataagtcgaaaagtctaagcctaaacaaacaagtagcttttctgtttggcttttttgaagccataagccactctaacactattaagccaaaaactaggttggagaagtgtttttggcttatgtgaggtagatgtgtgattcaactactaaacttaggacattaaatccaccggcttataaatcatataagccaataagctgacttaaaagtctaggccaataagtttaagcctaaacaaaagggcctgagtagattttccaagtaaatcagttgcatcatgcatgtattctaaaataatctcgcctgcacatatacactactcctagctgccaaggctatatatatacatgcacccatggtcatcatattgatcccacgaacagccagcccaggcaacaaccctgtagatatgacactcgacacaatgacgataggcttgccagtaagagaaggtgtgagcagcgcgaagctcaccctcatcgtagcgtgttttctgctaccgtttcttgtcgaggctgaatcgcgggcaccggcgccactctccttcagcttcgacttctccaattcagccagctaccgcctggaggacctcctgttcgagggcaacgcaagcgagcccagcaacaagctggtggacctcacctgcaacgagttcgcggagacgatccacaagtgcaaggggcggatgtcgtacgcccacgccgtgaagttctacgacgccaccacgggcgaggtggccagcttcagcacgcgattcaccttcgctatcgccatcagaagcgacatcagcaacccgacggacacaaagggggacgggctggccttcttcctcgctgcttacccatcaacgattccatcgaattcagatggaggcaaccttggcctccttgccaccaatcattcgaaggcctacggcacagaccggttcatcgccgtcgagttcgacacatacaacaacatctgggaccccaataagacctacgaccacatgggcgtcgacatcagcgccatcgagtcggctaacacgacaagtttgccgagctacagcctgaatggcacgatgacagcctccatcagttttaacagcagcacccggatgctgcttgccaacctgcattttgatgatcatccatcgtttcaaccggccgaggtcagtgcgattttgccggatccggtcacattgcttccacaagaggtatccgttgggttttccgcagccaccggcggctctggcagtgagctccatcagatactttcatggtccttcaactccactcttggtttggccctctactgctaatccacgcagaggtatattctccatcacaatatacattttttgtctctatttaaataactaattaagcactcaatctagttagaaggaaggagtaaactactggctttcatgtcttacatcctcgttaaatatttatacaaacttgtatacttcaggctgaatccaatggaatataatggaatacttaatagctgaatgattcgagacacaaacaaatgaattaactattacaaaattaaaaagcggattaaaaatagtattttacaatattcatatgtacgagtagatagtatttttcatataaaaaaaatcacactatttaagagcttgggaagcttgcatattcttgtttcattccgttatggagaaaagcacactcgagaacaactgtcttcagaaggtcggaagctcaaaggtgaaatacatgaaacgactagcagagtgcatgcatgtgttagcaaatttatggaataaatgatgaaagaaacgaagttttagcgaccttacaactaaaccaaaataagtataatgccacactataaaacacttcttacctagcttgcttagattgataaatgtgtcctttgttgagccttccattgctgcacctaatatttacgcggaatgtgtatactatgacgagagaacaaatataacgtactgtagcagcaacaatatatataatagcatatatatgatcatagaatgattaaattgttctaacatccagattaatgttcttacttctcacttggcttgcttctgtaacacgttctatggatgggaacccaacaaaagaacttcaaacaatatatcacaataatcaaccctacatattaattctaaacctggtatttatctcatgtcctttgttctagacattttttttctgtttttttttaaaacaaacctgaggctaaaggcctcaaaatatattactaatagaaatttgcaagctgagaggacagctagataagcaaagaagcccctaggaactgtgcaaattacacattgagcaacaaaacagcaaagaagggcattagagaagaaactgaaaaagcaatcaggttcctaactctgtttcctccacggcaccagccgaatcgacgacgatggcgatggcgagaccagtaaatccatggcaaactgcaaaaaaaaaaagctaaaacacgaaaacggaggaggaaaaaaagggacggagtacggactaaggagtgcggttggaaaagaaaagttgggtggggtgggggtgggggtaggttgtgaggggagcgtatatagttatggatatggagatacgatcgactatatagtgtattataatgatttgcggggatgatttcatactatatatagtactaatgtgttagtcaagaatatattaagaagcgttcgcgaaggctacaacgtacggatgcttaatgaagtgccattgtcgacctagtggcctactgggggattgcaaatggatgattgaaaacgctcaaggccttcatctccagggaggttggtagggcacacccgctctagctttgtgacatgcatgcatatgtatagatgcatactgtatattgtatatgttaccaccagtaattagtagctagggatatactccatccgtcctataaaaaaactaacctagtaccgaatatgacatattctagtactacgaatctaaacatatataatattacatctgattctagatacgtttttttagggacgaaaggagtacttaaaaacagtggtagaggaaggaacttataaagactagggcataattattaatgcaatttgttgaaccttcaaacttcctacaaaatttaaaagtattttcaagagaggagacaagcacaatagcactgttttttttgaacgcagagcacaatagcacttttaactctttaaactactactgcatatatttttactcctttcatctgaaataacttatttttttatataaaccagaatatcaagctaagttacttttaggacagatggagattttacgctaagcgatggaaaacgatttgattttacgcgctgaacctaacggtattttcttctcgctgtacaagtcctggtaggacgtcactcatcggctccatgggtcatatatcggcccatcaaacggctaccggctacgcactctgcttactgacatgaatgccagtcacaggtcacagccacgtcagccttttccccttcgtgggagacaagatgagaaaagttgttcagcaattaatttcaacaaaagtcaagacctcaaccttagggtagtccctcccttcgtaaaaaaaatcaacctagtagagaatgtgatctagaagagaaaaatgtatgtatgttcaaatttattatactggaagagatgaagtaggtcgatcctaactcataaattattgtataaatatggagtttgtataaaactcagtggatggtttattcaaaataattttttatctaatcacctctcttaattatctcttctttcattcacctatccctttgtctttgttcttgcttcatgcctaaagttattttcttgatgagagatgatttcatcttccttctctctccttgttaactcttttgccactttgtttttttatgtgacaaacatacaatactaggagaagggtttttccgtgcggttgaaactgattttcgcatgcagatgggcggcccgtatgcacccaagggtctacgaaaatcgcgattttcgcgtgcgggtgcctatgtcgcccgcatgggaaaataaaaatccagaaaaaaattcaaaaaaaaaaatccaccggcagcgccaccgcctccttgtcgtcgtcgtcgtccgaagacgctgcccgcgccctcgtcgttgtcgccaccggcttccgcgccgcacgccgcctcctcgtcatcgtcggccggggatgccgcccgcgccctcgtcgtcgtcgccggcggcctccgcgccacctgtcgccggcatccgcggtcccctccagccgcaccgccgccgaggcccctcccctccgccggatctggcgagggaaggaaggggaggggaggggagccggatccccaggggggggggaggggagggcagggcggccggccgctggatccgtgctcccgtcggcctccaggctcccctccggccacaccgccgccgacgccgctcccctccgccagatctggggaggaaggaaggggaggggagtggagcgggatcccacgaggagagggcggccggtagccggatccgtgtggggacggccgccaagcaccgtcaggactcggggagaggagaggacgacatggaaaatgaggagaggagtaaaagaggagaggagaaaaagaggagaggagggaagaggagagaaagaggggaaaatttaaagtgggtaggagggaaagaaagggtgggtatttttgcatgcggctttcttaataggtccgcacgtgaaaatgggccctattttcccagacgcgaccagttatggtccgtctgcaatctaaatgactctatatctaggaaaatcttttgtgtagtagtgatatatataatgttatactaaacactacgtgacatggagagttgggactacccttaggcttagaggatgtgccctactacctccctatcaaaataagtgtattaaggggttatttgattgatgactaagtttgtcacatctcacgttaccacaagtgtgtatcacctcctatcatatttcttttcatttacctctaattaacctctctctcacttcaaatcacacccttatttaatgtactttctctattccaaaatataagtatttctaggttgttaagcagatgttaaggttaagaagaaacaactttggtgttcctcaataaagctagaaatgcatttactatgacatagagatatagtaggttataaataaataaaaatattcataagaataatgatatattgtaaagtaaaaaaatatctttagaaaatgttgtccaagcaatacttatgtaaaaaggtttttgagaaatcatacttttgaaagtggtagtaataatctatattatctacataattaagttgtttagaatagggcacaaggtagcaccatttgatacacttagatacataatatatgccatgtgttcttaatttataattaacctaagacattgagttgccaaagtttgaaccctagtttgtcatcatcatgcatgtgagtacagtacaggccttgcttgtgtcatgcaagagaggtaacttgcacaaaagaaaaaaaatggctgatcagaatgaataagaaaaacagaattcgttgtacaaaatgtacaattttagctgattgaaaaattatgaaaattaattagatccctgaaatctttttttccctgaagctacaaattaatcaacacgaaaactataaaacctctgtgaaagacctctgcatgtggatcaagatcctgtgcagttgttattataagtgtaacttaagcagttatatgtgtatcaaatgatctagaatggaaggtcaggatatgaagcggtactgtagcaaaaatactgtagcagggatgtactatattatgcctttactgtagcagtcatctagagccgctagatctgaaaacgaatggccacgattgtgtgcagttgctattgtgcagttacaatagcaactgcatttgatctcaatcctctgcatgtactacatcatccccaaaagacctcatttctcactgtagacctcatttttcactatatgaatatcggaaagaaaatgttcgtctagattcatagtcaaagttgaagtgtcttttgaggacaaatgaatggcctgtttggcacagctctagagctagagtccagctaaacaatttcagctccatctaaaatgggaacggggatgggtggagcgctctcacagaataaactagaggtggagctgggtttttttaggctgttccacaactccgatccactacagatccaactcctggagctaaatctaggagtttgagctctatcaaacagacctgaaagtatataatacaacacttgtcattctaggttgtttaggataaattaaggtttcataagaaaagactaaagtaacccttattgattagaagcggaaggttggttgaggatacaatagaaagaaatttgaataagatgtgattgaggggacgattagtactttacagtgacaactattctggcaaagaatttgcaatataactattttagaacttagggattcatacgatccaacatgcatgctgtgtatgaatcctttcttcatgaatcttggattcttggaggtgatcaggtcagacatatgttggcattcacccttgaataactattacgttccaaaacctgcagtactgccacatgaatgcagacatatacccctactatatggcatagtactatatggtattgtcacttcgattaatttgtaccattccttgttttttcgttttttctccttttcccctccgttccccttcttttcctttttttcctcatgcactctgttattttccttttttccttctctttggagccacgagtaaatattttactaacaaattactctcacctaatcttcttttagtaaataattttttttctttttttcttcttttttttctcatgcactcgttattttccttctctttggagccatgagtaaaaatttgactaataaattactctctcaccctaatcttctttcagtaaataaattatgggctttcagtcacactaagtatctaccagcaaatcaattactcacgagtatattgttatagaaaaaaaatattccagtgttatctcaataaagaaattacttccgatagaaaaatctactctggtcttcacttattaaataatttacttcacacaaaatctactgcatcccttatctcagtaaattaattactcataaaatttactcctctcagtaaatggattacttttactataaccattaatttttctggctttttctcactcttataaaataatgcctcctgccttttcccaataaataaacaagaagattgactccggtattctcttagaaaataaatttctcccagactgcttagccacaaaatttactccaatcttctctcattgaaataagttacttcccgactgctggagtaaaatatttaccaacaaatcgatatagccaaaataaattacaaccatatttttgtcgactataaaactacagacatgtttacaaagactcaggggcacaaacacatatgattctacaattaaaaaaagtagactcgctgctccagttgcatctgcaaaggacaaatagtagccgatgatgacaccggcaccgacaaccttagaagttctgtgcggagttatgggcaggacttgtgtttggaggtgggtgttgggaacccatctcccatacacggaaaacagagcggtctgttagcacgtgagtaattaagtattagctattttttttaaataacttttgtatagaaacttttttgtaaaaaatacaccatttagtagtttgaaaagcgtgcgcacgaaaaaagagagggaagtgttgagaacttgatcttgcagacacacccgttggcaaccacaacagattagctacaggtagaaatcgatggaggaggccaatgacagctggctgtagctagctcatgcacgagcaatccccatcaagagagggatccgcaaaataacaatgaatcacaggggcttagaatgctcacaacaatgaaaccatgatcacagaaactaaattcaaacatgatcgatagaaatggtgaagtagtgagactttgatcttatcgacaagaacaatggttcgatccagtagataatgttaggattttagaaagaagaaaaaatgggatttttttaccatgctattcttctactgcaagtcatccgttatcctccttcagctgtgcaaccaagtttgtactcctagcctgcaatcaatgacattgtgcaataattgtatatagaatctcctcttgttccagttccaaattcctcaacactgcacagaccaattgacaactaaaaaaataaaatttaaacaggaaaagtaaggaggtgttgaatgcatcctgcaggaatttcattgtggtcaggcttgttgttagactgctggtaggaagtcagagagtcagatacaaaactgtagtgcataaaatataatctaaatgacccagtgcataccttgaaactgaatttgttatccagacaagcatggaagtcagattccttttccttcaaacgaacatgatcatgaggcctgaattcactatggttcttggtttggcatatattatgaagtgcaactagttggttgctgaaacaaatagtgtgcactacacatctaaccaaaaagaactttaatagtgacaggttaccaatctcaagaagctcatggttttgttttagagtcaattaagcaaactgctagtaaatcggttaatatgagacattatatttgtgtgtaggcaccaaacatatatattgaaggacaaatccaagcctgtaacctgacaatgcaggcaccaaatccattaatatcttttggagctcaaattcgaaattctggccattgttcatttgtttttatacctgccaaaagtagaatgatgctatttgataacatctgaatatgtactcccatctgttccaatttaatgcactcaaatttgacccaaattaatactgataaaactaggatttcttaataaatagatgaactctagtttttgacatggaaacaagcagcgctttaacacccatgaatttgatcaaacaaagaaaatagcacaaaatgtgcataatggagcacgtgcacattaaaaaaacacaatactaaaattttgagattaaatcactttgaatggtttgtaatgagatccaggcaattttagcaagaattatatagtgtggatagacatatacagatgtctaagaaaatcagccacacgattgcagtggaaaacatttgagtagtttagaatcaaactgcaaatatgaaactattacaaacatgaagcaagtaaaagcgggatgttggcactctgaaactgcaaaaaacctgaaacgcttctattatgtgcttgttgactgcaaacctgaaacggtggagatcgaccgagaggcgacgttgccgatggagacgagcggatccagacacggcatcgattgttggttgctgtcgtgcatgtatttcacctaggatggcaacaaaatcatgacaacaataattccagctgaacaaaataactacagcaaaaatgatttggaatggacgctctcagccggcgcccggcggatgtgcaggcgcgacgccgaaggtctgacgctctgaggcagagctcatggagactggatcttggggcgtcgttgagcctgaagccgaccggcagaggaggggcgtcgaggcggggccgcgggggggggggaatatttatacaaacttgtatacttcaagctgaatccaatggaatataatggaatacttaatacctgaaagattcgagagccaaacaaatgaattaagtattacaaaattaaaaagcacactaaaaatagcatgttacaatattcatatgttcgagtagattgtatttttgatataaaaaaaaccacactatttaagagcttgggaagcttgcatattcttgtttcattgcggtatggataaaagcacactcgagaacaactgtcttcaaaaagtcggaagctcaaaggtgaaatacattaaacgactagcacagtgcatgcctgtggtagcaaatttatggcataaatgatgaaagaaacgaagttttagcgaccttacaactaaaccaaaataagtgtaatgccacactattaaacacttcttacctaacttgcttacaatgagtaacgagtacttgtgtgagccttccattgttgtacctaatatttacgcggaatgtgtttactattaagagaggacaaattttacgttctgttgcaccaacaatttatattatacg

SEQ ID NO: 61732 - DNA, 6504 bp, Oryza sativa
cttatatcacttaatttctctaacttttcctattgaatttagatagccaaagtaacaccggaaaacaaaaagaaatagtgactacaaaaactatgtttggcaaaattcaaatgaattagggggcatatgtatatttcaaatgaagagtcgtgtcaaacaaatataggaggctttccctgctttaaatggttttcgagctattttcatgaaaactgacaaaaccgctcaagagaagtttttgatcagtgaacggttttgtaaaccctgactgcaacccatctgattaggaacatagttcagcttttcattctctacattagaaggaaataactcataattctattatatacacctacatttatatgaaaagcatataattttaataagtggaaataagtcaaccctaaagagatgtagtttgactaccactatgggtgtatatactgtgtattttctgtagccataaaaccatatcatcctagaactaaatgttgcaacttgcaatagacttatccaaatctttgctcaattcctatccattggaatcaacttatctatatatttactcaatttctacctgcggaatcaacttatctagatcattggcgttgacaattacaactcacactgaaaggattactgattggtaattgtgtaattgttggcaccatagttgggaatcggagagagggaaaaagggttggcaccagtcctctatttttttttctcaatgtaccgagaagaaagggggcttagcaggaataataagatgaatgattgcgatctgtagcccatgtaagaataagaacgaaattttgcaaagacaaatgaaaatcaatgaaagtactaaagggaatggtgaaaaggaaacgcaaaatcaagtgaattacaataaggaaaagataattcaattacaataaggaagcgataattaaaaaatcacttattaattttattcgtcacgcgacgtcaaggcgcatatatattcccactatcctccacgcacgttatagggaaatggagacagaaacacgacgtgtcactatgcaattttagatgcgccaagaaaaaaaagaagatcaaattttggtgacacagccttacaatttcaagatatgcctttgataggatggcattgacttttcacattacaataataccctagttgaataatgtattaatgcatttttctcatgtctaataagatatttttaacatcatggtagttactcagaaagcgaagcttgccgcactgtaaattaatcgtcaatattaatactttgtttgtactccatccattctataatataagacacaacccatccattccataatataagacacaaccacttttcttagatgttccataatacggagtataaggcatacatgcaagcatgaaatataactatgacatcttctccattaaattattacttttttaaatcctccactctcatgctatctaatcttattggatgcatgcattatatttattaggatgatccaaactacaagatgataataattatttcttagtttttgggttaagggtggttgtaccttatattttggaatggggtgagtaataaataatagccctccaggagtctggtacaccgtacaacaccaaacgataagaaagtgatttcatctcctcgttacgtgcatgtcacctaaatggtcatcaaattttttttaaaaaaaatagcaagatagattaatatgaaatataccactccacaaacattcaagttgaaattcaacatctacaagttgaaacaaaaagaaacaaatatgtaagcgaatgtacgataaccattttaatttgttccttttttgcaacttgtggaaatcgaatttggttttgcatgtttgttgagtgatatatttcatattaatctatgttgtcaattttttttcatattttttaatgactatttagatgacatgcaaataatgagacgatatcccctcgagggatgaaaattcatttcccggcacgatgtttatttctgtggagtaatgactttcacgcttggtttggggtgtggctgctaagaaaattggcatatatgatatattcaatgcaggtgcttccattttgttttcttgtttatgctgggagttgagaaaatcttagtccataatcaactggtcaagtgccgaggaattgcctgggtctcattgactctgttaacttgttccattggcggctgtaataagcctgggacagtgagaattagtaaaagaaatgactgtttaatttgcagctaaacagtatctcaatttcgaaatgtcattgtcaacaaccatgttattttccctttaaatcgttcggagctcacgcatctaaatcctaaaccacctgggttccatgatgagtcgtcgaatccatggcatgtgcttactcgtcctagccaccttcctctcttgcattgctctctcggcgggtgatcaccggagcgttctgtggcgcggcggctccatcgccgtggaggacgccgccgaaaacgtcctcgtgtcgccgagcggcaacttctcgtgcggcttctacaaggtggcgaccaacgcctacacgttcgccgtctggttcaccgcgtccgccgacgccaccgtcgcgtggacggccaaccgcgactcccccgtgaacggcgtcggctcgcgcgccgagctccgcaaggacggctcgctggtgctgcaggactacgacggccgcgtcgtgtggagcaccaacaccagcggcacgccggccgaccgcgcccagctcctcgacaccggcaacctcgtcgtcgccgacgccgccggcaaccggctgtggcagagcttcgactggcccacggacacgctcctgccggagcagcccgtgacgcggtacaggcagctcgtgtccgccgaggcgaggggctccccgtactccggctactacaagttctacttcgacagcagcaacatcctcaacctgatgtacgacggaccggagatcagcagcaactactggccggaccccttcaagaagtggtgggacaacaaccggacggcgttcaacagcagccgccacggcagcttcgaccgccgcggcgtcttcacggcgagcgaccagctgcagttcaacgcctccgacatgggcgacggaggcgtcatgaggcggctcacgctcgactacgacggcaacctccgcctctacagcctcgacgccgccgccgggcgctggcacgtcacgtgggtcgcggtccagaggcagtgcgacgtgcacggtttgtgcggccgctacggcatatgcacgtacagccaaggcccgacgtgctcctgccccgacggctatgtgcctcacgacgcgagcgactggagcaagggatgccggcgcacgttcgacgtcaggtgcggcgaggacgtcgcgttcgccgagatgcggcacaccgactactggggcttcgacctcaactacaccgccgggatctcgtttgacacgtgccggcgtctctgcctcgtcgactgccgctgcgaggcgttcggttaccggcagggcaccggtgagtgctaccccaagatctctctctggaacggccgggttatgagcattccgtaccaaaccatctacctcaagttccctacgggtgccaagaacctgaacccgtccttgctgcacttcgatggccacacctgcaccatggacgaacgggacgctacggtcagcagctcgtaccttcatggcaggcgcaacacgataaacttcatctacttctacagcttcctcgcggttgtgttcgtcgtggaggccatttttgtcgtcgtgggttacctgtttgtctttcgagctgactccgtggcggcaggacgggtcggtgatgaagggtacagcttggtgtttagccatttccggaggttcacctacgacgagctatcagacgcgacgtgcggattcagagacgagattgctaagggcgggacgggatccgtgtacaagggtgttcttgaggatggccggagcatcgccgtgaagcggctggacgagatgacgcaggccgacgaggtgttccggtcggagctgagcgtcatcgggcggatcaaccacatgaacctcgtcaggatatggggcttctgctcggagcacccgcaccgcctcctcgtctccgagttcgtcgagaacggctcgctcgacaaggccctcttctgcgacgacggcgagagctccggtgtggtggtgttaccatggcggtcgaggtacaagatcgccgtgggcgtcgcgaaggcgcttgcgtacctccaccacgagtgcctggagtggatcgtgcactgcgacgtgaagccggagaacatcctgctcgacggcgacttcgagcccaaggtgacggacttcggcctcgtcaagctgctgagccgcgacgccggcagccacatggcgctgtcgcgggtgcaggggaccagaggctacattgcgccggagtgctggacggtgggccgcccgatcaccggcaaggccgacgtgtacagcttcggcgtcgtgctcctcgagctgctcagggggcagagggtgtgcgactgggtggcggcggcggacggggcctgggatctccagcggctggccgcgtggctcaaggagaagctgaagcgcgacgacgacgaggaggaggtgtcaacgtggctggaggagctcgtggatgcacggctgcgcggtgatttcaaccatgtgcaggcggccgcgatgctggagctggcagtttgttgcgtggacggtgaaccaaacaggaggccgagcatgaacgccgttgcgcagaagctcctctcgctgcatgatactcgctagagcatcagtgcatcatcatcagccatctgcaccatgcatgagcccagcatgcatcgatcacctttcctggaaggctggaaccccaatgcatgggactgtgtgtgtcataccaaaatgaaaaaaaaaaaacggatttgctataattgtggccacagattttctgtccaatcgcagtcgattttttggccttaggatggcatgtagattcgtgcttatgtgttgtatccgcgcgcgttttacggctcttccacagcttttgcctcgtcaattgactccgtgtgtgttgtttgatgagggacatgctgatttgaccgatggatgagatacgtgtagtaagttacaccataattacatcatatttacactacaattacatatgtaattttaaaacttacatatgtaattttggtatttacatagtaagtacactattttttggtgaatacaatgtaaataaatgctgactattttttgagggaaaaatatggcaccataaatatagctactccccaaaaaaaattgcttagttagactgttcagggtgtgaaactgtgagtgtagtagtgtacattgtcccacaatttatttatttatcaatattcactaattattctcaaaataaattaaaaatattggtgtacttctttatacgacctagtggatggttaagcggataaaatatataaaagcaagtcctacttttgtggattaacggatacggagtatgcaacaatcaggctgatggagtgtttcgtggggaaataggataatgtactgatgtggaagcacatggccccatttcgctgaagggaattcaatttttaaaatactgtatgcatctgcttgtgtgttatatatgtaaagagaggaaacgaagaacggaaaaataatatagagtaagaattttttttttcatttttagtggtctaatagaggctgagggacgaaagcgactataaagccctcaaaatcaatctaaaaagtaaaattggttgtatcttataattcgcgcgccttccacggaaattattggattaattccaaacggatgcaacttgatggcagaaatattggcactaagttgacattagcacactaaaaccaatcgtcgacggttccatttcttttctccaacgaattagcggtgttaactattatatgattgcgattgcgatgcatccagctggctggaataatgcaatgcaaaaattgacaaaacaattatgacaggatctaatcagaattactccctccgtcccacgataacttcatttttggatttttatgtccaacgtttaaattaaccgttcatcccatatgaaaaatttatgaaatttattttgaaaacatagtgacgcataaagtattattcatgttttatcatctaataacaataaaaatattaatcatataaaacttttaaataagacaaagagtcaagcgttgtatccaaaatctgaaaaatggagtcttcgtgggacagagagagtagtaatctaaagcacatttgtttaatacgcaacctagtttagtactaggtcgcactatcttcaggttgatctactagtacatggatgatcgatgctaaaaaaacgactttggttaatcgtgtttgtcaacacgaagaattgatgcacatatgtccaattagatggccacaacgtccaacttaacgagtcactttcgagtatgaatta

SEQ ID NO: 61733 - DNA, 8602 bp, Oryza sativa
tactttctcctagaaacgcatgcttgcgacgcggggaattagcgttgctttaaccgaagcaaaaaaaatattcctcatcgagaagcagcagcagcagcgtgtgaggtgtgagtgagcgagtgagagtttatacgtgtctcgctcgaagaatttggcgagatttggaggaaaaggatttgattgggttttgctttgctgttgcgttctgatgcgctaaccgctaaaggcgataaaaaaccttggcgtttcttcgacgcattttgtcggtgtacaagcctttttggtggtttccatgctgtacaatcgcaacctgctggtttcccatgtagcatatgctgtgaacatcagggatacacccccactgatcgcttgttgtatatgcagaattaacctgtattcagataaagaaatgtcttgcaaagtaattaactgatttcagataaggtgccggttgcctgaatttggctttggtgttggaaggacataaaggaaagccgaatggtacgtttgatttggattattgaacggactattaaagcggattatcgatttgatttagaaattttaagaaataaacatgatgaatagtttaaagtggtccaagtaatacagtagaaaatgttttttagaatgtatttttttcaagcatgaaattaatagttaaataatatgatgaacaagtaaaaaaaagtatcatatgcacataaatctttttgtgtgcacaccacctaacaaatttcactaaaaattctagaaaaaatatatatctataattttagtagtattacatatatgtataaagtttcatcttcaaaatcattatatttagtgagtaaaaaaaacaaaattcagatacatttatactcttaaaattgtcagaattatcatctttttattaacgttaaaatataataaatttgaggctaagtatttacacataggtgtagtactggaagtacataaataattgttttaaatttttgataaaatttattagttgatgtgtctgatgtgtacccgagaaagattctgtgagtaggattacaaataaagcatatatagctcttttccccctgtcttgtaaattagttatgtaagacgatttagcacactagctttgaccagcaagctgtgtgcagtcataggatcatcgattgttccaacatcggatgataataacagcgtgttacttccagtaatctatatactccatctggctaattaagacagatagatgggttttgatccagtgatgttagcggtgactgacgcgggcgcgccacgccgccgtcaggtgaccgatcgatcgattgctcgtacgtcgccgtcgtcatgatgcgccatgggtcaatcactgcctgccatcatggtgggcggccggcgccggcgacggcgacccgtagatctcgattgaccgattagccggacaattagtgcagtattcagatccataagcccatttagaattttcgcttatatttatacttatcagccaaaatttaaatttaaatttttaattttaaaataattttaatgttttttcatcataatttatttttcagcaaattttatttttcgtttgcgatacgccgtttgtcttattcctcgaataagccagataatggggctgtttgtagggggatgaacagtatttcgggcattggttccagcttaaagtgattatctaattactgcaattccttgtgcaatctgactgctgctcccggtatatggcagacgattattgcacggataacgctgaagttttttttttaagcaaaggataaagctgaagtagtcgagtgggctgttggcctagggccaatgggcatctggtcaggccaccagaagatgggaattgggccgatcctgaaacataatgggcctaggaggccataattactttttgggccacttaaatctcatcgtttggcccattcggacttcggagtgtactccgctgccgtgggcgggccgcagggaagcactgtgaacctgtttgtttgggagaaaagtccggagatggtgagaagtcgttgatgagcattccgctggtgaacgccaaaagctaagaaattccgattccaagctgctagttcaggttttttggattttgtagctagaaattcttaaaatatgaacggaaatctgattgagttcctccatgagatttatttggaattgtattttcaggtcaaaccaaagtcgcaacaaagttatcgatccagggcagctattttctgcaactttgaacttgccaaatttcaatacaaaaacggatgagatggaagaccagtactgaaacaagcttgaaatcaggtttacattcgataattaaccactactagcatctagcaaggaaatgaccaacgacgacaacgacggttcatcatcctcctgttctcaggcagttgggctgatctgatcatcatatcgagatgtcggtcagtcacttcttcctggacttgcgctcggcccgccgtcgcgcgcggcgctgccggccgccggcgtcgtcgagctccgagtacttctcgtcgagttcctcgaaagatttcttcatgcaaccaccgacgaaatcaattaatggtgagaaaaatgcatggttgaagatggggacgacgacgaggagagctagcagtatagcagacgtacgtctcggagctccatgaagctgacggcgtagaaggtcacggcggcggcggcgacgatggtgaggatcggaccggcgaactgcgcggctacaccttccatgagcgctagccgctaggttactggttctgatgagaaagaggctcaaaagctttttttctcagccaaccactactccagtagcctgtgtaaccctatccagaattcagatagctcactccgtcactcgtatcagcatttgtcgatcacacaaacaccctccgaaaaacagtatatttatatacgtgcccttaaaagcatcaagtgatatcatatatcagttgataacaccttaaaccaatcttatatatgtcattatactattcaactatttagagtcatgccattataattttttagatatacatgggaaatataccactacacaccctttgatgatgtactgatctgattgctgatgttatactgagatattttcttacaagtacaaattcatcatatggtagtttacaaacattgcaggccataatatgcagaacatgtatagtcgtggcggggggagagcaacgtcgtgggatgggaggtgaatgtgatcgtggtgacagtaagcgtcgaggccaatcgtgatcactgcagtaggagggaagaaacatatttctattggtagtttttatagggcctatacttttcagtttcagagaattaattatagctcatctcttggagagatgatattttcacatcttaaattttgtttaggattatctttactattataaaagtttaagatgtttttgccgaaactattttcgtacctcgtggtatccgattctgctcgctcatgcgccacgccccacgtcgcgttcgcatgcatccgagtccgtttcgcatgtgtttcctccggccgtgagctggttaattagtcgactgtatgatcgttccgttcgacgcaatgcgagaaggttttccgtgcgcagcaaaggccggccagtccggatcaagatgtactgttaattatctttgcacgtagatagattttgcatgcatgcaaatcacagctagactcatattttcctggagcaaataatgactggctagcaagatctcagggatcattgcgtagaggtcagaaggctatcccagcacgatagctggttgtggagaaaataacaaaacacgagatagattcaattttcaataggtgcaaatttgcagtaaaaaactagaaatataaaaagtgtcatccaaactatatatggtaacaattgcaaatcgtgaagataaaatttatcaaaaaaattaaattattttttaatttatttgaatttgatatggttctcgtgcaattaccattatcttaccttagtggtaacctaccatgtaataaagtaattcatttattagacgtataagttttagttaagcctatggtgggtgacagtcacataaaggtcgagtgaggacgcagatcgaggttgttcaagttagatcaaagctggtgatgctcgatcaaaggtcaattgaattaatttggatcaaggaacaagtgacattatagagctctacaccattaagtttttggatgtcattgcacgtgctccacatccacctactgttgtagtgttgagagatgtcctcctcggagggtgaaccctccagctatagtcggaacgactcaagatacaatgtccatttatgagtccttcatcctaccatactagattgcctagggtgaaatgacaataagaaaaacctaacatgtatcatctctctttttttttatctcgattaaaccaaaacatgtgccgctaaaaatattcacccggtgtaacgcacgggcattctttctagtggaaaaccaaattttggggatgaaactttaggattctgttggcgatgctcttagatgacatgcaagtaacgatggggcatccctcgaggatgaaaattcatatctcatatattcccaagcacaaaggtatgtttagaaattcaaaaggaactataatatttgaattgcatgcatttgtggtgatatgatacgcaccatgatatatactgtgttttcattaattcttgtatacagaactgtaaaaaggatatgcgtaagtccaattaaactatatatactcatcgagcgagcggtaggcatcatcgtgatggctggcgacagatgataggaaagatcgtctggatatagattgtgcacggccgtggtccctcgttccatgtcatgagcatacaaagcagctctgttgttcagcaaccagtaataatagatgcaattcggttttaggccagcttcctccgcatcgaacgacgctccaattctatcttgaccgatgaaaaacgaccttcgtccaccgagcgacttcaccttcatccatgtcgctgatcccttcgccgccatgtaatcaagcttatagacgctgacgcgcgcaacgatccggaggcatcggatcgggtatctaaaccaaacgcagtacagctccccgtccgattccacaaggttagtggagttggacgtgcacgccaccgagacgccctccgcggcgaccacggtgaccacgggctcctgcgacgacagctcgagcacggcgaggcggtgatcgacgaggtccacgaggagcttgctgccgtctaccgccgtgagccgccctatcgcgcggaggacgtcgtcgcggtgctcgtggtgaggcgtgccgggctggaggtactcgtgcctcgcccattgctggtcgtcttcttcttctggtggtggtggtggtggttcgtcggtgccgttgccacggccggcgggcgccggacggcaatgccagagcaccgtgtcttctaggtcgacgacgagcacgacgcagccggggtccgtggggcggcggcgcgacaggaggcaccggcgccgccagtggtctacggcgaggacggtgccgtcgtggtcgggcgacaggccgatcctggtgccggtgaaagggtcccacaggaaggtctccggagagccgcggcgcgccatgagcagccagccctgcggcgtggcccagattcggtggtctctgacgaacgcgctccccgggtgaaggcacggaagatgcagcatctcaccccgtggcaggctatacacggacatgccgtcgccatcgtcggcggcggcggcgtgtcccactcccagcagcagcagcggagcaagccggcgatccaatgcatcagatggcttgtggcctgcctccatgaattcgatctcaatttactcctcttcttggtgtttttttcctgatagagggtatggctggtgaaactgaagcaaaaactcatcaatatacatgtacgtattccatgatttatagtaacagagatttgtttccatgtcgtaagtaagaggtgtccggaggaaacacgaaaagaaagcagcataatacgcggcatgcaacacacgtataacagaaaagggaaacactaatcatctcttaagggaatatcccctcatttttcatgtagcttaaaaagtcatcaaattttttttaaaaaaatcaagatagatcaatatgtgatatatcacttcacaaatatgcatgttcaaattcaaattatacaattagaaaaaaaacaacaaatttgatattgaatataacacgtaattcgcagttaaatttattatttttgtttcgaattgtataagatgagatttaacttgcatgtttgccgaaagatatatcatatatttatttatcttaatattttttttaaaaaaattaatgcctttttaaatgatatgtacaaaatgagaggatatcccctcgagggataaaaatccatcgacatctccaaatgaaagagagagagagaagaattcctccctctcgatctccctcctcgaggcctcgaccaatcctgcacaccgcacgtgcgctggtgttgaacgatctagaaagcaaaagatggagccgacgagcttcctcgggttgtttttatttttgctgattcgcgttgattaggggaaacggaaataggagatcgagtggataaaaaacactcaaccaaattttggagattaagaaagattcgactggatttgatggggagggtcagctccgcattgtacaagcacgagactgttgttcggaggacgctacgaaaacgggtgggtctggcttgacagcttgcaggtaattttcagagcaatatattagctccggtagtgggcacaattacataaatgtaatgaagatggagagttcctgattgttgcatatcgtaggcttgaaacgacggttatgcaacttttttctaattatggatggagattcaccaatagaccggaataatgttctccttgtcctgttcggttttcttctattttggttttgtcacgccccgaatgtcacgcccggaaattcactagtaatttccgaacttatttgtgcataaaatcctcgtccaggaatcaaccgaggtacacaaattgacaatttaatatacagattcatcaaattaactaaaacgataaatacttacttaagaggcacttagtcctcaccaagaagaaaactgcagcggaaaataaaatctagcgaagctccggctccactcccacaggcagctcaactggggtataagccaaacgtcttctccttctgaattctttttcttcaactgaggttgatcgattattgcaagaatgagcatatgacatactcagcaagccacacagcaaatatgcaagtgcacaaagataccaaaggatggcataatataggttcatttgcaaaagcagcatttagcaaaacttttaagagaagtaaaaacagtggagtgattaatcagaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgggactaatcacgaaaaacattgttcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacaataccccttgcacaacacaatccaccacagcgcacctttcctggatcataatcaccccctcaataaccagaggcatggactccccagcgacccccgtgggcttatctctgccacttctcagtctgatgctccgcaatgaaccatgctgtacaaaaggtaaagccattgcccacgctagcttgtggttggcacgattaatgtttcacaatagtagctcgcgaaccggtccttaattgtcatgagcacgactctcaaaaccatatgctcacaacccaccattatcaagttttagttggcaaataattaattaaccaatcacgattgaccatcgtgaagtatcattaagccatccttaaataataatgagtcataagttatcccaatagtgtgctaatgtttctaagcatggctaagcaattacatctaatatctagctgaaccaatatataaagctcaactagtcaagttataacaacccaaggtatccaggaataaagtaatcaatgcaaattggccataacaaaggaatagattctttattaacctgttaatcgataccagtcccaggaaacagtgctggtatcacagggagacagaatatcacagcaacagaagtctctttattatagagtagaagtacagtcatgttgggctgcgaacagatcccgagctcacaactgcattacaaaaggaaagcggaagccaggacttggaccaatcatcacaggcgtgacttgggaactaggccaaaaccctaaaactcatcgtagccggcttgctcctggaagaactcctcatcagccggatccgcttcatct

SEQ ID NO: 61734 - DNA, 6386 bp, Oryza sativa
  unsure (1)..(6386): unsure at all n locations
acgtgcttgatcccctngannccctcggtacccccttcatctccttcgagtcaccatcatcaattgcatctctgatagacggtcctccacttggtgcctacatctccttctgtgtcatcccttgactctcctctctctctctctctctctctctatatatatatatatatatagactattctctacacccccctcccatggatcaaacccacctcccccaccctccctagggcccgaaacccacctcccatcttagtcaaaagggcggtcaaagcatcctccaccggtcaaacccgcccactcaattccccccacgtccacctctttgttgtccttgtctcacaggaattatgcagtaacaagacgaccatcgtgcagtaacagggttacttctcgcagtaacaatattataacgttgtcaaaatatagcgatgatggatctagttttataaagctcttttttaaagcattatggtggaaacggttcaaaaatataatatgtgatgcgagagatatgattgtttaaagattagaatttcaaataatccatttgtgtttagtttgctactatgtatcatttgtgttgctcccttccctctacgcccacctctttggtgcactcgtctcgtaggaattgtgcggtaacaagatgaccatattatagtaacatgattactttcttgtagtaacaacattcgatagtctgtagaagtaccgttactactacatacatgctctgtgttactataattttcacgggatattactgtcaaagctgcagtaacaacctatatatttttgcagtaacaatctatatatttatatttttgcagtaacgttacatgatactgcacttttacaataatgttactattggaacattataacagattataagttccacaacaatataagtgatttgctctcacaaagtttaaatagagatatataaaactgaaacaacaaactctaatcacaagatgtcataaggtgaattagttaataaagcatttctttgaaccatgagtcatgggttcaagccttggttttgtcacttttaattagttttaaaattttctatccaatgtagatgggagagagatcgagagagaaaaaaaagggaggaaggggcgccaggagaggggagatggaagagagatcgagagagaaaggggggcgggatcaggaggtgggcctcgtggggtgggataagaggagggtgtagaatagagctatcatatatatatatatatatacatatatatatatatatgtatatatacatatatatatatatggggcaagtactccgagctttgatttttgcatggaaccgaaataccggcaaatgagtacgaaaaactcattatgctatattgtcgaagtcatctagctacgtaataccactgaaagaagatggggattgtagctaaaaagacagccaacagttgacaaccggaagtaaactccttgataatctcactcccgggcaggaccttccccatacctgaacctggcctgcttctcatcgttgaaactcgaaggcctcagctgccgcagttaatgtcagcatggcggcttttctgacctgcaacggaaattccaacacgcaacttcgaccgttcgacgtcgcggatcagttggtcaaataaggacgaaacacaccatatttcgtgctatcaatcatgataatttgaacagcaaaatagaaccaagttcacgcaactaacaggaacttttttcaaagtgtttgcagattatgacaggttaagaaacatctcctgttcagggtttaatctttcggttgggttatttgtatcggtggtggctgaaataccgaaattttggatatttggatctgaacttatatgaatttttaataaaatttgatcaaaattgaacaaaataataccaaattcacgaaaaaacaaaaaaaataaaaattccgatagaactgaaatttcgaaaatttcgtttcgcaattttaaaccctgctcctgttacgcaacgattacggcactcaggtactgtatgtttgaattactggttttaaatttagatgagaagtacagtgaagtggctagatcattaattagggctacaatcacagagagtgcatatagaaaaaaatagctagcaggcgatcacgaccggaacggctttgagagggacggccaggacgttggcggtggtgaacttctcgctcacgtcgagctgctccgccgacatgccgtccggcagccgccactcgaacgcgtgcagcagcgacgccatgatgaggggcagcacccgctccgccatcggcacgccggggcacagcctccgccccgacccgaacgggaggaacccgaagtccttccccctgaagtccatctcctccgtagcgcggctgcggcccacgaaccgctccggcacgaactcgtcgggccgctcccatgccgccgggtcgcgcatgatcgcccacgtgttgaagatcacggcgcagcccctgggcacctcgaatccgccgatctcgacgccgtcctccgcggccttgcgcggcagcatcacgggggccaccgggtgcagccgcatcgcctccttcagcacggcctggacgtacggcatccgcgccacgtcggcctcctcgaccgcttccctgccgccgagtgcggcgtcgatctccgcccgtgccttcgccatgacgcccgggttgcggagcagctcggccatcgcccacaccaccgtcagcgacatggtgtcgctcccggcggtgaagacgtcgaacaggatgttcgtcaggtactcccgcgcgatcttgcccgtggacatgagctccagcagcacgtcgaggaagtctccgcgcttgtccatggcggcgtcgtcctcggccgaccggcggtcgattatgtcgtccaggaccttgtagattttggccaggtgcccggatgtccagcgacgccacccttgcaggtcgaaccgacggaggaacgggaagaggtcggacacgttgggcttggctatggactcgatcagctcctccacgagctcccggaacccctgcgccgactcgccgcccacgtccaccacgtcggcggagaagagcgcgctggacaccaggttcagcacgccgccgtacacggcgtccttgacgtccacctcccgcccggcgcgcccgcggaggtacgccacgaggtccctcaccttgcgctcgtggacggcgcgcgccgcggcgagcgcgcgcggcgaaaaggcgtgcgccgccacgacgccgcgcagggtccgccacatcgggtccgcgctggggagccagatcatggaccggtcgcagaagcccagcgcgtggttggcgtccggcacggcgcgggcggcgaggcgccggtcgtgcgcggtgaacgcctcccttgcggcgcccggcgaggagatgaccacggccggggagaggcccagctggaggcgcatgacgggggcgccatgggcgcgggcaaggcgcgcgagcgtgtggtgaaggttcccgccacgcaggtccaggaggttgccgaggagtgggagcggccgggggccaggcggccaccggcgccgtcgggagcccaggcggtggctggtcaggtagaggtagcagaggagcgagacggcaagcgttgcccatagcacccagagttcgtgccccatttctgcggcggttaattcactctgtttgcgttcggcgtgagtgtcggagcctgcgtttgcgaattctgttacctgttgctgcatctacttatactagtttggtacccgtggcttgcaatacgaggaaaataccaaaacgtctacaaatccaaaaatcgagcgtttgtttctcctctttatacgagaatttttcaatacacgtgcgcatttagattggttttgaaacaaatttaaacaattagtttgatagaaaaacaaaaaactaacaaaagaaaagaaaactatgtttaaaattatctctgtgcatgtgaaggggcctttagcctagaggttacaagttacaagaggctcagtagcactatagtttccatattctccatgtgagcgaattttccaggatttagatttaacggctttgggatggatttgctggcccaatattcaaagatgctcatagaggtagggtttgcgcgtgtgcgtgcgttgtgagtgtatgcattgaactgtgtaattctaaaaaaatatatattctaatacataaacattataaatataaatagatacattaaaagttttgaagttgaatttaaattcaaattgttattggatatataaactttgagtatgtaaaccaaagtataaactttagtgtctaaacttaaaaaatgtagaataaacatgtgtgtgagttgaagcccaagcgcccgatatcccacctattggatttggcctgatatgagaagacaaaaagcccaaaaaaaagggtaaattggattcatgccattgtaaatatgtttttttaagttaaattttatggggagtaaaatgacaggtgttatccggtcaatatttcactcttatgttttttttattgtctacgatgcatgcgcgtgcatcagcttcgcatgggattattctcttggttgttatttaaatgttcagggaagaagagttaaaaggagctatatatatgacaagtactccgagctttgattattggaaccaaaataccggcaaatgagtacggaaaactcattatgcaatagtattatcaaagtcatctagctacgtagtacactagtactactcacagaaaatggggattgtagctaaaaagacagccaacacagtcgacaaccggaagttcttgacaatctcactcccggtcccggcaggtcctcccccatgcctgagcctggcctacttctcatcgttgaaactcggaggcctcagctgccggccgcagttaatgtcagcaagtcggcctttccgcgatctgcaacagaaagtccaacacgcaacttcgaccgttcgacggcgcgccccgcggcgaggctgcgatggtgagaaggcgtgcgccaccgcgatgccgcgcatggtcttccaaataagggcatgtttagttcccgacaagaaattttttaatgtaatattagatatttgatcggatatcgaaagaagtttgagatacaaataaaaaaactaatttcataactcgtctggaaagcagaagacgaatcttctgagcctaataatccatgtgggttgctatagcacttatggctaatcatggactaattagactcaaaagatttgtctcgtgattccctccccctcacagtgcaattagtttttttaatctatatctaatgctctatgcatgtgtcaaagattcgatgtgatgtttttgggaaaaaaattagggaactaaaccaggtctaatgcaccggtcacagaagctcagcacgcggttggcgtccgccacggcgcaggcggcgaggtgctggtcttgcacaatgaatgcctccttggcgactccttctggccactgacttttggtcggtggctgacatattggctcctacgacgttagggcaagtactatgggcatctaagtacaaagccccaagatgctacataggactaaatagtgaggtggagaagagaaaaaggattagagagaaatagtcacctctcatgcaaggggcagcccctacacaaacttcaataaatatgtgaaagtgttagagatattggggattgtgtggtagaggtaacctattatacatatcacctcttaatttaattatgtatgtcatgtatgaaattggatgtggtagtcacctctactataaaacttgcccttaaggatggtttggccacatttcaagtcggtttttagtatcacgtgggccctccaatccttctgctagtatgtgattagccgaaggttcattttcgttgtacggcgagtgtattttctccttaaattacttggatacatatattttttaaagttaatggtggaaataattagtaataaacccataccacttagttttattttatttttttataccggagttgacggttaaaatctgtacttaacgactgtcaacattcgggtccccaagcctaatcgttttcagggtccacctaatgaatgggtgatcacgtggagtcaaaatcggccacaccccaccagacactgcaactttcttctccctaccacgtgcacatttagatttgttttgaaacaaagttaaacaattagtttgatagaagaaataaaatactaactaaagaaaaaataactacgtttaaaaatatctgtgtgcataaacattataaatataaataaatacattgaattttttaatctgaatttaaattcaaattcgcattgggtatataaacttcgagtacgtgaactaaagcataaactttgggtatat

SEQ ID NO: 61735 - DNA, 1954 bp, Oryza sativa
gacgtcaggttagatgatgatattgctagagattatgtaagacatatgataactcgacgaattacataaacaagattagagtgtcataaagatggaagcactaatcccgagaacgcaagccaccataacaagtttacctcttgttgaagatcgaaaccgatgcaactcaacccgaaagcaagaactcgtcgaaataaaacgaaagtaaaaagggtggcgatgcgccaagattgtattgaacgtgtgtgttttattacatagggctcggggtctatttatacccgaggattgcaagatatgcccataccggacacaaccattatctctaacaaactctaagataccataagtctttgcggcagtcttttgcccacacttatctataaggaattcacataaaatatcctagttaatagatacaattgccttcccaggactctatccatgggtggcaatcatcttgaagtacattaacttgaacccgatgtcgcgcacaacgcgtattgtcggaatcggctatatcgacttatttagctcgactcagactcagccgatcttgtcgtagccgatctggactttagccgattcctgccctgttttcaaactcgatctccgcttccgactttgcttcgatctaatcttctctccgatgctgatgttaccaaatttggttgttaacagaagcctgcgaccacttagcaaacgaggtcaagctcccatgagcctgcgccccaacgctacacattttgttcgctctttcctttcggtggcctccttccaatctctcttccttcttcatggacgattacttccgcacgagtgtgagagccgaaaaattctagagccagcaatccctgtccacagttgagccgggttgggcaccgtagccagccggcgggtccaaagccagccgctatggaagagccagcacagggggtcccgggcttcgacggcacctggagctcaacttaaggctaggataaggctagaagacttagcccccacacttagcaaagaatcgttcatatagatgggagagaggttgggctcttaccacccaggggccaaacaaatgcgcaacacgcgagcgtcgcagggtcatgagaatagaatgggggaaattaaatataagattttaagctaatgaattggaaaattgaaaaaaacttgaagcttgaaaggacgatcagttgagccaggccaggcaccgtagccagccgtcgggaccaaagccagccgctacagaagagccagcacagggggtcccaggcttcgacggcacccgaagctcaaaactgcaagagtcctcctaggagtgaaccgaggcggcagcaggttcatgggataaccccgcgcttggcccctgagggccatggggaagacgtttgccatgacccggtcgccaccccccgccgcctctatgatcgtcgtgcagatctggagggactcggaggggtcggcgccatcgtcgtacttctcggtgaggcagggctagatctttgggggccctcagacattccgaaaactcgccacaaagacctggtagccaagcttacctagtggggacgtggggggccttgccccctgcctggggtggcgcgacactcctgaggatgctgcgccttccctcgtagcggcgacgcgacaatcaccacgccggcgatcgaaagaacctcaaaaatcacgaacgcgcctcctacctggcgcgccagctgtcgagaggtgaccctctctagcaggcggctgtgaggcccccctttgagagttcggccgggggcagcgggtgagattcgaggatttggtgagcgaaactgtgtgtgatcttgatctcggaggctcctccaagacgatgagacaaaagaggtttatacaggttcgggccgctatgaagcgtaataccctactcctgtgtgtatgattcttctgggcttagaaagtccctgaatccctgata

SEQ ID NO: 61736 - DNA, 17845 bp, Oryza sativa
tcaactaaatgactacgaaaaattttcaaaaaaatcggcaagatagatcaatatgtaatatatcactccacaaatatgcaagttaaaattcaacttctacaagttgtaacaaaaataacaaatttaactgtaaatatacatatagtaatttgagttttgtttgttatttttgttacaatctgtagaagttgaattttaacttgtatgtttgtggattgatacattacatattgatctatcttatccatattttttcaattccttttataattatttagatgacatgcaataaatgggtggacattcactcaagcggttaaaatagtttctcgattgcaacagggaattcgctgcggttcagtaaagtatttgtggctggattgttggagttatcgcgaacagtggcaccacaggctgaagctgcctgcccactacgtaatattattttaagcgagacttgattagttttcacgcatgcactcctgatgtcgtccaccaccggcatttcgatccaaccggggcaacattcgctctgatccaacattcgctctgatcctgaagaagagcatgctcgcagtagcagcaacttgcaagctagtagctagcaacaaagtcgaccagtgatatgttgatggaattgtgggtgtataatactcacgaatgttacgcatatataaatagactataaatataattttagtaagactagagatataccgttggttttcgtctttgagattagcgtgtgttagagggtgcagttgtgaaggtgtgagtgtgatattttttgcgtttgtttaccgtgtaatgaaaagaaagaagtcgaccggagatattctcctgccgaaaagtgatcgatcgacataagaaaattcaacaggtgctgtatcctttcttttctgttccatagtgcagcggttcaattttaaattcagtttaaaggggagagattaatttgaaagggagacacgacaggattggggttatcgctaatgaaatcatcatcatggcccggtggtctaccaggtgcaacaaggttagccactggcccggtgcttttgatcatttttgatgaaccagtgcagcacaagtagctgatgctgacggccggcgcctgtcctttccgcgagcaagaggtggctttattactctttccgttactaaatatttaacaccattaactttttagcacatgtttgatcgtaagtcttatttaaatttttttataaaatatgtaaaactatatgtatacataaaagtatatttggcaatgaatcaaatgatagaaaaaaattaataattatttaatttttttatataagatgaacggtcaaacatatttaaaaaagtcaatggcgtcaaataaaatatatttaaaaaaatcaacgccgtcaaatatttagatacggggagaacttcgtaagcggggttgttgattgcaaacttgggactactggagacatgggcccggaggatcgattgggcgcgactccctcggcaattcgccatgttcctgtatggtcttctgccggcgccattgtagcgtaatctattggatgagcggcggcgaagctgagctgccgtcttaattttgcttgagttatatatatatatatatatgaaacgaaatcgtgctgttccggtagccggcgctgctgattttatgagtttgttagtaaattaggtacatgaatttgtgagacaattaactagcgcagcaaccaaaaaggaaatacgtacaatttggtattcggagagaactcgagagctcaatggaaccatgtcagactatgatccaaaaatgcacttctcttttgctttttagccctagcggacaactttagatgcaattattgcagcaacgtgcagataaattcgacgattgtacgaagtgagcataactcaactgattaaattcattatgatggaaccaactaacccggattaattgaagttctagactttaacggctaaatatttttcagtggtaggcgacgtacctgtcgtgagcgaaacgtctgtgatgacattgttaatctcaagatatgtctaacaagtcttccagagatgctcataggagtagagtgtgcgtgtgtgttcgtaggggtgagtgtgcgtgtgtgttcgtaggggtgagtgtgcgcgcgttactagcgtctttttttcacgaattgtatattatataataagttgtacctgtccttctactgatattgtcgaggggtgaccctctctagcgggaggctgtgaggcccccctttgagagttcggtcgggggcagcgggtgagattcgaggatttggtgagcaaaactgtgtgtgatcttgatctcggaagctcctccaagacgatgagacaaaagaggtttatacaggttcgggccgctatgaagcgtaataccctactcctgtgtgtatgattcttctgtgcttagaaagtccctgaatccctggtatgcaagctagggttagacaagctttggctcagggatcctcagtccaatcccccttcctcgctaggtatggtcctccttttatacttctaaggggatatcacatgtgctgcgagtgctacctagggagaagggaaaatattctctatattaattacatgtcttgtgccttagcccagaagctatctgcacgtcggttgctgcgcggggcccatcaaatcatgcagggcgcccttgtcatttgccatttaatggatgaggacttccgggttctcgttcacaccagaaaacgggaacccgggtcagttcagagtggttggaccagctctgaccggggtaagaggctgtgaaacccctcatcattatgatgggacgggacggagcacgccgctcgccgcctgacacactgacagggcgggggtacacagtcgccgtcccatcggtcattcaaccggtcacagaccggtcagatgcgcagcacgccacattaaatacggcatggcgcggttgcatagaccgctttaaatgcagttaggtgggcgttaggcgcgcccacctaaccctgtacacgtgggctgatacgtggagggggtcggggcagctcgaccccaagcaagggcggcctcctccctctagcttggagggggcagccgccgtgccaccccgggctcgacccccctcggggggaaccacgtgggtttgggggcggcccaaccccaagctgggagggggcagccgccgcaacaccccgggctcgacccccctcggggagagccacgtgagtttgagggcggcctgctccctctagctgggagggggtagccgccgcgccaccccgggctcgaccccccctcggggggagccacgtgggtttgggggcagcccgaccccaagctgggagggggcagccgccgcaacacccgggctcgacccccctcggggagagccacgtgggtttgagggcggcctcctccctctagctgggagggggtagccaccgctccaccccgggcttgatcccccctcacggggagctacgtgggttgggggctgcccgaccccaagctgggagggggcagccgccgcaacaccccgggctcgacccccctcggggagagccatgtgggtttgagggcggcctcctccctctagctgggagggggtagccaccgctccaccccgggcttgatccccctcgcagggagccacgtgggtttgagggcggccccctctctctagacgtgatacccccgggcccatatcaccgatagtagcccccggcattagccctgaccaaaaccttcccccagtggccagggttgacgccactctcctagtctaacgatgtgggcccggtctcttctccattctttgctggcactagggcccatgcgcctttttcgccccaacttgagggcgactcgccagcccgtaccttgggttgtgaatttattttctgtatatattcagcaaacgttgttagattctctcgggcccgcggcgcaccttgcttgcccctgccttttgttaacctctgttcatgttctacttcatctattcaaacgattattttcgtgtgagtgtgaggactgaactttccatagccagcaatcctcacccgcgatcaagccaagctgggtgccatagccagccggcggggccaaagccagttgctacgggagagccagcacagggggctccgggcgtcaacggcgtccagagctcgacgcaggtctaggatagagctaggaatcgtagcccccacacttttagcaaagaatcattttaatgggtgaagtgaatacaaactttttgttaccaaggggggcaaatgagcgtgtgacacgtgggaatcatgggaccgcgaggaagagatgggtgagagataaatataagccatgataattttgctgataagcatgaataaagaagatatatacttaaaggaagtattacaaatgctatgctcaaaaagagtccccggccaacgctgagctttcccagagaggtctgctttggtccgggtattgtaacacctcctttgttacctttgtttatccttgtttacacgttgcgacctttcaaacctttggctcgaagagggctccccaccctgggctccgaaccctttagggaagctgttgacagaaacacgtggcttgggagatccgcttaactccagtgtaggtccaaaactcgccttcggatgtgttagcgtgccagttgatttaatcctgtaatcaacaagaaatagaagcgaagaaatcgtagttaaatttataaatgatagccgatcagctagatgccgatgacatatcatttatctttgagccgatgtcatctgtgtatcgatcggcagttataaataagtaaagaagaactaaatctacttgatcggctgtagatattaacaatatatactccttatatcgatatatacttaaatcaagtgattaggatagatcggtcatcatgccaagacagtataaatcacttagatcaaaatatatgtcaataacaagattatatatgcttatagcatagctgatcagatagatatagcatgtatcggctaatactccgatactactctatatcaagatgttaaagcaagtataatatattgagcaaaagcctaatatacttaaatacggcaagatcttaacgcaaagggcagatttaacatgtcaatcaagcgtataggataaaaagtagttaaatcagatacgatcggctgaaaccccgatgctattctaatcggcaactagaaggcatgctagggattgatattctaagcacgacttaatagatcaaacttaactgatgcagcattaagtatgaaaagaagaacgatatctagacaatcaagccgctagaagtctcatagaatggtagatgtctcatataatctagaccaatatcaatatttaacctaatcggctaccctctattgacagatattaaccgacgtcaggttagatgatgatattgctagagattatgtaagacatatgataactcgacgaattacataaacaagattagagtgtcataaagatggaagcactaatcccgagaacgcaagccaccataacaagtttacctcttgttgaagatcaaaaccgatgcagctcaacccgaaagcaacaactcgtcgaaataaaacgaaagtaaaaagggtggcgatgcgccgagattgtattgaacgtgtgtgttttattacatagggctcggggtctatttatacccgaggattacaagatatgcccataccggacacaaccattatctctaacaaactctaagataccacaagtctttgcggcagacttttgcccacacttatctataaggaattcacataaaatatcctagttaatagatacaattgccttcccaggactctatccatgcgtggcaatcatcttgaagtacattaacttgaacccgatgtcgcgcacaagccgtattgtcggaatcgtctatatcgacttatttagctcgactcagactcagccgatcttgtcgtagctgatccggactttagccgattcctgccctgttttcaaactcgatctccgcttctgactttgcttcgatctaatcttctctccgatgctgatgttaccaaatttggttgttaacacatgccccacaagtccggcatatttgataatgttctggatttgccataagccgactccgagcaagtctcacactccgccacttttaaccgttattccagcgctttaaatactacctgttacccccgagaaatctcacgccgtgacttcctttttcaccgctcaagcgaaaccttttctctctcttcttggcgattcccccggcgcaaaggcaattcctaggcgacttccttcccagcgagatctccgcccgcaccaatgtcgtcttccgccagcccacttcgtgcaccatcggccgaatacgctgaggtaatttctcattggctaaatccccttctttagcagcaaatcgatcttcttcaatctgatatcactctctccctctgaattgctttggatttgcagcacctttccaacctagttgtcattcccagcctggcgcatgaaaatcactactttcttggcccaatcggcaatccagaccccaccgagtttattattggtgaaaccaataggatccccttcagattaaccaacccagatctaggtcactggaagaataccttcaaatcctggccatccctagagaaagttccaccagaaaagagctggaccacatggttcaaacgtgtatcagccagcaagagggttcactgggatgaaattggaatcggccaagcacttgaccttactatagcgaattcggccaaagatgaacccctgatggcaactgcttcttacttttggtcaaacactaccaatgcctttctgttcaatcaagggctgatgactctaactctcatagatatcattatgatcacaggtctggatgttacctcatctggcagcatacatgggccagggctcggtcacccctcgagaacatgtggctttcctattaatgtggctagaaaaatttcttttttgtggatcaagttgtggccccacaaccaactggcaatttctggctgaagctctagaaacaaagagacaattccccttgggcaaaattctcctcggctatctataccagatgctgagcaatgcatcagctaagatagcagtcggctcagtagttggagcaggtggacattggtggctactgcaaacctggttaaacctgatagtcatgaaggttgtcaattggccatccgtatcagaaactgaattcccaagactagagccgattgtagatgatgatggagaagagcgtactcatcggagatgcacatcctatggagaatacgcttctacaccaactgatgccggagcaaaactatcggctgaactgctcaaggattggttttgtagcttctatgaatgctttcagaaagatgctagaatctggttcctttatgaagactctgcacaacttgagcacccagtggacttcagattcgaagacatcaaccatgaagtataccaatcatccagggaaatcttctcggctgcaatcagcccatgtgtcctccctgttggcattcatcaaggaagaaacatccaagcttcttataaattctatcatccaatgagctcaactagataactcggaatgggccaactcccaatcggcttgttctttgccgacaagatccaatgccgaggaggaatttcatgaaccctgatgatggatcggctgcttagccttcaaggaccccctctgggcagtattggcaacatagaactggcaacattcagaagcaaaagcttcgataggtggtggggtgaatggaaactgcatttacttcactaaccagctttgatgtatatgacagacctctttccagatgttgtccctcaagtaagcctccaacttcgctcaattttagttaaataattgtttggccgattaatcttaaccaatcatccttttggtttgcagacaacagaatcttcccctcctcaccaaagcaacagcggcaaagacatccagtatgccccaggtttgattcctaacggaggtgggctatctcctccagttatcggctatgatgcccccaagacctcagctcttcttcaagggctcgttagagaaccagccgatgccggcaaaaagaggaaaaccagatcgtcggctgtaagcatcatagccccaattaaggagaagaagacaaagaaaaccaagccagctgatgatctgcctaccctggatccatccatcgaacaagctctggatgaagaggccattggagacgaggttgatcaggccgcagccgaggtaagtgacactgaaagaacaccatcggcttcgcctaaacaaacctctccaactccttctgctccagttcatttctcaagggtaagtgtttctcgttaatctctttcgtgattattttgtcttatagccgatcattcccaagtcttataattgcagaaaaagaagactgcagtgaagaagaaatcggctgcaacaacatctaaaccagcttcaccagtaagatagttttaactttcattagttaattttttagccgattctatcttacacttgcttcctttcagccttcacctcctccttctcctcctgttcaacaatcatcaagtgatcagacctcttcagctacgggaagttatcacatcgaggaagaagaacaaccagctgctcctactatcccagtacatttcttttatcataacaagcattcagatcggctacacttgtttaacctctaactgcttctaaattgtccctacatgtcacgcccggatttttgtttcaggatttataaattatttaataaattattaatagaatttatattaaatgttcattaatttacaagtgaagttaaatgtgggaaataaaatttcctaaatataaagcatggatggatttaaattttattaaattctccatggttaattatactctctggaattttctcggatttttcggagctcaattcctaattttaatcatacaaagagcatttcagtaattacccacatattaaattaatcattaaatggtctaattataattttgttaagtactttgagtgtccaagtatgttcaagatttttcttggaattatttgagcattggaagtatttttaacaattcaaagatcatttcattgattaatttaattgggaaagtaataaaatccttctcctcagcttgggccattttcagcccattccttcctttccttcctctctcttccgccggcccaacctgagccgcctcctctcctctcagctcagccggaaaagtctactttacctccctagcactgttcatcttctacctctagcagccgaactgagaccgagtgggctcggtttttcccctccaaatccgaccttttctcttgtgttttcctaaaattagttgaggggaaatattcctcttatcctcatctatctttacccccaaaaatcggagtaaatcgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgctgccgccacgtgctccaccccgccgtcgtcgccggccgagctccatccgcgtcgcgccgccgcctccgtcgtcgccgccggtcgccgtcaccgccgtaaggtgcgccgaggtgtgggctagcccggccgccccttccccgtcgtcgccggccaccggagcccctccgccgccggtcaaccgagccgccgccgtcgcccctctcgtcgccggccgtcgtcggtcgtcgttcggcacttcggtgagcaccatcgggttcgtctcgtcgttctctacgtgtaggtgtcctccaaatccgcagccggtcgccctagctccggcgaggtcgccatccgagccggccgcctttgatgatgtcatcatgacatcatcggtttttctttttcccgtttttctaatagattaaatcttcggaaattcataactaaatcatcgtaactcggttttgagtggttcaagttgctaaattcatctaaaatcatgatctacatgtttgtttactttatatgtattgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttaggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttaccgtgccaaccacaagccagcgtgggcaacggctttatcttttgtatagcgtgattcattatagtgcgccagactgagaagtagcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggcgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttaggcctgtgcagcatgggtgtgctgttcagtgttgattaaaattgatgattaattactctactattttaattatcttaaatgttttgctaaatgctgctttttgcaaatgggcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacactgcaggtcttagctgatcttttctctttcgatatcagagactatcttgatgaaggagaagaagatactacaagcaaagcattggctcctttatctgatgatgtgaagaaaactctaggaagtattttggatcggctagaggcatcatcactagatagtttggtagttgactgtggctcaatcagggctcggctgcatgagattcaagccttaattccagatgaattagccgatatccttactccagctgtttaccttgagcaacaccaattcaaactggagaaagccaagttaagactagccgaacggcgagaacgtaaggacattgaagccactatccaagccaaccgacaacttgtgcatgaagagaagtccaagcttgatcaattatctgaaggcccaatcaaatctaacattgatcggcttgaggctcccaaaattgaactcttagcacaacttgaagaatgtaatgctgagctagatatggaacacaagaaactggccgatctcccaaaatctattgaagaacaaaaaacaagactcaaatcggctattaagcatgttgctgaactgaccaagtccctgaaagttatccctggaaccgatgctcacgatgcccaagccatagaagaagtagagcagattaggcagaaagctatatcggttatacagcgatacttatcactgtaatcttagtgcaataggacttagaattcttgtaatcggctaaaacattctgactcttccaaatcatcggccgacataaaaccttagaatttcctttgaaatttgcacagaaaattttatgaatctgaaatgaatctgaaaattttatgaatctgatatatatatgcccccctagttttataatggcgagagcattgataaaattatgcaccaactaagggcgatataacaatatcggccattgtacatcggcaaaccacaaccgatgacattataaaaacaactaagggcgatataacaatatcagctatctcaaggcgatgtaaacacatcggctgtcgtgtatcggcaatagtagccaatcatgcgtgaacccacacacttgggtaatatttcttcaagtatttaccattaagcgctcgcccatagacttccccgtcaagcccttgcaacatatatgctcccttagaaacaaccttatgaattaggaacggtccttcccaattcggcgaccatttgccgaatttactatcacgagtaccaatcggcaaaatcagcttccatacaagttctccctccaaaaatctttagacacaactttcttattacaatgccgagcaacacgttccttatctttagtaaccttcgcaagggctcgcaatcgtgactgaaccaaatcttccctctcatcagccataagattgtaatactcatcacgatgttctacaataaaatcggctatagcctgtcccttaatcgctttcggtgattcataccgaagatcaaactcagtcaaggaaaatatccacttcccaactcgtccctttaatattggagccgacagcatatacttgactacatcggctttgcatataacagtgcacttgttagataacagataatgcctcaacctcgtacacgaaaaatacaggcacaagcataacttctccacaggagaataccgagtctcagcatccaagagccgtcgactgagataaaacacaactcgctccttcccttccaattcttgaatcagaaccgagccgattgacttctcaccagccgataaatataacctaaacggtatccctttctgtggaggaatcaaaacaggaggagagctgagatactccttgatattatccaaagccttttgctgctctgccccccaagtgaattgctgattggcttttaatttcaataagggtgtaaaaggttccaacctcctggacaaatttgaaataaaccttctaacaaaatttatcttgccgatcatctcttgtagctctgtcttattttctgggggctgaattttcttgatcgcattaacgctcctttgagtcacctcaatccccctctcatgaacaagaaatcccaaacgatcatctcttgtagctctgtcgaagggatgcaacaattggcatgaatctaatcccttccaagcaataagctgtacgaaccctttccaccgatgacaaaaaaaggtggtaggaatagtcttgctgccgactgtcaactccacatttagaacacctttggtctccgatggattaccaccaaagtctttgagcaccatatttgtcttgatgagatcctcggcgttcctacccagcttcctgaacgtagcataaggcatcaaattcaccgcggccccaccatcgaccatcatcttagacatcggcttcccattgacgtagccgtttatatataatggtttaagatgccgattttctgtcccctcaggtttctcgaatactgcttgttctggcaacaggaccaacttagccgactcctcttccacttcgtcaacatcggcctggtcaatcccgaattcagctggcaatgtaaagaccatgttaatcggtgccgctataacactctttccttttcccaacctcttcacctcatcagctgcagcatcatcggctacgggaacctaattcttgacacgccactcctgtcatggctttggtttcctcagccgatggttgatttccttctcaacctcctgaaaacgctccctgctcctcaatctctggaccctcctcttctgattcttcgtgaaaatatcagaaggacaccattgattcttcctgatcgcttcttcctcttggccacaatcctgattcatcggacccaatctctgatgaacagggagtcttgcctgtttcagccgattatccctattatatgatcggctcgagccctcgatgatatcactgcatccagggcaattttcaatagatggcaacctcatcctttcgttccagcagaatctgaagaattcacaaccccgatgaggatcaaaaccatcgtcgtattcttcgtaatgcctttcctgctgcttatcatatttcctctgatacttgttgataatcttagccgaatttactcgaaaaccctttgcatgggctctattggctgcttgaccagctgtatgcaccatattcacgggaaaaggattcccatcgaccttcatcggcttcttggaatcatcaaacctaatctttcccccttcaatggcaacctggatttgctgtctaaagaccttacaatcattagtagaatgggaaccagaattgtgccatttgcaatatcttctcttgcctaattcctcagccgatgggatcgtatgaccagcaggaagctgaatctgcttttctcggagtagcaaatcaaaaatcttgtcagctttggtgatatcaaagtcatacttctcctctttcccatgacttttcccccattggcatggtataactttcttactcctcacccattcggctgcagctatctcagaatcatcttcttcgtcatccgaccaatacatatatggacaaacgtgattaactttcttagagcttttcctgacttccgccgacctatgctcgtgcaaggttaccttctgtattagatgcgataagctatcgaagtcttcggatgagaatttctccctgattggaggaatcataccctggaaggccaaatcggctaactgagcatcagttaaactcaagctaaagtacttgttcctcatctctctgaacctctgaatatactcgtgcacggtttcatcatgccgctgcttgatcactgtcaagtcggacaacttcatctcatggaccccactgtagaaatagctgtggaattgcttctccaaattggcccaactattgatcgacccatatggcaaagaggaaaaccaagtaaaagctgatccggacagaaataaccggaacaacctaactctcaaggcgtctacagccgatgcttcaccgcactgagcaagaaatcggctgatgtgctcataagtcgacacgccctcttgtcccgaaaacttggagaaatctggaactttaaaccgattgggaagaggaactctttcaaaccactcagggtaaggctgccgatacaaacttctagtttcttttggtttaagcccaaattgctccctcattacatcggcaatcacatcggcccacggtcgttgctgagctgctccttgtggttgttgctgcatgggctcgaattgaccaaactgagatgcaaactggggctgagccaatccccctggccgatattgggcttgcggggaaggaggctgatattgatagctcaagtttcccccttggtagttatgaagattcggctgggtattgcgtaccaagtgctcaggaaccatctgaggcaccatcgtgccatccggttgtgcatggtgaaccaaatgctctgagacgacttggtttacaaattgctgtgcaggttgcccaccaggtgctgtgaacccagccgatgcatttgctgaccccgggtgctgaatcggctggacgatctactgtcgtaccggagtctgttggatcggctgaagccgctgccttgatggcgtttgctgaatcggttgcagaggctgctgtcttgatggtgtttgctgagctggttgtacgacctgttgttggatcggctgtacaactggctggattggtggtgtctgctgaatcggctactgctgcactggatcaacaataagtggaggtggcaaaaacatggcagcaacttgatcttgggtcggctgattcgtgatctgcccagtagactgtggatgttccctcattaacaaccgagggttcatcggctggcctgacgccatagctgatgtagcaagtaggggagttgacgctggcgccgttgactgaattgtgggtgcaatagagggaatcacttggacagatggttgaacatcagtgatcaaagatcgataattcgggaagacacctccttgcaaataaactgggcctgtagcctgatgctcggctatcgaaccatcggctattttcttcatcatgtttgacaatgtatttactaaaaccccggactgattgatcagagcatgatgcacagcgtaatcaacccgatcttggaagttgttgaaaaagtcctgtgatagctcattattctgattaagatttcctccttgcggcccttgagcaccattaccttgagccccatacgctccatcaccttgtactccatggactccttgagggttgtcgccttgatttcccagagaatcaccagtatcacctttgttgcttggctgagccgagcctcctggagcttgtttcacctctccatctttagaagaaccggttccaggactatcagcaaccacttttatcttatacttctgaacaaacgttcccttgcgagtctgcatgaatgaattcaggaactggtcacgtgcttgctgcatcgttgcttcaaactcctgcttttgctcaggcgtgaatttctctggatcgatcggcatgacgttgtcatcaatgatgtcggtcaatcccggcttcggcgccttgcctttaacgaaacctgggcttgatggtggcggtggctgtttctcggccatcaggagggactgacgtctgacttctaatcaggtcccaccaggcgtgccaaaagcgtgttgacagaaaacacatggcctgggagatccgcttaactccagtgcaggtccaaaactcgccttcggatgtgttagcgtgccagttgatttgatcctgtaatcaacaagaaatagaagcaaagaaatcgtagttaaatttataaatgataggcgatcggctagatgccgatgacatatcatttatctttgagccgatgtcatctatgtatcgatcggcagttataaataagtaaagaagaactaaatctacttgatcggctgtagatattaacaatatatactccttatatcgatatatacttaaatcaagtgattgggatagatcagtcatcatgccaagacagtataaatcacttagatcaaaatatatgtcaataacaagattatatatgattatagcatagccgatcagatagatctagcatgtatcggctaatacttcgatactactctatatcaagatgttaaagcaagtataatatattgagcaaaagcctaatatacttaaatgcggc

SEQ ID NO: 61737 - DNA, 648 bp, Oryza sativa
actcattatgctatattgtcgaagtcatctagctacgtgataccactgaaagaagatggggattgtagctaaaaagacagccaacagttgacaaccggaagtaaactccttgataatctcactcccgggcaggaccttccccatacctgaacctggcctgcttctcatcgttgaaactcgaaggcctcagctgccgcagttaatgtcagcatggcggcttttctgacctgcaacggaaattccaacacgcaacttcgaccgttcgacgtcgcggatcagttggtcaaataaggacgaaacacaccatatttcgtgctatcaatcatgataatttgaacagcaaaatagaaccaagttcacgcaactaacaggaacttttttcaaagtgtttgcagattatgacaggttaagaaacatctcctgttcagggtttaatctttcggttgggttatttgtatcggtggtggcttgaataccgaaattttggatatttggatctgaacttatatgaaattttaaataaatttgatcaaaattgaacaaaattatacaaattcacgaaaaaccaaaaaaaataaaatttcgatagaacttggatttccaaaaatttcggttcgcaattttaaaccctgcttctggtaccccacg

SEQ ID NO: 61738 - DNA, 28541 bp, Oryza sativa
aaaagaaaaatggtaatttagcaagccctagctaggaattaggatgcatcaatctctagtagttcttgaagctgcagctagtatagctcccaaccatttctcctcttccttttctttactaatatgatcagcatttcattaagatttttttgtatatagtatagctacctacattttctcttgatctgattatgccaagtactaattttctgtccattttactgatgatgatctggttcaattccccatgtgtatatgtactctcaggtggcaggtctccagtccgagctgaactacctgcaaggtcacctctcgacgatggagctgccgtcgccgccgccctacgtcgccgggccgaccctggcgccgccacagccacagccactgatgccgatgaccgccgccgccaacttcaacttctccgacctgccatcgtcgtcggcggccaacattccggtcaccgccgacctgtccaccctctttgacccactgccggcggcgcagccgcagtggggactataccagcagcagcaacaccaccaccagcagctgcatcatcacccctatgaccggatgggcgacggctcgtcgagcagcagaggcggcgacgacgatggcagcgacggcggcgacttgcaagcgctggcgagggagcttcttgaccgccatggacggtcgtcgtcgagctccaagctggagccgccacctcacacacagtgatcctcctcactgtgtgtgatcatcaattcagcttagctagctagctcatggactaattgatcaggtgttaatcattcatgaatgcattggttgaggcaagaagagaatttaatcccaatggtgaaatttttttcaccaaatcctccatgtcgttgaggcgaaaaatcgaacgacgacgacgacgatggcgaggaagacgatgatggtgatgttggggatggagatggtaggtaacaggcattgcccggttttcgcgtatcatctttgttcttgggctagggtgcaaggggtgcccacttgcaccattttataatgcttgggagtttgctccaaaagaggaagcttggggatgagttcttgttagcttagctgtagccctgatcactgttccattgcaacagttctaattgcaaaaaacaaaacctggtctaatttagttcaatatacaaaaaaaaaatctttgtctcatcgcagattaattacggttgtgtttgaagtttgtttgatttctgtttcaaggttctaactgaacatctgaagtgaagtgtagtcagtcttaatttgggactttctgatctctctatgacaaatgagctttttttttttgccataatatatacaacagctagcaagtagcaaaatgagcatttttggggttaatggtaactgaacatatatgtatggtggcaactgaataaagtgtgaacatatgtgagtacttggaggctagagccaggtgttggtttccttttacttgcttcgtgcttctacaactacaataatgcaagtattcatatggtgcaaccttagtcttagattcagtctggctagctagctagctatttctaatgggacacagtacatttaaaacaagcctaattaaactagtttatttctctatgaagagtcgtggtatatctggggctaaatgattggcaggggattatattttagagtttgatatatagatgagtgagagacagacaggaagcatagctttggtgggacatctttgactaagaccatgcagcatgcacacaacaatgttttctctccttatgtttcttgaagttatatcatatgcccttgtattcagggactcctttgttatcaattgttggaaaatgacaagcggttgggatatgaataatatgatgccataggaaagtacatgtttcagtttagctagctctttaatgtgtccaaaccgcattgaaaagtttcatgattactactagtccatgtaggtaactaattattaccgtaatgaacatgcatatgcatatgagttaattttggcatgtactctaagctaatttaagatgatgtttctgtggcgaccggccatgcgtgcaaatacatggtactatatatgcataataatagggatactgctactagttaagtaagttaattatgtgtctctacattactctttgattcgttaattaattagacaggtcttttttttcttaaggaagatcgtcactaccgtaaattatcaaagcagggtaaatttgacatgtaactatggtaagttagtaactattataactagctggtacctagcatcaataatattccttgtaacaatattatttctgcaacttttgcacaagtaagaatataaacattaataggaaacaagtattatttgtacaaactaaagaatgtaataattagttggatcattagtaatgcatttaattagctttcttagaaataagagcattaatcaacagttgtcatatatgcaatgaatcgtgtcattaatgtgtacattttgcgtgcaaggatcgcaaaagttccatatagctgttactattctttgcaaatttatcgtgcgtgatatcaaatgtattggattctcctactattagaattgatacataagcgacaccatcacacatgagaacgtcttttcttaatatatataagcacaagatattagctagatgccaaattaaatacttgatttccagcacttcatagatattagttacctttctcaagtttggtgtgaaaaaaatgcatatctatatatatttgacagtattttagtagaataatgtgagtagctagctggaaaagaatatatttctgcatgctgcaaatatatggtaccaactgttcagtgctaccctgaactgaagtaaatgtcttattaatgaagagccatcttatgttgttttagaaattctatatgtagtgttggcattgacttgatttacacactatagtgttatatatgcttgtagctgcacaaaagtagcttttagttgctggcatgtcaatttaccaaacagaaaaagagacgttcaatttgtggatgaaaaaaaaaggaatattttttaaagacgcaagtttaacacaattcaaaatgaagcctttcgatgttgagtttaagtaatctttaatttaaatataaaagaataatggtagtcagggttaacactgcacaaaaaagtgaccttggtcctggtcctaatgaagcggtttccttaaaacctgctagtaaccacctcacagttctcaatgctatgaagaaattaaaaagtcggttctaaatcaattaaggtaaatcatggaagaatatagatgtcttacgaaagtaatctgccccaataagcaatagtacagtggtcagtggagatcagagaaataattttgtgatatggagtttaaacattggggtagcggaattaaactactatttggtgtgaaattatattaagtaggtcagaagcatccatacatagtacttcttctgtcccaaaatataaagagtttcggttgaatgggggcatatctaagtattgcgagtttggacaggctacatcccgcatggaaaaaaattgttgtttttcatacctttttgacaggcgggtgagccaaccacgtgaaaaaagtttttttttcgtagtgtatccagtagactgacatgttagcccaatggcgaaatcggccctagagcaaataacgttggaggcaatataatggatcaaacagagatggtgtagcagctagccgtgtgggggccaagggcttttggaggcggctattgcaatttcggtttgaaatttcggatcccaccggcaaatcaatatatcaaccaaaattttcgggatttctcaaatttttgttgcagttggtacaagtttattcaaattcggtcaaaatctatcacaatttccaaaaaaaaaggggtccaaaaaagtaccgaaaatcatgaaatttcataaattttggtcctaccaaaatcgaaagtgtaaaccctggtgagagggtgccagagagacactgctcaagggataacgtggcatctcaaagtgttagacaatatatccatccatgatgcatgatggtcaaactacactcaaattagtgagatcaaggatgcattcacacctgtgtgagtgtgatattatgtgtgtgtattgtggtatgtgtacgtgtgtactaaaattgtcttgtttggactgatgagaaatgtatacttaatataagttgagaataaaaattagactgtaataatttttttgtagaaggactgtaataataattgagagaagaaaagtatactataaaataactgctctataagacctattctccaactttacccgctatgaccaaaacaaaaattttcaggatacccaaagcacctcccacgatgccggtaagagttctaaaatatatatactattaaagatcttccttgtagatagattgaggtttcagaaagcttttagatgcaaccatacttttccgaaacctgatttatttaggttgccgaatatggagtattttccaaattttcggaaatatctaatatatcaagggtgtattctccttccatcataactatttattgacaaactccaaacaaaattttggaatttaaacaataaatataacttagggtgtgtttagttcctgaaaaaagttggaagcttaaataaagttggcagttcgaaaaaaaaagttgaaagtttatgtatgtagaaaagtttttgatgtgatatgatgtgatagaaagttgggaatagggagaaactaaacacggggccttgtacaatgcttagttttgaaacataaaaataataattgttgtaatcttaaacctattattttattatcttaaacaatactccctctatttttttatagatggcgccgttgacttttggatgcacgtttgaccatttatcttatttaaaaatttgtgcaaatgcataacatatactccctccgtttctaaatattcgacgccgttgacttttttaaatatgtttgaccattagtcttattcaaaaagtttaagtaattattaattcttttcctattatttgatttattgttaaatatacgtatatgtatacatatagttttacgtatttcaaaaaaagtttaataagatgaacggtcaaacatgtggttaaaaactcaacggtgtcaaaaatatttagaaacggagggagtacatcatgcttaaagtatttttcgtgattaaacaacttacaacaaaataaatagaaattatgtaaaaaagttttaataagataaatggtcaaacctatattcaaaagtcaacaacgtgttagtatatcattataacggttgtaacataagagattagcgtgaattaattgtgcctccttgctatttagtgaaaaaaatacaattggatgcacctctgatgtttttttttcaatgaatttttatattccatcccttcttattcaacttttcttaaagaataattttgtttcagcatttatttaactcggctgagataaaaataatgaatctgaaaaataaattttctttcgatccgcacttggctcaacttggttcacacagtcacacttagcccgaaaaaagtctacttgactccctcaaatatagatctaatctgatacatagtaccattcagccgcaataccggatacctcaacccccaagtataaaacagaaaaactactcaacagtatcctgtacacacgggataactactaccactaaatatctagcatcttatcctcttctttatctcttcccattcctgtcccccccctctctctctctctctgactaccacaacgatggcggctagctgcacgggattgcacgttgggcgtggaggacgctcggcccgctctccttcgccggcgtcggggaaggcggcgccgcgcagagctactcctgccgactcaagaacacgcggtgcggcggtgcaacggcgtgccgcctccccatggcggcggtgttgcgccactgctcgcatccattccttcgatacctgtaggtacccctcgcactaccttccactctgcctgattcctcccccccccctctctccccggtcggcaatgcttcaccgccggttgaattccttttctctttttttggtagatgatttcctttgctgatttttttctccggcttatatggatagtatcgattcccctgtcctatcctcttgaatctctccgattccacatgtaccaggtactacacaccatgcagctggtaccatactggtaccaggtaccagcctgtgatgtgctactccggttgcagaggagtgacgccggtgacgaggtatcacgcacgcctatggtacgtggtatcaggcaggggcggatctaagagggattaataggagggtctgaacaaactatacaaaattataggccctcttctaatgaatatatgacagaaaaatttagtgaggtcttcatgagggatctcatggttacaacacgggtagtgggggctagagaccccacagaccccaccatgggctagagaccccacagaccccatggtggatccaccactgctgatccttgatggtgttgtcgacgtggccaactccgcacaaagctccttcgtggcgccgacgcaatggtggggtggggagagaacgtagtgctggtctcgtgaaggagatgaggcggcccccaccactagcctctcctcgggccccctctcctcataggctgtggagtccttgcggcgacgcagctgacaaggtcctgaacttgagggtaacgtacgagcctggggagaagatctggccaccctggaggagccaatcctagtggagaagtccctgagctgcctcgccttgcccgctgcatccaccgctccccgcggcacctccatcagcatcgccgccgccttcacttactgcttgttggggaaaagatagagaaggaagaagggggcttatatgtggacctcacctgtatttttgccatcaatgtagtggaccaagtcaatgtgtcacgtcaacaaaaactactatcaaaaccgctgagggagtcaaatttcactagctttaataatgagggcagctacacaacgggatcccgttgctacggcatactttaagtgacttatccctttcctttcttctgtataggtgagatttcacgtagtgaacgtgtgctcccttctggtacctggtaccagtggtggatccaccatggggtctgtggggtttcgagcccctactacccctgttgtaacgatgaggccatttccaacccaaaacattagacatagtttccataaactccacatcatcaagaaactagtagtagacaccactcttccaatgcaaacaccactattctatactaaaatttaatggtacttatctcacatgatgtcttggatgttgtgtagaaaccatgtctcatgcaagacatgatttccttctctttcctcatttattcacttgccacgttatttttcatcctatgtagcagcgtatttaatactatggacaacatcttagtcattgggttgggaatggcctaagatccctcatgaaggccccactaaaattttctgtcatatactaccttcatcttgaaatatttgatgccattgacttttttaaaaatgtttgaccgttcatcttattcaaaaaaatttaagtaattgttaattctttttctatcatttgatttattattaaatatacttttatgtatacatatagttttacacatatcacaaaagtttctgaataaaacgaacggtcaaacatgtttaaaaaagtcaacggtgttaaacatttagagaaggaggaagtattcattagaagagggactataattttatatagtttattctgatcctcctattaatccctcctggatccgcccctgtaatgagctactaccgccgacgccgacgatggaggagtgcgagctcatgttgctcgtccaggtcaccacattcgcgtgctgcagcttcgtcatcgggttccggttcagccgcgcggtggcggatgacccgaagtggcgcaatccatggctgtcatcggcaacctcgcccacagcgcggatggattcgccgctgagctcgtgtggggccgcgacgcgatcgcgaacccttgccaccgctgtcgtcagcagcctccccgacccaccgatgccatcgacatctccgccgactacatcaaccacttcaagagccagtacacacatggcggccgtcgccaggtgctcggcgtttgaggtgttgatcaccaagacaccaaggcgtggcagagccggagacgcgcggcggggttcgaggcagacaccaccaccatcaagaagaagacaggaagaggaagaaagaaacgagggagagagagagaatgacatgtgggccacacaggatgacttagcaagataggccggatcaagcgccacattagtaaaactgttgagagagttaaattataaagttttactaatagttagggatcaagatatctgatattacagtttagggttataaagttagattggagctatattgagagagtaaaattggacttatttccgcttagccctctgcttttccgcatgcatgggatggcctggataagttggcccaaatcaacagtgccacctagctcactttgtttctgggccatctcgaattcttttctctttttttttctactgaaatttcgaatcattttccttattaactaaatttataatacatcaaagttaaaaaaagaaacgtttgtctcttgattaaaaaaaagagaattttgttgatagtacagcagtaagcaataaagtgcatctgaataattagtatctcaaatttcatcactgtatttgggtcaaaagaaattcatcactataataacttacgataaagttgttgaattttttattctctaagtctacattgggaaacacgagcaataaacttacgtatttaaatataaatattgcactgaaatgagaaaaaaaaatcttgattgtctgttgtatatataagtaacttgtgttctcgaaaaaaagggggaaaatatacaaaactgaactcggttgcagcataaaactgatattgtttgaactggggcaacacattacattccaaactgttagcacacagagtatccaaatactttacaatcaaaaacttgacagcaaactccaaacttttttcaggttatctgtacagagaactaaccaaccacaacacaagctagcggttaactgaaccttggcaagagaaatctcttcacgctaacaacattaccttctcaatcttcatcgaggtagctaggcaaatttacagtgaggttccatgaggtataagcagtaacagcaacccaaaaaaatccagggcaaaggatggttcttagtactgacggctgacaaccacactgaatatggatacagctaaaatctcaagcaaaaactactagaatctggtaagtgcaggcatcatctacataatacacaaataggtggtaggttttgttggcaaaaatatacacctgcagtgcttgccacgacaagcaaaacaagctcaaaagtcggttagtattcgctcttgctcttcgaaaataaccgactgaaacctcggctctgtttctctgtgaactggttagtaaatgaggaagaggaagaagaccttgatctgtgctttggacgcttggagttgtttggagaagcgaagtaagtgtttccatcaagattggaggggcttttgtgtgttctatatccatttagcggagatacgtttcctgttcccggtgcacttgagaatgtgtgatctgtatcaaattgacctgacagcttcttaaaatgcaagccttgggttgttctagcttgatcttcagaaaacacccccacaggttgttggtttaacacagaacccagtggttctgctggaggggggcgaagagtctgcagctgacggccaagaagcaatattgtctcctggcattctgcaagcttctctgctgctgctgcgatctctttgtcctgccattattttaaccaagaatatattatggaatacacaacatgaccagaaaaaaaataatgtttaaaagaaagaatttgaaggacactgaagcgtttattgtccaggaagtatttattcggagagcacaagggaataaatgtgtaattcatgtgtttggcactatatgagctgatatagtataagagattatcacagatttctaagaaccaattctacgaaactatagatttgggtgcaatgttttgtgcataactatagatttagagcccatgcaacaagcaattggtcttggcactatttggcaccttctaagttttcaccaatttgttgaaatgttggcttgtgcatagcaggctgctgacacagacacacgcatgtcataagtattgggcacatagatcagctaaaaagggtctaatgttgcctctcatcactcaacaccatagacacacatggacacttttctataggctgttggatgcactgggacgcatgatttgaggctgtcagtggccaggtctattagaaccaattgcaactttaacaaggaatattaaagttcagagaaatgagcgttaatagttatgcctgtacatttatgaaatttattccatatttaatttttggggaatacgcaaaagactcgcgtatctttgtattgagaaggaagtttcagcagtacaaggtccccctaactgcaagcagccagctcgctacataggtgaatttctcgtggtatcaatgctcgaccagcttattctatatttaatgaaagaagctggagtaaacaaactacataggtttataatcagttacgaacatgaagtttaggcttagtaatttttacctgctttattttaacacctgcatcctcatctacagatgaagtattcttctcattctcataccttcatgacataaacaaagtcaacgaagaatctgttaaacatgcaacaaactaaaggaaacaagatgataaaatagtctatctaagtcctttcaacaaagaaaaactaaggaaataccaaaatggaaagacaggtatttcacctttcaatcttctccttaagatctctgtacttcgccaaatcgtcctgatggttttgtctttcatcagcaagttcagttctcaaagtatttatttgtctatgcataacttctatttcactttctaatttcaacttgtgtaactcaagtgatttgtatgattcagccatacacttcagctgtgtctcagtcaagctattcgatttctcgcatgcagataactttgacgtaagctcttccatgtttttctccatcagactaaactcaagctttctacattcgatagtttcattgcactttgctaattccatctccaatttcctcttctccgatttcagttgttcatattcctccattgagcacatctgcactgtggttttgacaacaaatgcatccctagaaccctcaaagtcaggatcagaagacgaatgaggcgcaagtgaacaaatatcagcaaggctatctttaattggctcatgatgcactttgttttccaataaggtcactttatcaacatagtccagattattgctctcggtttcagtgatgctgtctctcggcaatgtgagtttaatagcagaatttcctgccaaaatttccggtaatgcaatcaccatttcggcaagagcattttcgtttagcacaactttgtcagctatagtggagaacttttctattttctcaaggattgtgttttggtgggaacttttaccttggacctcagatagttgtcttttaaatggctggaaaaaatcaagaatttccaaaatagcatgtcttagaccatgatccacatccctcaggttcttggattgctttgtcaaagatccattatcagcaagtccattcatgttatcaggctgattcttttttgcactcactgattctgcttcttccttgatatctcttaggatatttctgataccctctaggaccttgccaacattgttctgtggtgaatgagaacctaagagagaagaaattcttgagtgcaattttgaaagtggggagttctcaggcagatgctcactgctggatggtgtatctgggaactgcgaggatggccatgaatctctatcactttcccgtttagtgatggtagtgagagttgtgtgaactttagtggccttcttcttgtcaataaagcttccacattcttttccttcaggagataaacacgccaacctctccatctctagaaagtcatccatgagtaccatctgattggaattttctgtcaaactgcccttacctccattatctttcttgatgtgtgagagctcagatatcaaagcattggcccaagattcggcacaacttgttgcatcatcaactccgtcttcggacatggaagtcagacttggtgggttacttccattcaggctcagtgcaccatcatggtgaacatcaaggtttgaatttgttggattcttatactgcctagcactcaccatatgaacatccatgctgcggagcttgcctgctgtcttagcacatgtgtttcttgacacctgcaactcattattacgctttgacagcgcctcttttaacatctttgtttcatcctccatcgataacaagcgtgcagtcagaaattcattctctttctgcatgtgctgcaagttttcaagagaattatcaggggatggtgacaaaggatgatggaaattagaactccttgaaggggagcgtcgcaatctgttatcagcatggtctctgccccagctatccacttccagcttcatttgagctaatgcagctggcccgggtaactttttccgaacaagaccacgtaacctttggcactccgcttccagttttgatattttcttgacatcctctacatgttgcttggttgctacatcagctgaacgcacactcatgttcttttcttcattgcgaatttcaaattctttggaaagaacatgtagttcatacttcaatgaacttatctctttttcaccagattgaatagtgcctttcaacacttcgatctgagattctgcttgctctttttccccaccaaccttcatcattaagtgttcccgctcttcaagagatcttgagagtgcgtcattctcagcacctgctctaataagctcatgttcaaaagaagctaattttgcttttagttcggccttcatcatctcccactgcttggtttttgcaaagacaacatcttgcacttttgctcgctttcctccttcactgtcctccttgcttcatacattccttgagagcaccatccagatgggcagctctttcctcagcggctagcttagataatgtaacagtttctagttgatgtttcaacgccaaggcctctgcttcagctttctcccaacctacaatgatggtacacgcattaatttacaaaatgctcctggagaaaattcagtcttactacttttattatgggagtcttactactagattactagttatggttactacagattttattgcatcaaataaaatgttatgttgcacacctccagtagttactaaggtatataatagaaatgaccaagttcaagatcctggggagaaatcatgatacagtacaatttactcaatagtctatccaacaaaaaaaaaagtaaagaatagcagcaatcagcttcaaacctgatacagcctcttctgccactttgacatgctgctttactaggctatctttggtagtaatatctgattgtgctgcagatagtttttcattcaacacattcaccttatcacatagaatcttcacttgctcttctgattcagtaagatttgtgtatctttctggtgaaatctgcacaaattttggtacttgttcatcctgaaaaacaggaaaatagtttaagaaaaggataatcaatcaagatgagtatttaaccaccatgttgatcaaacaaacagcattagtttttgacatattaaatgaatggatgtaattgatggcatttagcactaacgataaaatcagtgtaccttaagtctaacgagtaaatgcactgcctgctacttaaagggtaacagcaggcttgaccaaaaagcaattttatgttagttcacaatctaaggtacatgacacattaccataacaaaagtggtacatgacacagacttaaatttgagtacatcagttgggtatcagtatcacataaagttaaaaatcaaattgaaaaagagcatctcttagtaaagtttgtgactagttccctctattttcctatggacaggcaggtgatgatttggtactaatgcaggacaaagctgtgtaaccatagcatattaatatgcagagatactgaaatagaaaacaagtcaatatactggatagcaaataaaaacaagcataattatttgggttgatgcgcaatatattcatttcggaaaaataaaagcatgaaaagtatcaagtagatatataacaaagaagcacaattttcccaacaaagccacacacaccatgtgtagtaggatgcttatcaatttcacaaagtacagagtataagggagcacagtataattctttggaagaaaaagggcagattaaagaagagccatcagttgtatatatgtgtttacaaaaggattcttgttaaaaaaagtgagtacagttggcgaataaatgaaccctttcatagtagccactgatgaccagattaaataaaagaataaaaacaaaatatgttgtttagatttacgaagatcattgacttaaaaaaaaggaagacaagaaagaagctatttttttctcatgagtgatgcatagactgaatgaatcagcatatcaactgatcaagattgcaaggaaggaaagccaaagaatggacacaaacctgctctgcttgaccggaactcttcaacacatctccagctgatgatttatcagaagacttctttttccaaggccagcttcttcgatccatcccccgctatctctctgatcaagtatgttcaataccttcagctagccaaactaaagaaaatgaagatctatcacatgatggcggcaagataacgatgcaggattcagaaggctacaaaagtaagtaaaactaacctatccagtaaccagcaaccaactgtacagaaaacagaaacgaaggaataaacaaccaatgcaactgacatataagtccaaacaagttggcaagcaccaaacaagctactataattttaggcgactcggattctacggaaaacaccgcagcaggaaatcaatttgcatatacaagtccttcagtcaagacctggtttattgctgggcacgcatggcatccaattcactaccatcaagacaaggacatgcagataatcgactcaacaacttctgcctcgtccacaagcatacaccttcagacataggacagatgaccttgcaggaggaagcacacgcatccaaagcagatgtaattaaacaagtggttaatactttagtcaaattgcacccacaatcatatagtacgcctatacatgacaacaattagccaccttcttaaagcaaagtaaccccccccccccccccctaaaaactgatccttaaagcaaacaccatgagcaatcaaactggcaatgcatctgtctgtcaatgtgtactgatccgcggtttggtcacgcggcacggatcattcatttgtcactagtacaccaacaccacactgttcctcctaaaccctgaaaggcacacagagaatgtggcctttaacaacaaaacaagacaggcatgtcaccatcatccagcctaccttaaatcaatttctcaatcgattagcagccacattgatccgatcatcgccacaagattgacaacgacacgagcgtgcgggcattgtcgcgtcaattagccgcaaccgcatcaaagtatcaattgtacaaccacacacacactttcatcagatcatggcaagaacaggctgcatcccacagggaaggacaccatgggtgcagacgcagccaatggaagagaccacagccacagttgccgggggccatggcatggatgagtaaatgtagaacatgcccccatgtgttcctccttgctccggccactttctcctgtacttgcaccctccattactggtgattgctctgctggggaggcaatgcatcaattgccaccggcagcagcagcagcaggaaagcgtaggattggagtaaaacccgcatgtacggccgtcaatggcagggattaatggccatttctggttaattcatttgtcgatttggggagattaacgggatttggcgttgcacttgtatctaacaatcggaagattttcagtaaaatggagggatttcatcaaggtttttgcggagccaacagcacgaaattctgatgagactgaatcaatttcgcaggagagaaaaaaaagaatcggccaagaaactgacacaagaaatcgcataggtgaatcaagaaaagaacctcgaattcaacttcaagaatcaagattgctgcaacccgcaggccgcagctaaacctccccaagaaaccgcgcagcaagaagagcaaagaaaaccccccaagaaaccatcaaaccatcagcgaagaacacggagagcgatgcttaccgcttagcaagcgagcttgaagaagcttcgaaccacccactccgggcgtgcgcggcggcggcggaatgcgggatccgatcggtgtcggtggcgcctcctcccgctttgcttcgcgcgcactcctgctctactctgctctgctcccaatctggggaggaggacgagacgacgcacgcacacgcacgcacgcgcgacggatcgatcaagactggattggattggattccttcactctcctccaccacctttactcctcctctcgctttaccctttttgtccacctgtctcccaccctttcttctccctcttctctctaatctaatctcatctcatctccctaatgccaatcaatcgatcaatcttggtgtgcaaattggcaatgcaatgcaccttcccccaccctccccatctgtctcctcctcaagcttcttgtgccttctctatgagtgataaaatagctcaacagcagtggatggatcaatggaggaggagtggggctcagcggctcaaggaaggtgagagagaaaagcaaggggaaaggtggagagggaaagagagagagagagagaatgcaaggaaaagtggagtgaattgttgttgaagctcaattgctcatgatgatggtgtgtgtggccacatggtcactgactctcactggctttggcactgctgctgctgctgctgatggttggtgattattgctgggttaattgcttgtgggttttacctttggaattttgctgtggtattaggtggtaatgctggttgtgatctcactgtcccattgacattgtctgcgtgtagcagttaagtgtaaacaatatacgtttccattgatacaggaaaaaaaatacaattctacaatctttgaagactatagtcagaaaaaagaacaaggcaaccacactatacgtctacgtctgattctactgctaaaaacaataagcttgttcaataaaaggggaaggaagcctccacatggaagaagtcgtgaatacatgactgcatgtttgcgtccatcataagtacataactttagattttgatgactgcaattagacacactcgggtgcaataacacttgaaatttagaaagtttaaggcttagttcttgttggattacttacttaaattatttaaataaattatctactactctacgctttgaaaaatacattttctcgaaaaaaaaaaattcttccaatataggaccagttgttttatattatttcttaattttatttattaaatattaaattattccccataataaagtagataattcaacgtaacaattcacttaattaataatttatttcagactaaacctgagtcgttaagacaagtttcaaactcggcatcatgactacagaagtattggcaactaggtaaatgcatatagtttaaccagttatataaaaatttcgtaaaatttaataatatagacgatgataatataaaacactttacaaaacatgcaattctaaatgcgatctacacatgaagaaaaaaataacaatttttatctgcgttgtacgggcactattcactatctaattttattattttgtttctctagttatagatcaaatatagtcttgcatgtttgtatataaacttatatcatcacaattagtattacttttttttatatttttataactatttgagtcacatgtatatgatgggtaccaagacacatatagcgaagaaaatcctggttcatcatgactaacaaagttattcctagtgtaaactatttccttggaaggtttgaacaaccatgctatggagtagtacccagattcttttctactcggatttggccactatatcataacaaggaaaaaaaggtagtgagtatgcactcaaagtccacagtaggtccacaactgttaacacgaaaaattccaccacatgctgccatcacaaatcggctactcatgcaagaaacccatgcaatacactgtgaccagaaaagcattatgttagattaagggatgtcaggacagctagaaaatgccaaaaatataaatatagttatattccaattgtgtgtaagtgtgatactgccaaaaaagtaaatatagttatattccagttgtgtgtaagtgtgatacagccgtcagccatgggaggaatttaatcatccatgtagggtgccaaacgactatgacacttcttccctcacgcgtcagcaggtaattactgtgaaatgttgctttactagtagttttagtaagtacggagtactagatttcttaaaatttgtttggtttcatcattaattaattgacaaagtttggggatcgtttaattaagcactaggattgtcgttatcattatggacgaggaagaatcgaacaaccggcagaaaccaaaaatgtgcagctagatgttactcactttaattatattactgaggagcaagctaattaagctagccaacgaattaaggcagctgtacagcatatgtgcacattgcgcttatgccaatttaattcacttcttgtcatctaaacttatacacacaacttaaacttgcaaactaaactgacatagtgtgaatgatggggaatggattctactaatcctcgagcagatattccatgggtatttttttctccaaactcaatataaatatttacaaaaaatttaaaacaattgacaatatagaatataagtggcatctattattttttaaaaaaaacaagtttgagaaaagaaaagataaatttggatatgatgaatttatttttttcactccatatgtgtgagttaattgtcgatttaggattttgtgaagtggtatatgtagtatatgtcatcaaaaaaaatttaaaagaaagatgttttatacttctttaaaagtctctagtagtggtggtggacatgctctcatgtctagatccgttgtcctaaataataacacatttaatcatagattagtgtattatgggccgaggagagtacatatatatttttgctaattttcataaatattaggatggtttctaacaaacgaagcggccaggacatcccctggtcgaatgaaagcgtacatgcatttatgttttcccatgtaattggaaaatacagctgtacggtagtagtattactccctcaatcccaaaataagcgcagccataagtttctgtatccaactgtaatcatccgtcttatttaaattcattttttaaaaaactaaaaaaatataagtcacgcataaaatactattcatgttttataatataataacaataaaaaaactaattataaaaaatggatacggaaacttatggtcgcgcttattttgggacagagagattatttctcaaaataactaatcggaattccccacggagctaactccgtcctaaaatataaacatttgtagcatagtgacaagtcaaatatttttaactttaactattaattgcaaagaaataaaaaagatcaatcatgtaaaattgatgttactagatttatcattaaacaaaatatcataatatataattatttttatttaaaatatcttacttttataaatattattggttggttaggatctaaaaataccaaggaaattgccaatcaccaagcagtcaccatctaccatacattgcaacgtgcatcctgaagctttttctctcaagcttgttgctgctgtgctgtccaccctgcttgcaccggccatggcccatatggtggccagccaggggcgtaatcatgactgctaccacgaagaggggtcaccggcattcagatacgcaggacttgttcactttattattgtttcattcaaccaaacgaaaattttatgttactaagttttaataagctaataaattaaacagatgtccatatcaaaaaattgatagtagttcccaaacttttctctcacaaagccactactccctccgtttcaggttataagatgttttaagtttggtcaaaatcaaattgttttaagtatgataaagtttatagaaaaaaatagtaatatttttatccaagataaatttactaaaaatatatttaattattaatttaataaaactaatttgttaatgtaaatattactatatttgtttataaacttagtcaaacttgaagcagtttggttaaaacattttataacctaaaacggaggtagattttgaaaaggcacagactaaacacatacaacactatcaaaatttaggtaacgtcaaaacttataaaaaaatttggtattgtctaaatttgataaggttgtctctttttcattaagatatggattttatcttagtttccgttagcacgctttttaaactgctaaacagtatatttcgtgcgaaaactttctaatatacaagttgctttaaaatatctgataaaccacttttaaatttataacaattaaaacttaattaatcatatcttaatgatttttattttgttttctaccacctaacctcatactatttcatcaacggtagaaacgaaccccagctcagagcataactaaagatttgcccttgattggcccgaagcgtcttgcacgcctcgcatcgcatatacgcgacgcgcccacacacagctgcatatgctgcacaaagcttttgcagatgcatgtgttggcctcagctttccagggtacggtcgctggctcaccaaggcaatatgcagatctcagctctcacatctagctaactaacttgtgtactacccgtaactgtgtctgtgtgttggtacaatcgtgcatcgcgtgacacgtgatcggatccatatatcggtcgacagttcgacacctacctaatttattgttagcatcggagggggttatacagggacctgtaccgtttaattttgtctctccaccacttgcaaatatacagatacggataagattagagaagagttagtagtagtacaccacctaagctcgttaactcatcctgtgctggtcgcattcttttgccaacatagagttggtggtgggactgtttttaacttcctgcgagagacaatccatactgtggtagatgtgatttctatttgttttcgagccgttttcatccttatctaaaacggtgtttagattcgtgatgagaactgtagggaaattcctcccgtaccaatatagttttcgtaagaaaataatatcgttttttattgttttcatttctagccatatataaatttttttttcttaacttctttcagcacagtattaggaggagaccgtggatcgaacgagagaatgcaagttccactatcttggaggtgaggaggacctgttggtgtgtggctcctcgaagccaatgctgtggcaccgagacttacaacggtgagtagagaggagcagggagtggtgtgcgtttggtcagcgtctatagcaagattcggggcgaggctcaatggtgtaagagcttcaatgtgatgacgcggagccgataataggttatgctcgagccatgtaggtgttgcccaaatagagtaaagctggaaatagaagctgaggcgccgacaaactcctacaacataacagtttgggggaggagaggagaaaggagcatcacgacataagtcaaggagcctccgtctctggttgagggatgcaaactagacttggtccgcttgtgttgacatggcatcccaatcacaaaatagaagtgaggcccatgtgtaagtgactggggacaaaataaaataaaaattatagggcctacttgtcaggctctttctccacttaatatcttttttcccaaatcctcccctctatatttttcccaaatcctccacactcagtgcagctcatgtctagcaccggtggcctcgtcctagcatcgctgcagctgtgggagagggagcggttcgtcatgatggcagatgacgtggtcggtggacacaaacgaacgacgatggtgatgacacgtagaaggagagcgggcgcgagcgcgcaaggcgtggagtaggataaggaagaagggggcaggttccatggtgaccaccacttggcaacaccctggtgagcagaccctaacagccataatcatactgtcgagaagaaaaccctaaagccgcccaacttcctcaagctcgtatttcaccgtggcgttgtgggggtcccttcagtaggccagtggtgacggcgaggaggtaggacaaatcatgctcttgccgacttaggtcgtcaactggcttgaggccgtcgtagattttgtcgtgggcaagggagcaaatccaacaaggtgggcgattggccgcaacatcttcatcatctcctcctccttccacttatattttcctgtcgttatgccatagttgccgaacaggctgtcctcgtcgtggctgatagatacaccaaccaggagacatcacgacacgtcatcgctgttccgccacctctgcagcgtccccatgtgcgacgatgggcccaccacactgtgtcgaatcaagcacgtatcagatgtgtcacgatagccacggtgcatgcggaggaggcatatgacaatgtttgccaccgtcgccctaccgctgctagctgccgcccgtcccacttctccaagaaaagattaggaggggagaagggacctaacaagtgggccccgccagtttttaaatttttcactagtcacttatatgtggaacccactgatattttgtgatggggctaccacaccaacaccggtagacaagtcaacatgcctcgttcatgaaaaccactctcgaaatcgaggaggaagttaaattacaccgattttaatagttgaaggatcaatatatctggtactactgttgagggatgcgtatcaaattgaacctatatttgagggactcaaagtgaacttattcccccaaacaagtatgctgactgccaagtgaaagcccaacagaatcactggtgtttgcgggcagcgtcgagctcggcctagcccacaagcatgcatgccacactagcttagctgtctcatgccaccactaaacatgagatgcatgcttgccgctaggcgctgactggtgacgcctgttgataaccgtagatacgcttgcagcctctggctctccgtacacgtatatatatgctcagatgcatgcaccgatgcgtgccaacgtacgttgcagatggcctccctgactgcacacgcgtacacgcacgtacgcaaggaccagcggatccgaccgccaattctcgcgtggcatgcatgacaagcagctagcaccaccacatcgtatgacacgtagatcacgatgatcgcctcgaaatcccctcctgtactctactacactacgactacccattttcatcgatccatcgcggccggcagccatgtctccgatgaggccgcgctcctccagcgcgagctcgacgtcgccggtggcggggaagaaggagaagacggcgacgaagccagctggtggtggtgctcgcgatccgcccaagggaaggtcgtcgtcgttcgcgtgcagggtgtgcggcaagaggttcccgtcgcagcaagccatggccggccacgaggatcactgccgccgccacgaggatcacgtccgcgaggcagctgctgccaccgccgccgcagtcgtcgttgtcgccaccgccaccgcttccggtggttgctctaaccgtgcaacttgcggtgctcttctggcgtcttacacctgtgcgactcagcttcttgccgctgccgccgtcgcagattggtcacaggtggccgccgggatccctctttccaaagagcagcttgttgtcgccgtcgccatcgtcctcgccgacgacgggtgagccggcgagtgccacggttgatgtgacgctccggctgggctccggtggcaagcgcgggaacgagaagcctctggtcgagtcactgatggtgccggcggcaagcctacacggtcaccgaggagagcagggtcgcgaaggcacgagggcgagggggatggacggctgtgatcatggtaggaagaaggggaaagcccagatggacggattggatctagagctgcatcttcaccgctagtttagtaaagggtttattaccgggagcagattacaaaattagggatttgttagacagctgcctgctgttttttttttttttgcgcttttgtcagctggatttgtggccatgggatttttcttcaagatttgtgcacaagccagcccaaggcgtgtcctcccttcagccacaaacgagcccaagctacagttcaaaaacataaatcctcatcttccaatttctcctgcatgaatgggaggaaagcaagagaagctgtcggtgagagagagatcgagagaggatgcggcgaagcaagaagcagcgacctcgatgttgtcggcgtcttctccgccggttggagctcctggttgtgggcttgtggcgcagccagggccaggcagcagaggtgtttctgttggatctcgccgctgaagagttgaatcttggaccatcaatgaacaacgaggccacatcgatccccaaggtgagtattccccatggagatttatgcgttgaaatttatcacatctgttcatgtgggggctgccggattaatgaaaaatccattaagcaaatatgtttgtgactcactaaattacacaatgatgaacattaacatgtgtgtttattgaactaccgaaaaacgatacgtgccccggaaggaactacgagcttccatcttctgtacacatcggagggaccatttggctggatcctacgaaccgtgcaaaccctccctgccattcactggtggtagttgtatgcggaatagaagggatcactctgtactacctgcaataatctctataggtaaacattgaattcaaaaatagcaccagttgatccatgccagcaaaaaaaaaggaccatatgatggggaaaaataatcaagcttggtttttctggagcttttcaactcctgcctcacatgtacgagagagcaaagaaaaaaaatgcatagggaatagaacttgcaatagaactacagaaataaaaggctttccaagcaatccatggtcccacacagcgcatgactgtagaaaggtttgcaaagttcagaaaataaatggtaaaatgaccacctaattttggtatattctgaaaattagtccataaaaatagtgtgtattgtacttttaagtccctagattaaattagcatggggtggaacaattaattctataagttatgccacttgtacgtaaaaaaactgtgcatgaaaaagagctaaattttaggacgattttcataataatgtgtaaagcttttggtttaatttagagaaaggttaccataactataatgatttaaaataattcgtgcacctaatataattaatatgttttcatatacatagcttgtaacaggttgattagagtcgtgtgaatgctatactatatacaatagtactagagaagttaacaagtcatccatacaaaaatattttgtgaaacagtttctaccggtaccgatgtaaacccttgatgccactgtgatcctccttttgttgttggtataggcctaaccaactgcatgctaacaagttaacaagtagtatgctcgaaaactatttgtatcataataggctttacctgcattgtccggtcagtttatcgtagacggtgccacaggccttgccgacgacctaggacgtgtggaagctgagggtcttgcctatgtcgaaggcctagaagaggtagaagaggtagacggttgttccagtagggggtccgcaaacctgtgtcctgtgggacggtggacttctgatgcacgcctgcacgatgccccccgcataatacgtttgcatttctgtcgcattcggtccagagcagacatcatctcctcaagggacccagctatattgtcacgcagcttctcccacagtgaggttgtgtcagaatatagttcctccgcaatatcgccctacgaaaataaatgttacaatgattacaggttgcggtaagattattgtttcattaaaaatttagtggataatatgttaccgtcaggtgggtaactggcgctgactgcatagggtacagcgtgtccacgtcggctatttcaggaatatatggatcctctattgtcacaaggcatacgcgtgtttatgcgatgtaccaccgcatgtacaacgcgtacatacgacggtcgtacggtctggattcgttaatatatcgaatgttgccctcgaacattgttcgacccaaggggtcatcttaccaacgatatttcgccacacgctagcatctcccttcctcttttctaacaaaaaaactcatcattaggtgttgagttaagtagtataattcggacacacggtaattaatgggaatccaattgaatttaacttataagtgtatttttttggagggggggactgtttcaccaagcaggagaggcacttcttggtaaaggctgaattgcctcattacacgctgtagattgtacgcctcaacggctatatcgtagacaagcatctttttcatcagccagtaagacgagtcacgcaagtagagtatactgaggtcggcaggggcacgacgttgtgtctcctcttccgtgtatggacaccactgaacgtatcctccttaagtagatcgaacgcctcagtgaagtactcgtacacgcttcgagcctgaacgttcgtccactgtggttgcatgttattaaataaatagtaagattatagctgtacgaactaaatgcaaatgtacaaaaaaaaatttctacgtaccggtccctagcaccaacgcatgccataagtaggcctatcatctgtagtgttaccaaataagctagaatatgccacagttccaggcacgtatggtcgtcccaatgggaagcgttcttaagaccatagcatgaacaacaacggacaaccagtaaacataggttgcttaaagcttgtctttgtgcatgcttcacatagatctcggtaagttgtagccaaaactgctgatccccaactccactagggaaaactttctatgttgccctgcacaataaatcttgctatggaaatcattctcgcatccactatgtatccgtgtccacttgtgaacataacccatccaaaaagccatagaaggtaagcctccaaatgcaattccacatggtaattttctacgtcctctctcgtgaaagaaacctacaaaggtacacagaaaatttcaataacaaaacataatatcatcaatggaagttttttgtatgaattagtttttcctcgaactggatgagccagtgtaacgtagggccgcgcgcttcatctttatagaaaagtcctttcatgtctctatcatcctctggaacaatgtaagcatatcttccaataatatcatccctccattccacaggtgggtcggggaggacaattgtctgtcctgcaagtggtagccctataagcatggatacatctcgcagtgtaattgccatctctccacacgggaggtggaaagtgtgagtctccggcctccatctgtcgaccaatgcagttagaagtcccttgtgtataatctatcggcgtgtgtctctagatgacacatcttcatcttcctcgtcagtgtcttcccttttatttgctttccgtcggcgtgcactttgttgtcttgctaccatgtaatcgtaatgccctctagcctgcaacatcctaacaaaaagaagaatgcctgcaacaagacatccttgcataacgagttgttgcgtcagacaaaatttacaataattgcagcaaaaaaattaacaaaaattcatgtaagtgtgtaaaaaaattagttaccttggtaaccaacgttcgtcgactccccacattgggaaagtccgcgttatgaagaccgacataccacttggacgactggaagacattagccatgcatggtgccatgcatcgatgtctctactgagtaacgggtaggattctggaagaca

SEQ ID NO: 61739 - DNA, 26765 bp, Oryza sativa
  unsure (1)..(26765): unsure at all n locations
agtctagtcagcctcccccggggtagatgggccgagagggaatcggcccatcgaccccgggggaggcaaaatagacttttgcggagggatttgatttggaaggatttggattcggatttggactcgacgatagatcggggattgagatccgggatggcacggacactagacaacaagcaaggaaacaaatttcgcaattagggtttttaagagataattttcccgctaggcgccacgacggaatgggcgctacacaatgacacatacgcctgctggagctagcttaaaaaaaatctcaagttctgtcaggatggtgatggttgaattttttagagataatattattttaataaaaaattgcaaaaaatagatgtcagttaactaaaatcacaaaaataacatcatttcgaacctctctgacaagtcacatatcgtactaccatgatacagttaggtaggagatatctaaggccctcatcagtaagccaatagctttggctgatcagccaaagttggctttttcccttaagctaaagaaaaaccattgattggcttgattggcttatttggcttatttgatgaagattttttgtggccggtgctcatcagcccaataagcaattcaatgggctttggctgaaaagcctcagcccaaacatctatccgatgaggccttaaatcggatggcttatcaaacaatgaaagttcgacatgcgccgaagatctacaattgtaatacaacatatagtttgaagctagacgtacaacttacgaaacaaatagacatgtttgatttaccccttacagttttgccctaaatatgatacttcttccgtttcatattataaatcgtttgatttttttgttaaaattttttaagattgaccatgtttgtaaaaaaatatactaacgtctttaatacaaaacaaacatattatcaaaatatattcaatgctaaaattaatgaaaataatttggtattattgtcggtgatataggcccgggggtatcaggtttagagggaggaggctgccccccgatgccacgtagccctcccccgaggggagtcaagcccaaggtggggtggcggccactccttccccaaagactagtcggaggaggctgccccccgatgccacgtggccctctcccgaggggagtcaggcccgaggtagggcggcggccactccttcccaaagactggatggaggaggctgccctccaatgccacgtggccctcccccgaggggggtcgggcccgaggtagggcggcggccactccctggccgagactagagggagaaggccgccccaggcgccatgtggctcccccccaagggggggatcgggcccgaggtcgggcggcggccgccccctcccgtgactaggggtcgggctcccccgacctcctctctaggtcaccacgtacggtgggttaggtgtccgcctccaggtgcccacctacccgcatttatggcgtcccgagcggtcgcgccacgccgcatttaatgcggtgtgcagtgcactcaaccggtctgtgaccggtcgaatgactgatgggacccaagatgtcaggcgcaccatcgcgtgtgtcaggcgacgtgcagcccgacatatcccatcaaataatgatggtgagaggttctcatcctcttatcccagccggaatcggtcctcccgctctggtcaaggcaaggctcccgttttccggtgtaataggagcccagaagtcttcacccattaaatggtgactgacaggggcaccccccgtgtcaggcggcaagatttgacaggccccatcatcaagacgacgtgtgcttggcttcccaagtcaagagacaagacatgcatttaatgcaaagattataatacttctccaccggagctaggttaggttgttgggcccatgtggtaacccattgaggtataaaaggagatccaggcctagtggtggaggaggggacttcggggcgaactggcgcttgggtctcgcaaccccaagcacttgtgttctacattcaatcaatcatgcacaggagtagggtattacgcttcatagcggcccgaacctgtacaaacctcttttgtctcatcgtcttgaaggggcctaaccccctcaagatcacacagctccgctcaccaaaccctcgaatctcacccgctgcccccggccgaactcacaaagcggggcctcacggttccctggtggaggagttcattctctgacatctggcgcgctaggtagggggcgcgttcgtgatttttgaggttctttcgagcgccggcgtggtgagtgtcgcgccgccgctacgggggaaggcacagcatcctcaggagtgtcgcgccaccccaggcaggaggcaaggcccccacatccccaccaggtaagcttggctaccaggtctttgtggcgagtcttcggaatgtccgagggcccccaaagctccagccctgcctcaccgagaagtacgatgatggcgtcgacccctccgagtccctccagatctgcacagcgatcatagaggcggcgaggggtggcgaccgggtcatggcgaacgtcttccccatggccctcaggggccaagcgctgggttggcccatgaacctgcagccgcctcggttcactcctgggaggactcttgcagttttgagctccgggtgccttcaaagcccgggaccccctgtgctggctcttctgtagcggctggctttggtcccgccggctggctacggtgctcggcctggctcaactgatcgtcctttcaaacttcaagtattttcaattttgcaattcattagcttgaaatcttatatttatttcccccattctattctcatggccctgcgacgcccgcgtgttgcgcatttgtttgctccctcggtggtaagagcccaacctctctcccatctacatgaatgattcttcgctaagtgtgggggctaagttttctagccttatcctagccttaagttgagccccgggtgccgtcgacgcccgggaccccctgtgctagctcttccgtagcggctggctttggtcccaccggctggctatggtacccggcctagctcaactgtggacggggattgctggctctagagttttcggctctcacactcatgcgaaagtaatcgtccatgtagaaggaaaagagattggaaggaggccaccgaaaggaaagagcaaacagaatgtgtagcgtggggacacaggctcgtgggaacctgacctcgtttgctaagtggtcacaggcttcccaagatggttcggaacccatggtggggggccctcttcgagctaaaggtttgtgtttgcttcattcatacaagcaattctttgctataagtgtgggggctacgattcctagctctatcctagccctgcgtcgagctctgggtaccgtcgacgcctggggccccctgtgctagctcttccgtagctgctggctttggcctcgtcggctggttacgatgctcagcttcgcttgatcgcaggcgaagattgctagctatagaaagttcagtcctcacactcacgcgaagataatcgtttgcataaaattattattgcttatatttatctctcgcctatctctttgttgacgaaaaaatcgaatacaccggcctgggagatctgcttaactccagtgcaggtccaaagattggtgagatgcgagcgtaccagtcagtttgatcctacaactgacaagatatacaaatagtagatcaaaacagtcgatcggctgacaagccgatggagtagttccagccaatagcgataatagccgatgccgataccagccgatagcgatagggtttaagaaatcggctatatgtccaatgtaaataatgatatgaaggcaatcggctgatgatgatgtaataaaataacaatataatccagtagaaaccaatcggctagaaacaaaatacaataagcactgatccgaaggttaaagcatacatcggctggaggtccgatgtcatgaaatccacaagattggattaaacagtgaaacctttgtcgtcatcggctaaatccaacttatatgtatatgcaatccttatgagccgatgcaacgtccagataactcaccggctgaaaccccgatgaaacccttattggcagtcaaaaagccggctagagattatggttctaagcatgacttagtagatcaaacttaactgatgtagcactaagtatgaaaagaaacataatatctagacaatcaagccgttgactgagttttcagggtggtagatgtctaagctaatctaatctagcaacacgatttagccgataccggtagaaaccctaaaacgagatgcagccgatagagctaaattgatatgctaagactagattaacagagacatatgataaataggtaggcaaatatatcatccaaaccggagcaatccaagaggtcgaatgtactgatgcagccttgaatgacgccgacgtagacgatacaattgcctgggccgacggaacattggacttaccccttcgccggagatcgaacaccggtgcagccccgcgtcaggtgccaagtcccgctagacgataaaataaagtacaaaaggtaaaaggtggcgatgcaccgaattgtattgatcgtagagattgattacatagaccccggtttacatatttatacccatgggttgatacaagtccttgtcggacaagaaagaaactaacctaaagataaaaggaaaatataaagtccttatcgaacactaaacacactttcctaaagataaaaggaaactaacaaactattcctaattaatagataaactgccatgccgcatcctcattaaactcggtcacttagggataagcttcctttagtagattgatttccttaaccgaatatagcaggaatccgactattggcgacttgataactcccatcggctgattccgagatgttgcagccgataatgattctaagccgatgatgactttggccttaccaaatttcactatcaacaccgccgccctacctcgggcccgacccccctcgggggagggccacgtggcattggagggtagcctcctccatccagtctctgggaaggagtggccgccgtcctacctcaggcctgactcccctcgggagagggccacgtggcatcggggggcagcctcctccctctaaacctgataccccgggcccatatcaccgacaattataaatgttgctgttttttctataaatttgatcaaatttaaagaactttgattaaaaaaaatttaaatgacttataatatgaaacggatagagtattaatgtatagtagctatatccaccaaatatgatacgacatcagtccaatatggatagatcgaacacgtcccctgaaatataaaagtccaaacgtgggagcacttcattccaacatttccatcagcatgcactctagttagctcaatgtaaacaaacaaaaactgtcggccggtttggtgaactatcagtgtacttaacaacccctctttaaaaaccaaagcgcacgcaccacgcccgcaacaaactccccaccctcaacctctatacaaaagtaatccaccttcaagtctaaacaaagactaccaaccccaatatttactcatcagttgacccctgtcaatttagtgtgactatgtgagctgtaactagcatttaggcagcacttgaatagcagtttggctgagctagctagtgacatggaaactaacatgttaattagcacataagtaattaagtattacaaattttataaattgatctttttataaaaacttatatattgtttctttaaatacaatatttagcaactggaaacacatattcatgataaatgagtaaagcccataaaaccgtaggtacggctgtgttcgttatgtatggttgagaactttttttctcccacgaaaaacgagataactcattaccatttgatcaattaagtattaacttacaaaaaattaaaaatagattaatatgattttttaccacaacttttctatgaaaattttttaccccattacaccggcagtttcttaaatcaaaagagaaaaatattagagaagcaagcagtaaatgcagcaacgcgtagcgtcagccagacgaaccagagtctactgtaggagatcaagcgagatagccatagcccaaccgcagcgcagaaaaacacggggtggcgcaccgcgcgcgacactgcgctcccgtgcacgccgcacggaggagatcggggatctcggtctccctctctctctctctcggcgcgtcggtcgcggaggacacaggtcacacgagtcacggagccccgtactactcgccttcctcctcctcaacccaaaccccatcccgtcctcctcgcgtgtcaggcaacgcagagacgaaacccacgagacgtgttcgttcctgctcggtctctgatcagtttgctttgggcgtggtcttcctcgagtcccccacatttcttcctcccctccgtacggatacacacactctttctctctcgtgactgatccgactccgccgccgccgccgccgccgccgccgccgccgccgtctgctgctgctgcggggggtgggaggagatgaagccgaagagcctcccgttcatcgccttcgagcacaagcggtgcgtttcctctctcgcccggggtggggggggggggggggcgtgtttcgagttttgccgtctccttcctcgttgcgccgcgtgggtttcggccggttgctgtacgtcgcgtcggtttctcctcggcgagccgcgacgaggggatctcactttttttttcttgctgaggttttcgggtaatgcggcgagggattggctgtgcgcgggagcggcgagggctggatctcctccgcgcgaaggagtgtagggttgaagcataggatggatttgccggtggaattgcacgagttgagagctccgtgatgtttgctttttttttttttttgaagagatctgggtttcgacgtccgcatcctgctgcacgacagtaggagcaagcagtttccactgttgattcaggcattgagttgataggattaaacctgacgaaatttgatctctggtttgaatctaggagagggcacaaccgcacaagtctagaatcatcgaagttctatgcggtagttagttgccgttttggagaaatgttccctttctgatgctgtgtgattgaagcagggatgcctatggcttcgcagttcggccccaacacttgcagcgttacaaggagtatgcaggcatctacaaggtagaagacacgcgccccctgactttttttaatctgcattgtctggtgtggacaagctacatgccttctggtgctgtgtttgcaggaggaggaagaggagagatccgatagatggaagaattttctggagaggcagtcagaaccatcgggacaggaagagaagggtgaagctgccgggcgtgttgtggatagcagtggaattggcggttcttcgttgctgcaggagaagattgtgcaaggaccacacaagatcgagatatggaagccaatcagaccatccctgggcaacatagagcagatcatgagtgtacgtgtcgaggagaagcaatcacctgcttctggcaatcaggacacgaaggatgtcatccatccggtgaaggttcaagagggcaagttatctgaggattcagatgatgagttctatgatgtagacaaggttgagactagtcaagaaatgcattcaagtgatagtgcgaatactggcattgacaacaggggtcaagaggaaaattttccttcgatggaagagttggagtgtctagtccatggtggactgccaatggctttgagaggagaggtgcagcttgtttcatggaacctttttgctttgtttccttttctaactttagaattcttcagttcattcagcagactcttgcttttgtggtgacagctatggcaagcttttgttggcattggagtgcgtagggtaaaagggtactatgatagtctccttgtggcagaaggtgaactagaagataccagtggttcgcgttcttcaacctcggatgttgccggggaaaatactgaagtatcttctgaaaagtggaaagggcaaatagagaaggtaggtcactgagtccaaatttccttttttttttaatataaaaagctagttttattggaggctaggatttttcttatttagcgtttttatctggaaaatctgacaagaagccgtatctgccatttctgggctccttacaggacttgcctagaacttttccaggtcatcctgctttagacgaggatggaagaaatgctttgagacgtttgcttctagcttatgctagacacaatccagcagttggttactgccaggtaaatgtgccgttactggtgatccgcattgtgtcctttatcttgatggaagtcagcttctttgtaactctgtagcaacaattgattccaagtgttatgataaaatagtttgagtaacaattgtacttggatattggtgaactgtaggcaatgaacttctttgctggtctcttacttctattgatgccagaagagaatgcattttggtacaccctcatgccaagtgttgtactatttgtgtgttttcactgatataaaatattgtgatagttgaattaaataatattttaaagctgttgatggtgtaacaggacattggtaggaattatcgacgactattttgatggatacttttctgaagaaatgattgagtcgcaggtattgtgatgtttccatatccaggtttctgttggttgcatgtttgagtgcttggaagatggaactgcatgtttgattcaatcttatgtgaaatgaaccttgggttgtttccaggtggatcagcttgttttagaggagttggtacgagaaaaattcccaaaactaggttcgcaacttattgcaaatatgatatattggtgtggcgtgcctcatttagctagtaacttcaaaaatataataattaaaagctgatttccttttttgtgcagcaaatcacctggattaccttggtcttcaagttgcatgggttactggaccatggttcctatccattttcaccaatgtgcttccttgggagagtggttagatttttacctttgttgttctttcatgtttgtttcttgtaggaaaccccatttttaatttataccttagctaagccattggtggagatataacaactggatatgtgcaagttgaaattttgtgtttctcttaaatacttgtggaacttgttgtgtatctttccaaaatggtgtgaaactattgtaattgattgattgtggctttgtgtatcttagatgcggtggccagtttataattatctaagaaaagcctacatagttacctccacaaagcacattgatactacattatcttactagtatttattattccattctgacttgctggatatgtgaactagtctagtcaactataacccccttgggggtcagaggtagatgatgcagatccaagttatctttgtaagtagggagaagtagtaagacgagcccttggtccccacaaaaagttcgaaagtattaccatgttttccttttgtctcggatgatggctgtggcattgctcggaattgttgaaaatgtctacactactatcagttaaatttattatttgttacatctattatctatgtaagcataaccttgtttggtgtaacagcctcgtacatattctgcttggaagaaaaatgacaccatgtttatttctatatgttgtttgaacattttcagttctccgtgtctgggatgtccttctgtttgatgggaatcgtgtgatgctattccggacagctcttgcactacttgagttttatggtactgggaatgcttctgattctcatagtttcctaaaataaaacgacaataagtagtttcatctcgtgggctagctaggtactgatatttttcttgattgcaggtcctgcacttgtgaccacaaaagatgccggtgatgcagttacacttttgcagtctttagctggctccacttttgacagcagccagcttgtcttgacagctcgcatgggatatcagtctgtagatgaaacaggattgcaagagttaaggaataagcatcggccatctgttctatcttcaatggaagaaagagcaaaaggtctaggtgccttggacaccaacggtcttgcatcaaagctctataatttcaaacatgatcctgaaccactggtgtcaataagtgattcgcaagatcagatgagtgatgtgggagatgggaatgccaaccaaagtgattctggaaatatggatgatatgtatggcggtctgacagtcagttctgagattgaagctttaccggacccaaaggaccaggtagccatctcatcatagtaattagatttagtaaattgttctctatacctgaagtggctactgtagtttctagtttgaatccctgcagatcttctgatacgaaccagtttcattactgcatatcctttatctgaattatttttattacttcatatcttctatgggaatcagttttactacagcagatcttcttgtctgatttactcttcttacattagatctcttggctgaagtttgaattatgccgattgctagaggagagaaggtcagctgttctcaggtatgttttacatttcataatttgatattgtcataatttgctggaaagtcgtttttcattatttcaaaatgagaaatatacatgcattctgtcataggttgctggaaccatcttatgcgactttgcttttaaatagatttatggctaatttacccgtatcagtccttgagtcctgatctggttgtctaccagtctgaagtattaattccaattttcttctttttgatatccagagctgatgaactagagacggcattgatggaaatggtcaagcaagataataggcggcaattaagtgcaaaggtatagccagataactaaacttttgtataaggaggtgttcctttgtgccaatagtcagattgcaagttcagagatggcgtttacaatgcaactatgccacagaaataaatttcaccatgttctttatttcaagtatatataacagtgttttagaaataatcattctaccaaattataaatggtgcaagatttatctagtagaggcactttattttgaaatatccaaatcataaccaacaccagtatatcataattcatcctatgagctaaagatatctaattttctaacataagtgtgtttgaatgtccctcttctcttttaggttgagcagtcggaacaagaattgtctgaactaagacaaaccctattggataagcaggaacaagagcaagcaatgtgtcaggtacagttgacccattagtttttatagatgtatctttctaccatggcatgtccactcaccagaaattatattgaaggtactgttgcgagtggaacaagaactgaaaattgcagaggaagcacgcatctctgctgagcaggatgccgcagctcagagatacgctgttaatgtgctgcaggttagtcagtcaacaagctcggtccatccttctgagatcatattttctctcttaaaatcacttactccttccggtcctaaatatttgacactcaggacaaggttcagtcaaacttataaattccaacaatcaattttatattagaataagtttataaaatccaataagcttatgatattatgatagtactttttgaagcaaatatacgtgtatcatttttttgttttaaaactaagtatttaagaaatttcatggtcggaattttaaaagtttgatcaaaatcttgtcctaagcatcaaatatctataactggagggagtatttttatctgaactaaccaaaacggtagtcacgtacatttacatgcacacatgcaaatactgtgacatatacatatgttgtgcccttaaaacatatttgtatacttattttctatatttttgtatattgggctctcatcggatcctgacacatatgcaggaaaagtatgaggaagctatggcttcactcgcgaaaatggagaacagggctgtaatggcagagacaatgttggaggccacactgcagtatcaaactagccagcagaaagctcttctttcccccttgccttctccaaggtatcccaatttgcatcttggaatgttattagtaccaactgtgtgctactcaactgcttgagagttcagatcgcaactctcatttgcttatgaatttctgtactgttagaattttgaaaatatttttggctagcttttagagcatgtctaagtttctaatgagcaactgtcagttcggattgctcaattattcgtgaaaattagtaggctttcatgacaatgcattcatgttaaattatgttccaagttattcatgttatttagtgttccaacattgacatttgcttgactctgtttcccctccagaacatccatgatagacgcatcccctggtcgagcaaaccatgattcatcacaggagttccagcccaaaaaaataaacttgctctcaccattttcactgagttggcgcgataagaacaaggttattcttctgacctaatagatacattactgacacacgaggcatcctgtatgtggccgcaccaattttggcttagttaaatgggctttcaattcggtagataatgttctgtctgatactctccatccttgagttagaagatgacaagatgttatattataaattatatccactgtttagtgttttacaaatcatacaaaatgacctgccaatctgggttcttcacagggaaagcagaacaatgttgatgacagtgccaagcttactgatgcacatgatcaaagggaagaaataaccaacaacaatgacgagaagcaggtagaaacaccaaaactggatgtgctagaagagtctatgggttcacccaaagaagataacaagtcgagagtagaggtgccaaaggaaacagcgatttggcaagcgtccaagtagtcgcaaatgatatgaatgggcagcatgaacagttgcaagaaataaaactggattgaacagttgcaagaaatcacaaaccaaccttttgcatatatcttcaccactatggtattcttttatctgatcttaccatggttgtcgagagagttaaacctggagggcttcaaggttcgaacacgatcattgctgtacctattttttgctctgtccccttctttttaattgtttccttttttttttttatcattgccactcttgtaggtctataggttactttttctctccattattactcgagaagagaaaaaaagggcgaaagttatctggttgtccattagttaactttcgatgtaaatgcatcaggggaaattaccaaatgtagaaacacactttgcaattatggtatgcttgtttgtgaatcgtcatttccgctagcgagggcttgcttacgttgtcaaatgcaggaatctgcctcatttttggagttcatttgaaaagtctgaaagttctgaatgtcaaaagctcgttttgacgaggaaaagagcgtgcttccacttttatggattcttctacgtcaacttttcattttattctatttactatcctctgttattatcacattattaacatggttaacagacctgaccagtattacggttgtggtcttcgcagtagctaaaatcatttgttgggttggactctgttttggtcaaagtcatctcctagagattattgcctgtgaagacaagaatcatacgcccttattctccttaagattattgtaaagactaatgtctttttgactggagcattaagctgtgattgctgaagtttgttggatagcttggacccagcttattcccatatctttccatttctttttttgtttgcttactagctataccccgcttgtcatattttcaagaacaagtgaaagatcagtttggagtagtagttataaaccaccttttagagagaaaaaacgggaacaatcacacgtatttttgtttaaaaaagtctctgatgttgggattttaaccttggtgtcctgactcccgaacatctgaccagttggcctacaacatggtcggttaattctgaatttgaaatccaaacctcttggcattacccaactaatctaatgtttgtagatgtggccctggctagtccagtcaaagaatccatctcatattcatagacaccccaattccaaccttgactatgatcttgtgagcagttaattagctgccgatgaacaggccagcaccatgccaaccaagagaatgttggaccagtagagctctttcctgcctctctcagatgtgacctcaaaccccggtaatcctagcattagggatactatatattgcacatttgcactccactgagtaagatggcaataaaaaagcctgaagacttgctggcttgctgcatggtcttgcatgacattcatatctctattgtttgcataattgactcacattcatctgtatatgcttgtatagcctagtagtagcctttgcactatgttcagttaaaacatccactgtgtcaacaccttttatttgccagggccagacagctcacagctgaggcaagtgacattgcagcaagtcactagccagccagtgtatatatatacacacacacatacacgtgcaaacgggaggaggagagtacgggggttcttgtgtcacctcccttctctgaaaactactgaattcctaaggtgatcacattcttcttggtccttcgaaaagaaaaaaaaaagaaaaggcattcttctctgaggtaatcaagagattcttgtcacaattcatggtgtacatctgcaatgtgtttacctgaggtgacccatttggttttcttgttcaggtttcatcaaatggcagatgattccaaggcgcattcggtgaagggaagcgggagaaagataccgaagagaggacaaataaaagctaagatctttaggtctattttcgcctccctcgtagcgctagttcacaagatcaaagacaagaagaaaggataggaaatgtacatttggacctgtagtaatatcttcatcttggtgtatcgagctgcatccagcaatcatctactactagtataatactagtagtatttacggtattaatatcaaagaaataaaatctgggtaaaagcttcatgctgcgtttgcatatggtcctatgttttttttttccaagagggaactacacaaatcttaatgaagtcgatggaagtgcatagatttaatagctagaatgaggattggcttagttcaaattggcatgtcccccagttctaacctactacctcctccgtcttaaaataaatttatttttcacacataataatatatataaaaaatactagaacactctctccatgttaccaaatcctaatggaattgtctcccccactttatctaatatcaatgcatttatcccttatttttaaaaactccaatacaaagattacttgaaaataaacttattttggaagttggaacaaacaagaagaaacaaagataaaactattttaagatggagggagtctccctccagtaatgaaatcatatcattttgaacgtcgatatggtttgcaagatacaaatttgatcggaaaatatttaaaagcattaataaaattgtattatgaaagcactttctgagatgagtccaatctaaatatttaaaaagatgttaatgttaaagaatattaaagttctatttgaaacagtatcaaatataacatcttcttttaatctttttaccggaagcagtatacagatcagtaaacctggaaacttcagtgagttatcgttgtcatccacatcaaatcaagaaagcagcagtgcaaacttagactggtctcccagtaaattgcaggacagccaattatatgagcaaagatagaaaaccaaaaggagatagcaacatccacaaaagtccatttagtttggcgagatggcaactaattaaacatgtgtgcgtcagtgcatgatgatagtaataagtgaagaagaagaagaaggcaatgagaaaaactttatttgaaaaggcatgagaaaattaagctactcgctgaaaaagccaaagaaccacacacaagccaaatagacttggatcttgacttcccagttttatcatcagcataagcaggcaaatcagatataatctacagtggatttgcagtggagggggccacatgccaggccataggccgacaggatgttggacaaaagatgcaaggacagagacacgtcgggccgttggggcatgctaaagactcgaggtgagcagacagaaggacacaaatgttacaaagagttgtgtttgcctttgaatggtgatgcagagaattttcctctaaaatactccctccgtccttaaaaaaactaaccttagtatgaatgagacattttctagaacaacgaatctggacataagcatgttcagattcgttgttctaggaagtatcccatacatgttaagattagctttttttttacggaacgagtatactccaccgtcccaaaatataatgatatagaagatgattgaatatattctaatataatatatttggatgttttgaaaaaaaagaatgtatagatacattatactatgatacattcaatcctctccttggttatggaggaagtactgcttataactctttgtttgttctaacacagaatttcctaaaattcttagacatccataagtataggtcttaagtgttcttttttttttgaaagactagcggattttcccgtgcattttttgtttctagatagattttagtgtactaaattggacttaatacaagtctcttcaactttctatgtaatagatttgaaatggaattaaatttgatatacaattgtcgtcttttttttccatggataaaattgcattttgcataataaaattatattgacaatatacaccattacaatctaaactagacacatcacaacgtaatgatgcaaatcatattgcttttctcttattaacatggtataatttctagtagacctttatagcaaattgaatgagggtagttttctttttctccttagtaatatactactattctttttagataatggatatatgatttggtatttgcttcaacaaaagctacttccacttattacaaagtccttacctcaaaaccaaagataaaaatatctaagcacggtaagacgagaagacaaatttgaatcccaccaacaaaaggaagaagatacgcatacctcttattcacatagtaaggccctgtttagatcccctaataaaattttacaccatgtcatatcgaatatttggacacatgcatggagtattaaatatgaacgaaaaaataactaattacacatattacgtgtaaattgcgagacgaatcttttaagcctaattgtgccatgatttgacaatgtggtgctacagtaaacatttgctaatgatagcttaattaggcttaatagattcgtctcgcagtttacaagcggattctgtaatttgttttgttattagactacgtttaatacttcaaatgtgtgtccgcatatccgatttgacacgccaaaactttacacccctggatctaaatacagcctaaacctatttaatcttcatctaaagttgtggtaaaaaaattcacgactgttggttctacatccggcatacaagactgttggttctacatccggcatacaagattgaaaaccttatcctcatcatacctttgtaatcgggactaaaactgaagctagtaccaacgtataagattaaattgaagttgcataacatatcattcctactatatcaaagagtgcaacatacaacagatagatagatagatagattgtgctacacttgtgatgacattttgactgcgaaaaagtgcaaaatctttagctatgtggaacacctcacaccccccacccccccnnnnnnnnnnnnnaaaaaanantnnnngngnnataccannacaaaaatgcccaaggataaatgttttgcacatttgtctttttgttgcgcgtgtgtctcctcaaggctagtgtgttctatcttcttcctgaaacaaatgacatagctcatgcatgtcaatttcatagtagaaaagatatcaaaccaaacatgcttttgggtctcatgtcatgtccctatatatttgtgaaatttgggctaggtcgtcgtttgtctttatgcaatccgatccaccgacggtttgttggatcatgatattgttttacccatgtccctggagatcagcacacatggggccatcatgtagtgcaatatatcggcaaagccatatgtgaagcttacgcgtaatttggccagcagcaacgacaacgagtcctagaagaagacgaagaaatgcaacgcgtgcgtgatgcgatgtacgcagacgtgaattcttggttatttagtcaagtcatgaaaccttttaatgacaacgcaaaataggtagagcgctaaagctaggctaccgctaccatcggtggccatacgctgattgtaagctttacagcttatagaaaagaaataatttgtcggtatttacatatgtgtaatttcttaactatgtaaaagctaatgctgaaaaataaataacaaaaaaaatcttaaaatcaacttaaaatttaaattttggcattcgtttataagctactacctccgtcccaacatgtaacaatttttggctatgaattagacacataattgtccagattcatagctaaaattgcttatattttaggacggatggagtacagggcataagatgagagcatttccctgtttttaaaggataatgcataaagcagccatcggcaattatgcacaaagtcctcttcttattttgataatttttaaggtggtttttattggtagcacaatcactctataattcatgatgaatcacgaagtggacgtagctcgattagttagatttttagtggtaaaacctgtctatgtaggttcaagttctagacttaatatggatatgaagatcgtatttatggttaagacgcctgtggtgacttaatttatttggtggtttgtgtatttgatcggaattcagaagtcttaattcttttggccgacgtacgatcgctgcctggatgctggtccagtgaaaataataagttggaattcagagtagtgaaaataataagttggaattcagagtagtgaaaataataagttggaattcagagtattagtgaaaaaaaaggttggaattcagaagtatttgtttgtgagctgaaatgtcaaatttgtcaaatttcaaataacttacgtggtggccttttgctttcccccccaaaaaaaattacactctgagtacctgtatcatcttggaagcatagatatggtgtaaattcaagtaacctctgcaattaagccaagaacagatctactgatgaagcacagcactattaactagcctttcaacaaaagaaaattgatcttcattactaatactccgaaaggtccgaacaaaattgagggaaagatgaacaaaagggcatctacaatctagcagcagcaacttttcctgtcaccatgtcaactacatcgatccatacacatctacgtacggaatactcctactgcacagcacacgtacacaagcaatatactacaagtaatatgcatatcaatctgagtatcagatgatgatgatgttgctgttcgattggatcgattcagttgtagctggcttctctcctgaagctgctgcgatccgctgccttcttcttggagtctgcagcagcagcagcgtcgccgctgctcctcgtcgccggcgccatgaggttgctgagcgtcctcacaatctgccgcttcagctgccccctcttcagcggcggcctcttctccttgccactgatgaaactgccgctgctcttgtactgctggtagtagctgtagcagccgtacccctgctccatggcttctctctctctattttcttcagttcttgctcagttgctcctttctctcttctgaaactgaaattgttttttctctctcgttgcagtagtagcagttgaacaggtagtagttgtgttgtgttgtgaagcaggttctagtttagtgtgtggagatgatttgagaaattgagaaggcaagaagtatttataggcggagtgatctgaagtgtcatgctgttctgttgccgcacatgttaattaatttaatctcggttgtaactttgcatcagccggggcgggtgtgtgtttttttactattctttgaaggaacaacttgaccacttctgggccgggaggtttgtgatgtgatcatggcactaataagggcatctatgccctgaaaacgacagaaatgacaattgattactactacctggagggcaaggttaacgtgcttaattatatcaggcaaaaatttctacctgatgtctaccactgtccgcacatatttgcttctttctgttcgtgctcatcatggacgtgaccaactgaccaaacagtctctccgagacattgctgtcaaaaataggagtcgatttgccatttcatttgctctatcatcgagtgacagatcgattaatcgattgacatcttgattaagctgggttaagaagaagaagaacacgtgctgatcaataactgacggctgcttcttctgacgaattaagagcggtagcagcagctagcttagcttcaaggttcagagaatgtggtcactgtttgacctgaggggggactctgacgatcgagcttgaggtgtcagtgtcactggctctctcgcagcatgcaacccgctcaacgatggacaccttgatcagcaatccgccggccgaaatagctttggctttgctttgattgctttgaccttatcgcatgcttcttctgacgagctagcttgtgcacctattatccatgtgatgcatgttgatcattatcggaaaagaattgtgattgataatcgttttgtcatgtaattaatgttttctgttttttttagagaaaagagctagttgcaaaggcattgtctgaagatgaacaaattaaagagagggattcaggaataacatgtttacttttacatgatgtcgatgtcactcaaaactctggatatctaggagaaagatcagatgccatagatgtttctggcgatctatccaccgttcaaagccttgagttaatgagttctgcctaatgaactagcttaattaattatctatgttatacttttgggaaagataggtatagcattttgttggttgaaaagacattctcagtaactaacaaaagtaaagcactgcgctctctctctatataataagactctaataagagagacatcacagcatctatacattctagcacactgtaatataatttgttagttttcacatatgcttttgctgagtgatacacagtaccctccctgatccacacgcccaacttgcctatatagctaatgatgctcgtattagtgaccaaactcattgcagccgtgagtttttgggcgtaaaattcccaggtttcacacccataaacatcatgggacccggtctttaagtactgaccttaaagcagtcaatttattctcctgcaaaggaaaaacaagaaaaaaattaacagcatgcatgcatcaaattaacctgcaggctatagctagtgaaacttgcactagactgcaagagccctcacctaaaaattccatcctactttccatcacaaagaacatatatactgatatagttatggcagagcaaatcataattaagagggagtttctggaaggaaaaaaaaagaagagctcttaattaaagatagtaattaagagaccatggtggagtgccaccaccagtacaccaacagcatgaaggagaagaggccgccaccgaggagaggtcagctcaagcggcagatcgcgaggaccttgagcaacctcatggtgccgggcggcggcaagcagatcgcagcaggttcagaggagggccaggctgcagcaaaagctcatggatgcttcaggcttagatgatgaattgatggggagagtatggctgattcaggttcaggcttagatgatgttagttgttaatctattttgtactatagtcgttagtttttgctttcagaacctctctttgatatcctatataatgctgtgtttgcaatcttgggttcccaacgtatataggagtagtgcgcacagaaaacggagtgttcattaacacgtgattaattaagtgctccctccgttccaaattagttgtctctttaggattcaaatattgtcccaaaatacttgtcacaatgaagtactgcttgtcccatcaatcacttctaattcaaaattttctcttttttacccccaaccatcctcccacatccaaccatacatcatttaataaaggccactatagtcttctttgtcaaacattaatccatactaaacaacctataaactaatatgggacaaaggttatattagctaattctttttaaaaaaatagatcaatatgatttttttaagtaactttcgtatagaaactttttatgaaaaatgcatcgtttagtagtttgaaaagcgtgcacacagaatacgatggagagggattgggaacccaggattgcaaacacagcatgcattcagcagcttcattatagcaggtataatagcaggctataagctagctataaacacattttgagaagataaaagatgagagagaagggcagtggtctacaaatttgtagccagctgcagtacagactccaaggtgcatgtgtgtataacaggtgggaccagatattaattatgtactatatatttataggtaactattgtataaattagttattaagttgactatagataatttagagccagcgattggctatactattaaacttgctcttaggagagttctgccaagtttagttagtaacatgtactgctgtgcatctctgaataaatgttaaggaggcttcatgtaagaattttttgatgatgatgatatacgatattagagtgaatttgattaactcatatgtgagtatttatggtgaattttgtgtactcaaccatgtttgaggtagcttctttacatcagtgcagctactttaagaaatacagaaatactacagcaggtattatcgttggaacggaatagtttatattaattgctaacgtcgtaataacgttacgaggacttcaacttggtacttctacctagatagagaatcatgattaccatggtacgtcaggacaacgctacgagatactacgctgacttcaaaatagtactactgatgtgtttagtttacacaaaaattagaagtttggttgaaattataacgatgtaatagaaacgttggaagtttatgtgtatagaaaagttttgatgtgatgaaaaagttaaaagtttaaaaaaaaatttagagctaagctcggcctaagtttgtaatacccttatacgggcataccaggtttggcagcatgggcattagatgtagtgccatgttgacgtcagcgatggtaggtgacatcaacacataaggtatcatgttagatcaacaagaacccatcctctagtcttcctcttataaagatatctaaccactacactggccaaggtcacctgtgacaggcccaaaccctcatctttgacggcttcgcgtatggtcagtgattagtggtcactggtgagtccagtcacctttgacgggtggccggccgtcacaggtgacacccacctctgacgggcaagttactataaagccgtcagaggtgttggtctccgctagcctaggacgagttgggacccgtcacaggtgactcatctctgacggccctttaaataaaggccgtcagaggtgatggtctccgtagttagaagctgtcacaggcgatctacctgtgacggccccaaaagtaaaggcccgtcacaggtaggtcacctttgacgggcctttatttgctagtccatacaggtgatgttacctttgacggatttttgttccgacccgtcactgatgagttaattccagaaaaaaaaagctaaatattggctagcctcaggatttgctagccatgccctctgaaacacagatacatcatagatatattccagtcaccccccaatataacatcacagatccatctcaaacatcacagatccccaacaacacagatccatatcaaaaattgacatcattcacatatgcagttcaaatgccacaattttgcacagcaaattcacaccccttgaaagccacaattttggtcgttgctcatataaccgcatatatacttaccaaatggattaaagccataatgtcctcgacctccacaacctgtcaataaggaaaaaaaaggagaaaacagatgaatagtacaacgtaaattgtagttgatcaaatttgatgacaatttagtaaactaccataaatattgcacatatgaaagtaaattacattgcactccataaaaacatattttttttacatcacaagaaattatgaaaacatctttttttacatcacaataaattatctagccaagttcatgagtctatttgacgtgaaaacgtcctttcttattcattatttctgccataatgaaggcgcacacttcgcctctgatagcgcggggaggaggggggagggagggttgatgggtgagatcttgaagccagctctacctttctgtttaataaataagatgttagcacgttttgaatagcaatgttggtattgaaatgagcttattcgccattagcaacaacctcagggtcgaaatctttcacctctcttagacgtgttgacatgttgtggcacacgtggaaaccatattggtctccgatctgttgtgcgcatgcgaacttggtgtcatggtaaagttcgtccttgccctccttgtgcctaccacccttttccacatatgggccccaagccatatttaagaccttggtgatttcagtgaaatcataatctttggacttattggagttaaggtagataaccctactccacttaggtacgatgactagaagaatccaatgtcacctgcgcagttgttatgtagcgttagtactaagaaccttaacttcaaaaataatatacacgaagggtattgtcctcttactcttggttgtgtgcgcacatgatgtactccttgtcttgataggcccataaacactggttgacatagtcaaccacctcagtgaagctctgtcgtaaattaacctcattcaccatggatggatcaaggaacccaacctgattaccaaggcgacgactctcgatccaacacaaccttaaaacatttatgtattagaactaatttaattaggagatatagtccaatcatatcacaagtatagaaggtatgcacttacaaggaatagcattttagaagaccagtgtccaactttcggatcctgaaaagatcgaagaggtcatcaaagcctatagttatataggcaggcgacaataggaactgctggtggtcgtgatgtccaattatggatgactccctcattttccgcttagcattgcttagctccatgtattgcttatgtagctctcggcaagcaatacccatcacggctaacacattgccctccaccaatggcatgcctagctcaaattgggctggcgccctcacgaccttccccgctttgctcaccggcatcgacgtcgtagccttgcccctttttggctccggcgccaactccccgaccttccccttgccgcgttcacgcttctggcccttgacaagtggtggggagctatcggcctttcttgtggtctttattggagccaagctttgagctatatctaccaagtccatatcagctccaccaggagaatgaggtactgacaatgccggtccacagggagcctcaattgatagcttagacttgggaggtgtaagctccgtcggtcgacttggacgaggagtcatcttcacaattatatcttctttgggccattgtatgaacgtcttgcgcgcatcgcccaaagtcatgatttcatcattggggggcacgggcagcggatagcctgaccaggtgtcctttactgtatcgatggacaccttggcatacccagctagcaggtctgtgccgtggaccttgtctgtaaccgagggcttgaaagccatgccctcagcaacttcgggagcgaaagttgggtggaccctcgccagtaggacacactgtgctacgccctgcatatgtgaaagtctgaatttaatattggaacgtgtaaaggtttttttattagatatggattggataacatcaattacctctatgtggtccactgcagctagtggtgtgaccgggagaccaggggacggcacctctgtggatgcacaactactcctatgctgtaacggactcgcgtcgtgttgtgcacgaggagttggatgcacagcaggtgttgtgcctcggggtatattcatgtcggcgaggaccttgttaaccctttcttccaccctagcattcatgctagcttctagttcttgaatgacctcaaccttaagttcggccttcaaacgagcgtccctctcttccttggtgacttttcgtttcctgtattgggagctgtactacgggagtccatgcttcaaggacacattgctaccaattcccctagtccggccaggatgttctttggttccgagcgcctttgtgaggatatcatcttcgcgcctcttcggcgcggactcaacctcgctttgtg

SEQ ID NO: 61740 - DNA, 53376 bp, Oryza sativa
ataccatttttttctctaactaacaaaaaaggatagcttttgaggcgtgattcaactatagaaagcataatgccccaattcattccaaaccaaaagaggagttaagtggtcaatctgcaccaaacaattaggataaaatggtgactcaatcttcagttgatagaaacattcagttttatctttggtccgatttgactttcttgcatatgtagaattcttatatgaagtcactaaattatttcaggtttcatgcccttgctacaaaaaaccaccaagctatactcagggagtttatgccaacatgaatagagtaaaacaactgctttcattataagcaatcgcgcaaatatgttatgaagcgcccatgcttgccactgtatcatttcttgacgtggatttttctttctttatgtggataccacagaaatcagcatgattttgatatatgtttggaaattaattatactttaagatagaaacataagcctaagtgcactagtaagaaccatgacccaaactgtacaagtacaaataaaatgcaacggtgcttatagatggaccagaagtctaaagtgaatttattggaaagcaagtacctacactcaaagcccagatgatccaagtatgacacagcttttttcaaatttagcaccattccgggtaaacagctagcatttttgcgcgaaccaacttcctctgctgcttgcagatcaacatatagtatatttgtatttgctggatagttagcctgcaaactaaattaagaaaagtatagatgataaaatgtcaatacctataaaaggaaaacagccttattcatatgcatcaaacataaagggtgaagcagataaagtatatgttgccatacagcatcaatattttaatattcaggtaggtttgcatacttgcattgcatttactatttccaaaagtcaaagtaacacaaactattggtattgttctggaatcttgattttttttccccttgatacttttaccaacagaaagtatcactctcgaagactgcttcataaacctttctgttacagttttgatactaagaacctaagtttataactcgcatttattaagatattaaaattagccatcaaatttcttcctaatcatatgaacattccagtatgattaacaatttaatatataggaaaattaaaacaggaggaagggtaaagcatcacgagcagaaaaataagtacgcggttggataaaattgaaagaaatatttacctgccatttgttactgttggttctgggatgccatatttttcaaactcagtgtattcaatgcaagtgataccatatgcccattgtccatcctggttttctttttcgattagtacatttaccccttcagtagcactggtcttcgttcacaagacgcaaaacctaatttctggagtatgatatgtcagaatatggaaagagaacacaatagttgaattcaaaggtgcaaagttaacatggcagccaggatttgcatcagtagctaatatggaacactcaaaaggtaaaatgaaaaagagtttcatattacccctgggaaaacttttaccttatcgtgacgcaggcctattcctgccaatgccatcagtgttaaatcagttgcagccacaacattgctgaaaattacaagacatgcacagttacttcctttccaaataatatgttttgacaatgattaacaaacatttgattcttaggataacctgacttgacgtacagttgcgccttttctgccattttggtaaagccattggaatatacctctatcacatgcaagtttccaaatagcaccatgaccaccaggcttaccaacaggaaaaagtgctccgctggttaaccatttaccatccttagcatttactacaggtaccaaaggctataaaagtcatgatgagatttagttagcactgtaccatagttttggacagaatgagtaccgattttacagactagaaagacacacaccaataaataaataaataaataaataaatactagaaatcttgattatatacctgttcaaataagcggaaattctcacggcctctgccaaaccattcaagtctttcacatattgcagttatatgctcatggttatccttcacagagcttgtcatgatcgcgacaggagttatacattgtttcccaaaaatcttgaaatgcaaaaattccctagcctgccaaatatggtgccattcacacaattatattactggtcatagttctttgaacctttttaaatttctcatgacagagtgctacaaaggaaaagttatgcaagtaatacatatgtaaccatagacactttacacccttttcaatccttgtgaaagaacattacataaatgtggtttgctagaatatttttcatatagaagttagtgtcacctaatgaggtgtactgcataaatagaatgcggaaggagcaaaccaggtggtttctacttcctccatttcatattataagactttctagcattgcccacattcacatatatgttaatgaatcgagacatatacgtgtgcctagatttattaacatctatatgaatatgggcaatgctagaaagtcttataacctgaaagctaagccagtcaatcccctattgttttcaactttcaagtgataccctcagtaaaaatattacaaataaacaaaagttccatatacttagcagaagtacctgcagatcacgtatgaggccttctaatagagatctcccacaataaggaagcaatgcagcagggagggattcaccagtatccgagtccactaaaccaagacgatcaccagcaccaccaatcggataaatctctcctagttctggcaaaccctagaaacggtcaaatttcagttcatctaaagagaatgtaatgtctttgacaaaatgtcccgcactaaaaaaatcagaccacaaatcgcacggactatgctattgatctctttggtcaattttaggtaatgtagactaggaagtaacctcaatcccccacagagcagcttgagatgcatattccgtatcttccaatagattaagtccacttggaacatggaagtcaatagacttgtgtttgctaggccggtgcttgtggtccttcgaggctgaaagcaactccaatgccataatctgatagctggaaccaataaaggaataccgatagtgtttcagatatcagggtgaaagcaaaacattgtttaaattttagtgatgttttaaagagcactgcactagagtacaaacaagctatggcaataaggttaccaactcccagattttggccaggagcacaggattgcttggcaactttagttaatccctcgttttactaagtctacaactaaagcaaagcagcaaacaagcaattctcagtttctcacccgatgatgcctccaatgcagtcatagaacacgtcgatgtcgccgaggaatttgagcagacgccggagaagctccgattccccgctctccgccacaccctccaccactccctccgagctccacttgccgaccaaagcagccaagctagacagcgcctgccgcagggcgctccgaccatcgctcccgccgttatggtggtgatggtgctcgtggccgcgaccgtcccagtcgagctccgcgccgagcacgtgttcctggccggcggcgactaggcatttgagcaggaacacctcccgcggctcgagcgcgcccagaaccccaccattcgacccctccccgaagaactcgaccacccgggtctcggcgtcgagcgcgcggagcttgtcggcgagggagcgagccccgcggaggcgcgcgcgcagggcggagaggcgcgcgagctccgccgcgagcgccaggtccccgccgccgcgcggctgctcgcgggaggtggccggcccgggcccaacccctcgctcgagtggcgcggtggagacgctctgcgagcgggaggccgaggacggggacggggatggggaggagagcgcggagaggacacgtccacggcggcggcggcggcggcagccgggggagcggagcggcgggaggcggggcgagcagaggtcgaggcggaggtggggtggaggcagcgtgcgagaggccatgcgaggagtggagagcacaggaggtggtggtggtggagagcgagcgggcgggaggaggggggggagaggtgagacttgagaacgagggagagaatggataagaggaggacggcgagaccgcgagagcgaaagcgaagggggcatatgctctcgggcggaatctcgggtacccctgcgtgcgcgcgggcgtcgcggaagacgcgcgcccggcgcgccggttgtcacttgtcaggtgatctttttgctgttttctggtggggccgtgggctgcttcttgaaacttcgttgctcgtagcccatttagggcctgtttggtaagaccaaaaatatgggtccattactgtgtatggatcagaaaaaaatggaaaattttgaggaaaaagtacaccgaaggtccctcaacttctcatcgagttaaaaaatatcctcaaaccgcaaaaccagatatccggcgtcccttaactaatcaaagctggtcacaatagatccttatgtggttttgacccttggttttggcctacgtggcggctgagtcagcgtgggccccacgtgtcaaggttatccacgtcagcctcctatccttctttccccttttctctcccgtcatcatctctctctctcacacacacttctctacaagctggccagggcgaggcaggagagaaggagcgcggtgccacgacggtggcggtcacagtggggaagcacgtagagatgacacaaacgtgtgcgggacgaagaggatgggcacgatgcggcgggcgtggacgctgggaggctggtgagctcctcccaagtacaaatccgatgtcggctttggcttggcggtggcggcaaggcgggaggaatgcagcgaggagggcgacgccatgagggcgcttgaggaccaatgctacgatggtggggaggcacggggaagactggtctcggcttcggcttggtggcggcggtgaggcgggaggcagggacaggcgcgacggcggtagctctccaggaccaagcgtcgtcgttgccaggagctaaagggcgtcgccgtcgctggaagctagaggggcgagcggctcattagggctcgacttggacgacaatggcgatgtcgagcaggcggtgtggcggcgtcggcaggcaagcgcggctacggagaggcgacggcgggtgagcagcggttccggacgcgggcggagcggcggcggtagcgggcgagaccgctcttggtgtgccgacgctcctcttgctagcgcatgccgaggcggcctccgaccaggcgtggcgccgcgactaccccaacccgtcatcgtcccccagcgcaggtgaacctcgtagagcccctcctgtcgctcacgtcatcttgccaagagcggtcttgatatctcgccggtcgccacgttgccccttttccgatgtcagacgtcgctggcaccatgctcccctctgtcctcttcgctcttcccctgtgctactgttgccgccgccctccccttctcccacgtagccgccggcgccgtgtcgctgtgtttccccgccgcaggccaccgttgcggcccgccgccatcttctctcccgcctcgcctaccggtctctgcacccaccgctttgcctcgcccagaaagagagaagaggagaaagagggagggtgatgatgtggatcaccctaacatgtggggcccatgtgggttccacgctgactcagccccacgtaggccaaagccggggtcaaaaccaccgaaagacgtattgtgaccagttttgactatttaagggacgccggatatctggttttgcggtttgaggatgttttttaactcgatgacaagttttttttttttttgagaaggtaactcgatgacaagttgagggaccttcggtgtactttttccaaattttgttctttgatcaatgtaagccagaaattgggcctccgaaacgagggctcaggccttctggtttgagtatttgacttgggctaagcaaggtggcccaaagagatatttttggggaggagaggcccaaagaaatttggatggaacgccatcgttacggtcccaggctcccagcaccagactcaaaaggtagtgtttaacatcaatacggtaaattgttaaagataagaatgccaaaaaaaatcattagtgttaacaaagtttagatgttggaagcattattacatctgcaatgtttcctgttgatagagtttaggtgtatcctcaaccgtgtacacagggcacacggaaagcaattcaatcaggccagagctgcagataaacccagcacttaattatcagctcctcaattcaaattccaaccgtatcacaaaaggaaaacatttgagttaaaacgactgatgaaacacacgtgcatgcaccggtcactttgatcgagcatgtcttaacgaacagcacgagagctttggctgttggagataaggcgggaacgaaaaagctcgatgtcttaacgaaacgattacaccttcgtttgaaaaatttaaatctcctgcacgcgtaaatctctcatcgccccgccactatataaggcgaccaggtacccgaccccatgaacacacaccaaaccacctcgagatcgcttcactctcgtagcaatggcgccgtcgctagccaccgtcgttgcgatcttcctcgccgccatcctcctctcgtcgccaccaccctgcgccgccgcttcgtccgcgccagcgccggctgcggccgggcatggcgtcccggcggtgttcgcgttcggcgactcgacgctggacccgggcaacaacaaccgcctcgccacgctggtgcgcgccgaccacgcgccctacggccgcgacttccccggcggcgcggccacgggccggttcaccgacggcaagctcatcaccgactacatcgtctcgtcgctcggcatcaaggacctcctcccggcgtaccactccagcggcctcgccgtcgccgacgcctccaccggcgtcagcttcgcgtcgggcggctccggcctcgacgacctgaccgcgaacaacgccctggtgtccacgttcggctcgcagctcaacgacttccaggagctcctcggacacattggctcgcccaagtccgacgagatcgccggcaagtccctgtacgtgatctccgccggcaccaacgacgtcaccatgtactacctcctgccgttccgcgccacgaacttccccaccgtcgaccagtacggcgactacctcatcggccttctccagtccaacctcaacgtcagatcaatctacacatcacaactctctctctttgatctgatcttctttcaatcttacataggtcactttagatcttagattcacggtagagttgaaatttgtgtgttaaattatagtggtttagaattttaaatttcatctaaaatagaaacaaaatgatttatccaaatattatcaacgtaatcgtagatctaatattatagacttgtagagctaaaattatccatctctaaaaaaaaaaaatcttgaatccgcagctatgccaaagaggatgacatactcatcttcatgatcaaaagttaaaactcacaatgcctttgtgtgttattattgaccgtgcagagcctgtacaagatgggggctcggaagatgatggtggccgggttgccgccgttgggctgcctcccggtgcagaagagcctccgcggggcgggttccggaggctgcgtcacggagcagaacgaggcggcggagcggtacaacgccgcgctccagaaggcactctccaagctggaggccgactcacccggcgccaagatcgcctacgtcgacatctacacccctctcaaggacatggccgagaaccccaagaaatacggtgagcaatgctcctcatctgatctccttccgtccaaaaaaaaactaaccttaaataacgatgggacataacctaacctagtacaacgaatcgagttttttttttggagaataagggagtactcatgcacaagatcacgttgcatccggtgaacttttgatttatttgatcatggtgtgtgtgtgtgtgatattgcaggtttcacccaggcgagcctcggctgctgcgggacggggatgatggagatgggggcgctctgcaccagcgcgctgccgcagtgccagtcgccgtcgcagtacatgttcttcgactccgtgcacccgacgcaggccacctacaaggctctcgccgatgagatcgtcaagtcgcacgtgccgcagctcatgcagtaattagatggtccgtagcatagtttagtgtccagtgtgttaaactaattattaagaataatagatatgcatggttcagtagctatagagtttttgcatagagtaaagtccatcaccggtccctaaacttgtaccgctgtgtcatcccggtccctaaactcgcaaatctcggtccctaaacttgcagatcactcgtttaggtcctccaacttgttcagttgtgtcaccccggtctctaaacttggatttgaatatcatctgggtcaaataggacggtctaaagactttatatttaaaaataattcataactttttcatgtgaactctaatgaagacaaactttatatcaaacttgtagcccttgacgcgatacacaacttggaagtgaattttttttaattttaagtcattttttgtcccaaaatgtaatttcaaaattaaaatttcaaaatctataaacatgcaacaatattttgggaccctaaacagttttaattcaaaaacttttaaactacaaagttgtaggtcacgtcaagggcaacaattttaatataaagtttgtcttcattagagttcacatgaaaaagttatgaattattttttgatataaagtttttagaccgtactgtttagggaccggggtgacacaactgaacaagttggaggacctaaatgagtaatctgcaagtttagagaccgggatgacacagtcgaacaagtttgaggacctgaacggtcgatttgcgagtttagggaccggaatgacacaacagtacaatttagggaccggtgatggactttactcttttgcatacatatgttattagttggtccatccgtatagggttaggggcaaccacaatgtatgaaaaaggtaaccttaagtcaatgattgcacttgtaaagtgagccatatacattgtgaaaagtagcattagtttagggtgcaccttatgcttaaggtctaccacaagcaaaaagaaaatattttctctttcattcacttcatgaacaagagatgaaacaattatttttccattctatgtgggcccatcttatggctaaattctaaccataatattgttagtatggctttaacaatggcttattaaggttacactacaccacaaacattgatgatgcccgtagagtgggcagatattcagtgcaggatgtgtacacagggttaattttaattcagtttggtttattcaaaggaattgtgagccatctcatagtcgcagtcacagacaacagattgatttgccatttacattgtctactagtatatctagattagaaatcaagcgcatggatattttcttcacatttggccctgcatatactgaattactgatatgttcaaacagtcaaacagtacaatcacagactcctaaatcttactgaacaggaagaataaggaggccctaattgatctgtcacgatctaaagaacatgcagagacctatccatagaaagtgtgttactgaactgtgacggttatgactcgctgatagaatcgccattctactacgaataacaggtctgcaggcaaaccccaaaataactgacgaaactcccataattttcccaaaaaataaaatagtttatcatcaagcccctaaaagcaaacttctccttgtctccaaattttcccccaaaaaagtgagtttggcaactaccactataagcttcctaatccatcaaaattcctgtcttaatattaataacctgaaaaagcaaacaggaaacattatggacacatgaatagtcatatgaaaatttgtttggaaaatgacaattattctgtgttaatttggaaaaaactaaaaaaaaagtgagttatcatctgcaattctggataaatatatttttttaagacaagaaagaaggtcaggcacgcttaagcccagtattatgacactcacaatttcacaattttcagtttttaagcagtcaatcatacttgctatagaaaacaaggactattgggacaaataacgtacttaccctaataaacatcatctttacttgcctctgtctgaacggaccagaatgtcagccagcgtctcatttttcatattgttcttgcctgaaaggttgatctttgaatgtaagcacaaaacttgagcaatggccaacagttgcaatcaacacaaatgagttataacatgtcgatttgtgtgcagttctgcactacatacagtcatatagtaataattgagctagtcaatgatactgacagaggcttatgagtatttgtctcagcatatcaatatgttgccattaacacaagaaaatataaatattttaacataactgataacttatatctgagaaactcaaataaacacataaagaggcctagagtatgaatcatcttaacatgtgccttttaagcttgactttacataaacatgtaagcataatttagaagaaggttcaaatttaaatttcacaaacagcagataaaaaaaatttacaccggaactttatactccttccagtcatgtttacatgacgtttaggacaacagaatatacttcataatagcacaactaagctgtcctaaatgtctagtatacttaactggagggagcagttgttacttggtagcaaattcctaaatgtgcctactgttatattgtagcgcagttctccttttttaagggaagaacacagtctgactcactgactgtaatcagtagtgtagcccagagccaagatggatccggtgaaatttcatacacattttgtaaagaacagagagtgatattatgaagacacaaaagtatcaacaggttcatgagaactgagaaacataatgtagactacaataggattattctaataaacccacttatgacagcaagaaaaacactttaattccacaagctaagctagtagtttttttttagataatgagctaagctagtagtaacatgttaaacatcttcaaaaaactttctttatagggcaattttatggtacttgaggagataccatgaagtaccattttttctattgtaaatttggtacctcatgatacctaggtactatgaggtaccaaaatttacactaaaattttggtacctcatggtacctcctaaagtaccgtagaattactcttctttataactaaggctttggtcgatatcgaaaatgttcagacgcttcaagaaacgtgtacataaacaaattccagggccgccaaacaaaatgcacaatgcagcaaaattgactaaaaaacgtacacgcattcattgagttacctgcattagggatcgggaaagaatcgagccacggtgggagcacacatggaagcaagacacctgacgagctcactgtcgggaaaacgtcgctgcatagctcagagcactgaatcaccttcttcaagcgcatgtccacgctaacactaaccctctcaatcgcgaggtacaggacatccgcgttaaacggatcaatggcaccgatgtacggtatccccttaggagatccccctttggccccgagcgtagacagcgccacctggtgatccagcgtccagtggccactctcgtcgtccagcgtgaacgacatgacaacgaacggctcctgatcggagacctcgacgtagcgcagcttgccgttgctgacccccattcgccggtgcttgacgattcgttccatccctctcgagcacggtttctcagagaggatgctacctggcggcaacttgatggaacgggctcaggccggtggctgaacgggtcgacagcgacggcgccccagctcacgtccacccaccacagccggccaccgaatgccaccacctcgtggttcattcccattgcccgcccgggcggcagcggagacggcatgaccagcttgctccattcccttgtctccgaggagtacctgcgcagcaggaatcgccggccctcgtcgtcgccgtcgacgttgctgagctgcgctgcggcgtacctcttcggcggcccgtcctcgccgccgccgtcgcgttgggtgaggatgccggtgtggtggacgtccacggtgttctccgtgccgtcgaagtccggcagccggaagagctcgccggtgagcgggttgcagacgaagctcgcgaagtgctcgtaggtggtctcgacggtggtcctggcgagctctgggatgatgacgtcaagcggaagctccgggacggggtgagccgggccacggaagcaggccttgaaggtgtagacgaggaggaggccgtcgccgctcgcggcgaggacgccgcggccgcggagggcgacgcggctctcgtcggcgctgatcgggcggtcgttgagcgctatggccttcgccgggatggtgacgcgggaggcgcgcgggggcggcgcgagggcgagcgacacgccggctccggtggacccgtccgctgtcgagatccggtggatcagcgcccacggaggacgcgaggcggcggtggtgagggcgcggcggagacggccggaggcgacggcggagaggccacggtggcagagcattttggagtagagagacagagagagaaaggaggccgagagggttctgcacttgtgcttttcgaggacaagaggagagatgtgagggactgtgggtgtttgtggactcggtgcacggagttttctgcgtagtggtgatgtcatggcctcacggcagtcacgggcagagaaggcgtgctccatctcagattctcagtcagtagttcagtacagtatgtagatgattcactaggaaatgggaatggtggagaagaaatcggtcggaaacgttttttttacttaaggaaatggttgaaaacaggagagaatttttcatatttatgaatttgacatttagtgttaacttcaatgcgacgttgacagaaattagaaaaactaaaatttaatacagtaataatcgataaagatattattattattattattattattattattattaaaatttactctctctgtctcattttaagtgcaattataaatttctatgttcaacttaatcgtcttatttaaaaatgtttagtcaaattatttatgttttatcatctaataacaataaaaatattgattatgaaaaaattaaataaaatggacgattaaagttaaacatggaaatggagggagtacatgttttgcacccaaaaacataagaaaataaacgtccaccacaaaaccaatattttctatttgtttctattttctactccaaagttcaattatcgatcgaatcaagtcatttcactgtattaataaaacagtgtcacgcactgcaaggagaagttgcaaatcgttcccgttagtatttctcaaaaccagggccacaaagttaatcaataccacagtataaagcccaacaaactcgcatttctaacagcattctctcgaagattgtttcagtttggattgttcaaacaagtcatctcatagattgatttgtcatacatacactgcctactagtaacaaattagtgtaatacattggaacgtaagagcatagatatttcgtcttccatattcgaccaatgcatatactgttctgttgatgaaacaatacaatcacagttaacttgcagaacaggacgaataagggctccctaattagatttgtcacaaggtacaaaacatgcataggcctatccatagaaaggacgttactgacttgcagttaaacatatatgctgtcctgtgacggttatcacacgctgattgaattgccattctaatacaaataacaggtctgcagaaaaagctcccaaaaactgaagaaacagtcagaattttcccccaaaagagagttcatatcttcccaaaaactgaagaaactcctgtctccaaatcttcccaaaaagagagttcgacaactaccaaaatcagtttcctaatccatcaaaacgcctgtctcttaatcttaaaaacctgaaaaagggggaaattatggacacttgaataatcatacaaggatttaaaaccctgaaaaaaggggaaactatggacacatgaataatcatacgaggataatttgtttggataatgacaattattctgtattacttcggaaaaactaaaatatcatttgcaattatggccaataatatttttaggataattgaaaaaaaatagaataaagaaagacataggcacccttaagcccctccttagtatcatgaagagtaatacttttgataatactcttcatgcacttaaccatgatgctatgtctttccttgccctactttgtttcatgatactcttcatgaaaaacccttgaaagttttcatggtattgttcctgcacttaaccatgcttgctagttgagaaaataacaatgcaccttattgagatacatctaataatgaaataaactaggactgctggggaagtaaagtactaaacctggaaaactttgtatctacttggctctgtctgaacgaaccagaatttcagccaacgcctcatttttcacattgttcttgcctgaaaggttatccattgaatttaagcgcaaagaaataagcaatagccaaaagttgcaatatcaagacaaatgagttataacaagtcgatttgtgtaagatcgtttggtttgaagtaatatattcatccaggtgggcatttcacctccctgtgatctgtctaaaaaaacaagccaatttgcctgctctgcacacgataatttagtcaatgaaactggcaggctttttagaagtcatctctatgttactattaacagaacacaaatataattgttttaacataaatgacaatcttatacctgagaaaatcaaagggcaatgaacttgtaagtgatattttgccaacattaacattgctaactataataaatacttgaggccaatcaaacaccccaacctttttaagcttgactttacatagagatggaagaaaattttggacaagtaaatttaaaaatcacaaatagcaggtaaggtaacagattttacattgaaaccctcaagttggtagcaaattaccattcacaaacaacagataactaattttagacaggaacattttagttggtacttggtagcaaattcccaaatgaagctagcgaagaactggattatgcggaggtgtaggcatactggcataggtggctcgatccagtcggatcaacagaacttgtatgtgtattcatctatatccagttaaattgtagtaagaattcattagtggtatcgctagtggtatctaacaaataactctaataggattggattaaattgtagtgagaacttgtatgtgagaattcgttagtggtatggtatctaacaaataactccaataagcttaagtcatggaacgttaatgagctacaatctctaataaattcccatgggagactcggaggcagtgaccaaggcccaatatgccttccttgagaaacacacgccttagcaaacaggaagaatctctatgatatccattttaacaaaattaaaacaattaacatgtggatgtactaactcgggtaaacaagaacgagaagcgaactgcagagtacataatcacattatgaaagaaacattcaaacatgcaagtacaagtgattacctgaagaaggaatctggcatgatccaagccacggcgggagcaagcagggtgtcagccagttgagttggtctaacagagtggccccagtcaccaaccccgtctccatgtccacgccgataaccacctggttgcctggaccggccatgaggtacacgacgttgcctttaagcggatcgatgcaacagatgaacggcgcctccgcgaagatgtggcttccgtccgggcagagctgtctcccgtcagccaagggctccccgctggacaccagcgtccagcggttgcccgcttcgtcgagaacgaaggagtttagctcgaacggctcggccccggccgacgcgggcacctcgacgtagcgcagcctcccgtcgctgaccccgactcgccgatacctgctcagcctcagcttccgtcgcgtcgcgaagcccgacgcctcggcgggcagcacgctgccggtcggcagcgcgacgatgcggaagtccggctcgtcggcgaacgggtcgaatgagacggcgccccagcccaggtcgatccaccacatccgcccgccgaacgccaccggtgggtggtcgatgatagtggaacgcccgaacggcagcgaggagaagaagctcggcatcgcctcccacctccccgtctccgagaggaaacggtgcatgacgtggccgttgacgccgacctcgatcaccgcgtaccgatcaggcggcccgtgcccgtccccgcgatcggcctgggtgaggagccccgccgcgccgccgggcgaggcctcgcttctcgcgccgccgatgtccgggaggcggaacagctggccggtgagcgggttgcagacgacgcgggcgacgtcgttctcgtacaccccgcggaggaggaagccgtcgctggtcgctctgtcgatgaagccggcgaaggggggggacttgctttgcgtgagcgccggggccgtggcggccgcggggagagaggacgcccaaggggaagaagagttgggaggcgcacgggggctcggcgatgcgggaggtcgcgtgtagctccggcgggtcctgccgcgcgatgtctatcatggcccacgcagggcgcgagggagaggcgaccgtcgagtgggagcgccggaggcggccggagacctcaccggagagaccaaggaggcggcggagctgcatggtggcggcggtggggagtgaagagtgggggagaggggagctcggaggatcagaaattgggagaggatccgttgcttttgctatttcgacagagccggtgcatgtggactcggtgcgcgcagtgatgatccgttggttttgcctggaccgtgggagtgggactgttctactggggttgaacatggacccacttgttctacaggtggtgtatgcggagggtgaggatgcttaacattcactagtactcctacgtcctacgtggtctcacttttctattatctcgcgtatcagtgtttataataatgataatgttattatggtagagcatacgaaccgcatacggaaagtaccacggatctattctaccaaacatgacggaaaaaaattggatatgacaaatcctaatactacaaatttagagatatctctgtttagattagagtattatgtcttacaaccaattacttcctccgtcccaaaataagtgcagccatagttttccgcgcctaactttgaccgttcgtcttatttaaaaaaaattaaaaacatatgttacgagtaaagtactatttatgttttattatcttataacaacaaaaatgctaattataaattttttttaaataaaacgaatgatcaaatttgagagctgaaacttatgactgtacttattttaagatggaggtagtataattttttttaaaacgagcaagtatgtagtagtacaacggaagtaaaacagcgaggggaaagcatctttgtcttttagcggaaaggcgaagaggtgccgtgtttgaaggtttgaatgcccagtcatgtctaatggcggtgttgcgtgtttcccattggttgttcacaaggtctgactccaccggttttcccgccaaaactgtcttatgatgggctggttgggtctagtacaagcaagggtccatgggctggcacgaactcacttcacaggctcggacaacttgtcggaattacagaagaccataaagcgggtgtttagatgggactagggggtgtttagatggggctaaaactttttagcctatgtcacatcggatgtttggacgctaatttagagtattaaacctagactagtaaaaaacctaatttcataaatgaaagctaatccgcgagacgaattttttaagcctaattaatccataattatcaaaagttaactgtagcatcacattgtcaaaatcatggcgtaattagactcaaaagattcgtctcgcgaattagtccaaggttatggactggattttgtaattagtgtatgtttaatactctaaattagtgtccaaacatccgatgtgacagggacttggaataagtctctagaaaccaaacaggccctaaaactttttaatccatgtcacatcggatgtttggacgctaatttagagtattaaatatagactaataaaaaaactaatttcataaataagagctaatctgcgagacgaattttttaaacctaattaatccataattatgaaaagtttactttaccatcacattgtcaaattatggcgtaattagactcaaaagattcgtctcacgaattagtccaaggttatggaatgggttttataattagtgtatgtttaatactccaaattagtgtccaaacgttcgatgtgacagggacttattgtaagtacctgtttcccaaacaggcccaaaattcgctcaaaagaaaatacagaaggccataaaaaaaatttcaccaagtctatcaaataaaaattctggcaaatttgaaacaactgggatgtacaattccattttaaattcaagttctttgcgaggagtcataaaggatctaggataaaagaaaaaaaatattaaggccaagcatttgcacaagagatgcgaagccatccataatatgcttacaaagtaacagaactgatgccatgcaagctgtttgtactttatagtagccattacatgctgattgaaccgaatcattctgatggaacgaccaacaagtcggagcactgaaatggcgaaactcccacaacctcaccaaaataagacttaactgattttatcagcaaagacaaacaaaccaaacttcttcattccccagattttcacaaaaaaaaagagttcagcaattaccaccattaacatcttaattgatcatagcacttgcatttagattatgaaccctggaaagtaaacggaaaacattagggcatgtacaaaggtagagtcggatatgagctctacgttatttagagattagcatcctacaacagttagagacaatatggtctctaatcattaatgtatcaaaatattttttcttacttttatttcctttctttcaccaccatgcaacaaaatttgctctagtaaatgctaagagtcgactctgagccgttgtcatacataacaaccatactcctttctctttcctccatgtcatcaaatttacttgcatggcaatagagagagaccactaataaacaccgtatgcatgttatcgtgtgaacacaagtaaacatcgtcttttagagtttagtcagaataaaaaggaaacaaaatcaacaatttttgtacagatacaaggccttttttatgtgttcctttagaaagtatgaaataaaaaaaatgaattgtcaattattgttccctggaacatatgcattctctatatggataaattaaaagaaattagagcagatagtgatatatacatgttagcaagcagaatttctgacttcataagttggccacaatattgtaggacaaaaagaacatgattcatcctgatggtaatgccagctggccaggcaacctgtggcatttaagcttaagcagctattctcagcagcactaacatttgggaataaggatgtatgagcaaatcaagtactccacaacaatttgagtataagctctagaaatggtaacaccattataaggaggtagacaaatgtacctagtatcattcataaactccaacgaattcagaaaaaaaaagattaggaacatcgatagcatcgaagtattggtcaaccatgatagactcatccacacgatagcattggactgacgatgtaataactaacagattatgagcaagttgtttctcaaaagtaacctattgcattagctgcaagcctgcaactaatacccgtaaaaaaaaagcctgcaactaatatgagagatccggaaggagcaatgaaatatgacaaatagtggataaaacaagggtacacaaacacatgagttagaagagaaaataccaatagatgaattagccagtgtgcttcatttttaacagcatctatctacacgaaccagcatgtctgccaaagacttcctttcaacattggtcttcttgctcaaaagggtttctgcaatcatgtatacaagaatttgaacagtagtaacacagccatgatagtgacaagaaacaatatgcgtatatatccaataattgcaaaagacatggtaatgaacattgcatcaaaacacctgggcattaactatatgaacaaaataacaagtgttacacaacagacattcctctccaagaccacaatatgcgagattcttctgggaaataccaagttctggtgctgatatatgtcgatgattatcactggtatagtcaatttactagaagtgcaagccctatcagagaggattgactctgcttaacctagcggtggcaccactttgagggcagctatgcaggatcacttcaatggaacattttcaatagtactgcattagactagtagagaaagatagaaattaaggtaaactagatgcaaaatttggagttcacaaacaaaatctgaatagaattcaccagtcaatttagtaacctgaaaagcaaacagttagcatcaaacatcctttttattgcattagtccgaattacataaagatggaagcaattgtagaacactataaattagaaactcagtggataacagtaataagatttaagccagggaccctaatgagatataatctgtatcaaattgcaataggatgcttagaggaactacactgaccaacacctgtataagcccaaacgtgttacatgaaaattcaggcgcgttagcagcgaacaggaaaatcgttatggcatccatttttaataaaattcagacatttttagttagatgggaagtgcagaacagataaccacatgagaagaaaaaatgcttagttgatcaaacacctgtagaagaagggatccgggttgattcaagccacggcgggagcacgcagggtgtcggccaggcaggctcatccagcacagaaagcccaaaccccatccccctctccatatccactcccaaaacgagcccgctcccgaccatgatgtacacgacgtcggcgttaaccggatcgatgcaagcgatgcctggcatccccgggaagggcgccccttgcgcccgcagcgctgtgctctgctccatcgtccagctgctgccatcgtcgtcgagcacgtaggacctgaccacgaactgctccactccggacacctcgacgtagcgcagcgtcccctcgctgaccccgacgcgccggtgcgtgctcagcaccttcttccgtcgtcgcctctcgaagctcatctcgttggatgaaggcagcactctgcccctcggcagctcgacgaatcggaaatcgggctcgtcggcgaacgggtcgacggagacggcgccccaggcgaggtcgatccaccacagccggccgccgaaagccaccaccggctggtccacgacgatcgggcgcgcggccggcagcggggacaggaatcccggcatcgcgtcccacctccccgtctccgagaggaatcggtgcatgacgaagtcgtcgcagctgacctcggccaccgcgtacctgtcgggcggcccgtcgccgccgtcggcttgggtgagcaagccggcgtagcccatcagaccgggcgaaacctcgctgcttgcaccgtcgatgtccgggaggcggagcagctggccggtgagagggttgcagacgacgcgagcgacgctcctctggcccggaggccgagacgaagcggggaggttgggagccgtcgcgtgggcgcaggcgcaggcgccatgcgcaacaatggcgcggaggaggagcaggccgtcctcgctggtcgcttcctcggcggcggcacaaagggggccctggctaccgcggggacggatggcgtcgtaggggacgaggagttgggaggcacgcgggggctctgcgaggcggaaggtcgcgcgtagctccggcgcctcctcttgcggctcgctgaccaccatggcccacgcaggacgcgagggagaggcgaacgtcgagtgggagcggcggcggaggcggccggagacctcaccggagagagcaaggagtcgccggagctgcatcgtggcggcggtggggacttgggagaggagagggagaggacggaggattagaaattgagaggatgcttttgcaatttgtcagagccggtgcatgtggactcggtgcgcgcagcgatgatccgttggttgcgtggagaaaatgaccgtgcgattcttctacgaggaaatcttggggcccatttgtcagtgattaatctatgggtgcagtgcaggaagaccaatgtcaatatgtcatggattcttctagctttcgcaataaagcgtgtgtttagttcacgtcaaaattaaaagtttagttaaaattgaaacgatgtgacaaaaaagttgaaagtttgtgtgtgtaaaaaagttttgatgtgatgaaaaagttaaaagtttgacgaaaaagtttgaaactaaactcagccaaaaccaacttctgttataatgtggggttctatttttcgccatcagcaagcaatctgtcaagattgaagatgagaacacacagtagtactcataactaaggagcacatgcatgatgcaagctaccataattttacagagaagagaaccataatgtgttgcacgtaaacattctacagattttcttgactgccattcagacttcaattgtcaatcgaaccaagtctatcactgaataaagtaaacatggttcatagcacatacagcaaggagaagttgcaaaacgtttgccataatttgtcaaatgagggacacaaagttccatcagtaaagcccaacaaactcaaatttctcgcatcaaaaccctcaaaattcaacaggtagcaccagcaaagtccagatgcacagcaaaacccaaacttctcccagcatccccaaaatgagagttcaggtacttgaagaaactgctaccatcaaagggaatctctggatctctaccagtaaatttcaaggaacctgcaatcaatgagtaaacatcagtctccctatctcacaaacagagaatagcacagaacaagtgaaatgaacaatcgccagttttggtggttaaccaaaagtaacactgaaaccagaacatccatttggttttgtacctaagctatcagtcaagcgtgaagcattgcatgacttaagtcttgactacaggctacagcacaaattacagcctgataatatagtactagtaactagtaaagtagcatgcaagatgcaacatactttagtagttcagtctactcttgaatcttgatcgactagttacaaatatttcagcatagtaaaagacacatcaacatgaagattctgagaaacttttaggtttgagatagttcatgtctgcttgttctgataggagtgattgtcctttaccgaagcagcaattctcagcagcagcaacattcggcaataaagatgtatgagcagaacaagtactccgtgacaattcgagtataagctttagaaatggtaacaccatcataaggaggcagacagatgtaactagtatcattcataaacaccaaagaattcaaacaaaaaatacaagattagtaacatcaatagcatccaagtattagtcaaccacgagagacttatccacatggtagaattggactgaacagactatgagcgagttgtttcttaaaagtaacctattgaatgactgcaactaatatatgagagatccggaaggactgatgaaatatgacaagtagtggatataacaagggtacacaagcacatgagttaggaagagaaaaataccaaaagatgaattagcaagtacgcttcatttttaacagcctctatctacacgaaccagcatgtctcccaaactcttactttcagcattggtcttcttgctcgaaagggttcctgcaatcatgtatacaagaatttaatcaagagacaataatagcatagccatgatagtgacaagaacaatgtatgtatccaataattgaaaaaaacgtggcaatgaacattgcatcaaaacacttgggcattaactacatgaacaaataataactgttactacctaagttttcaggttataagactttctagcattgcccatattcatatatatgttaatgaatcaagacatatacgtgtgcctagtttcattaacatctatatgaatgtggacaatgctagaaagtcttataacctgaaacggaggaagtgctacataacaggcattcctctccaatgacagcaacatgtgagattcttctgggaaatactaagttctggtgctgatatttgtcgatgattatcactgctatagtcaatttactagaagtgtaagtcctatcagggaggatttactcagcttaacatagcagtggcaccactttgagggcagctacgcggcaccatttcaaagtaacatttcaatagtactgcattagactagtagagacatagaaattaaggaaaacttgatgcagaatatggagttcagaaacataatccgaattaagttagaaaactgcaaagcaaatattagacatcaaacatcatttttattgcattgcaactccgaattacaaaacgatggaagcaaatgtagaacattgtaaatctgaattcacaaaatatacctataataacatttaagcctatggatgaaaatgagctataacctgtagcaacttacaacaggaggcttagaagaactaaccaacccctgccaaagcccaaatgcattactcgaacattcacgcgagttagcagcaaacagcaaaaatagttacgacgcccatttttagcaaaaatcaggcagtgataaacatggatgcactaacatagtaacaagagccactgaaaaaaaaacacacacacacatacagagagaaggaaaaatgcttagtagatcaaacacctgtagaagggatccggcttgtttcaagccatggcgggagcacgcagggtgtcagcccgatgggatgctccagcagacagctcccgatcatcacccccttctccaagtccaccccgacaacgtgcctaccatcctcgccgatcatgaggtacaccacactagctttcagcggatcgagagcaccgatccgcggtgtctcctgcaatggctccgaccagagccggccgagcgccactctgtgctccagagtccagccgctgccgccttcgtcgtcgagcgtgaagcagctgagcacgaacggcgacgcctcggacacctcgacgtagcgcagcctcccctcgctgaccccgacgcgccggtacctgctcagcggcgcctcctgcagccgccgcctctcgaagcttatcgcgtcggcggcgggcagcacgctgccgctcggcagctcgacgaagcggaagtccggctcggccgcgaacgggtcgacggagacggcgccccaggccaggtcgatccaccacatccggcctccgaagctcaccaccggatggtccgcggtgatcgctggacgcgccgcggggatcgcggacgagaagcccggcgtcgcgtcccacctccccgtctccgagaggaatcggtgcatgatggaatcctcgcctctgatctccgccaccgcgtatcgatcaggcggcccgtcgccgcggtcggcttgggtgaggaagccgggcttgacaaagcgccaagtaccgcccgtgtcgccggtgtcagggtcctcctccgggagggggagcagctcgccgccggtgagagggttgcagacgacgcggacgactttggtgtcggacttgaggccagggagcggcggccaggtgtcatccttgggcctggggatgaagacggggtttccgccatgggcaggaacttggactagctcgagcgcggtgcggacgaggaagaggccgccgctgttcgccgcgcagatggtgccgcgggagatgacctcccccttgctgccgtcgtcgacggggacagcgagggacacgatgaagcggatggggacgacgagctgggagacgcgcggtggcgaggcgaggcagaaggtcgcggtcgtgattggctccggcggttcttgctccgtgtggaccaaccccatgtcggccatcatggcccacgcgggtcgcgaggcggccgtcgagtgggagcggcggaggcggccagagacctcgccggagagaccaaggaggtgccggagctgcatcatggccgccacggcgtcttgtcgtctagtggtgctgtggtgatggggaaaaattgcgagagagagagaaagagagagaaagggaggatgagaaattgagaggagacacggttcatgtggactcggtgcacgcagcgatggtcatctgttggttgcgtggtggacttgttgtacgggggtgcagtgagaacagcttttctgggtcccacttgtcagttatagtagtccatgggtggagttggttcacgaggtccgggctttcgaaaaaattcctctatttggaacgatcgtacgagtagagcgaaaagcgaagcgattgttttgaacgggaggggaaaccggtggaaagcgaagcgattgttttgaacgtttgaagttttttgagcgaacctgaacgtttgaagttgaactgactatcgcctgtgcctgcgctgccgacgagccgatcgtacgtcacaaagtttcccgccaaaaatattcttgggctccgcttggtcatatgggcctacagcccacaagttgccgtgggttcacggcccagctgaatagcttaaggcgtccacatcaaagatatcgggttggtttggtttgtggcctaaataggccttaccaaattttatcaatgccaaattttggcaagttttgatatggctaattttggtaaggtaaagttatgtttggattgaagtcaaaatagcctaagttcactattgaaataacctattttcttaggcatgtcaaaatttggcttcaaaccaaataaacactaagcactattgaaattgtcaaatattggtaagcctaatttaggcctcaaaccaaaccagcccatcatctctctctctctctctctctctcactcactgcccctaagctgattagacaagacgattacaaatcgggcgtctgatttttaaagaaaatcggacattgtttcaccataacaaatatttgaccactataatatttgtgaaacatagttgaaataccattgaaacatttcattttcatggatgaaacatcaaacttcaacccgttgaaacatcccaaatatgcaagaaatatgaaacaccatcaaagtatccattgcaatacttcgattcaacacgaagaaaaatccaaatatattggctggaacataaaaaaattgcgaaaatgtatcaatccagatctagtttattcctcctctccggtggtcgtcgactgttccaaatccacgccgggatggtgcaattcctttctactccaccaaggcgggtaactgctgctgcccaagccttcatcacccatagtcactgatgaacaggagtaacgccacttccagatccacgtaggggccattgcctttctgcaacttccacccgtgtcgatgttcacaatatcttgttaggagctacacaggaaggacgccccctccccccacccccaccggccaccaccgacccctgtcggccccatcccctctgcatggccataaactcagtcatcgactaggggatgaacctcctcttcatcgcttctccgctggccttttgcagggccgccgatgctagggggatggctccctacatccatcttcatcggtgctgcctctcctccaccgctgttcgccgccacgccggccctctatctccgtcgttaaggacgtgcgtgggagagagatgagagagggagggggcggggggtcatgggatatgtggaatgagcggttgggaggagcccaatattttcttatccatcggaggctcgataggtagcgttttcattaacttttattttatttttataaagcccattctattaaaaaaatgataagcattttcaaactgaggaattttgcacacaaattgacgcaggaacttgaaaaaggttcatcataaggccaccgattttgacacagctaatgaatttctcaagcaatttcctgacctgggtccttgtgagaccattgaaaggaacaacatgtacacagaagcacataagcaatctccaattactacttcagatctgagtcgagtataacacgtgcataaggatatccatttgctgatggtaattctgttgtttattccaagcaaataggcaattggcagctggcaatatactcccttctactccctccatgcatttttaagtgcagccatggttttccgcgtccaacttttattgtctgtcttatttaatttttttttaaaaaaattaaaaacataagtcacgaataaaatactatttatgttttatcatctcataacaacaaaaatactaattataaaatttttttaaataagacgaacgatcaaatttgggcgtgaaaacttatggttgcacttaaaatgggacggagggagtagtacttttttttgtttgccatcagaaagcaatcacgcatcaatctatcagatggcctgacaaaaaattacattgataatgagaccatataacagaggacaaagcttagataagtcataattaaggtctaaggagcacatgcatgagaaattttgcagcaaagagaagcaaaatgagttgaacgtagacattgtttctagactgccatttgtcgatcgaatcaagtcattatactgaataaaacagggttcacaacttcatgcacacagcacagcaaagagaggttgaaacatattccccatagttttcaaaatgagcgccacaatcagtgataaagcccaacaagctcaaatttctcatagcgttccccaaaaatgacgtgtagtcaccattcgcttcctaattctctcgaacatctgtcaatgtgagtaacctgcaatgcaaatagtaaacatcaaacttcgtaataacggatgatgaccaagaataaacagttaaacactagggtcatctgaacattcatttgaataaatgggtaatacagttaacattaagagtaatttgctgtagtttctttcaagtaaatgccggaatgaatttcattgtctaataaagaagtagtagaaagaacatcgttcagtttaatcaagatcactttctgacatatatagtccactatacactgtgaatcggtgattacatgaaagaagacaattgttgaattcacagcacagtacaacagttgtgtcaagtggtcaccttgtatccggcttgatgcaagccacggagggagcacgaaaggcgtaaacacggtgggctcgtcgagcagaaaactcgcaatcaccatgcgcctttccatgtcgacgccgatgacgtgcttgccgtcgtcgccgccaaccacgaggtacacgacgctggcgttgagcggatcgatggcgccgatctgcaagggccccgccggcgagagcgggccgagcgccacgcggtgcgccagcgtccagcggccgccgccgtcgtcgtcgagcacgaaggagctgagcacgaacggcttggcaccggacacctcgacgtaccgcagcctcccttcgctgaccccgatgcgccgccaccttctcagccccaccttcccccgccgcatctcgatgctcgccgcgtcggcgggcagcacgctgccgctaggcaggaggacgtagcggacgtccggctggtcggggaacgggtcgacggagacggcgccccaggccaggtcgatccaccacatcctgccgccgaaggacaccaccggctggtcgatgagaatctggcgcgtgaacgacagcgaggacaagctcatcgtcgcctcccacctccccttctccgagagaaaccggtgcatgacgcaatccgcgcctctgatttcggctaccgcgaacctgtcgggtggcccgtccgcgcggtcggcttgggtgaggaagccgtggagaagattgtgccaactcttgctctcgccgacggtgtccgggtcctccgggaggcggagcagctcggcggtgagagggttgcagacgacgcgggagacctccgtgtgggacttgaggccggggagcggaggccaggtggtgtcgtccttggagatggggatggggaacttgacatggtcgggcacctgggcgagatcgaacacggtgcggaggaggaggaggccgccgctgctcgccgtgcagatgttgatgcggcaggcgacgttgccttcggtgcccggtgtagcggggcacaggaggcagtggagggggacggtgaggcgggagacgcgcgggggctcggcgaggcggagcgtcgggcgccgctccggcggcactcgctcgtccaaccgcaccgcgtcgtccatcatggcccacgcgggggcggggcgcgaggcggccgtggagagggagcggcggaggcggccggagacctcaccggagaggccaaggaggcgccggagctgcatcgcggcggcgcggcgtgtaggtggtggtggtggtggtgtggctgagagagaggagaggaggagaaactgagaggaagcttttgcaattgtcacgcccggttcgtgtggactcggtgcacgcagtgatgttccgttggtttcctggagaaatcgggttgttctacgcctgcggggtgtagggaaaactgtcgggtccagttgtcagtgagtatttgggcccatttgtcagtgtcagtggcctactaccactactacattgctggcccgcctccgtgcgaagtagtattccctccgtcgaaaaaagcaaacccagaattagatgtgatatcaattttttgttcaaatttactgaacaaaaacggatgagtatttggaacgtagcagtgcagcagcgaaaaaggagatggctttgaacgtttgagctgcccccccgaccgtgcctgctgccctgatctgctattccacgtcactagtttcccgtaaaagtgttttgggcctgacgcctgagctgcttgggccgtagaagcatcagtgaccatgggcccacggtccacggcccagctgagaaaaccactagcctacatgaacacctcaaattaaagggaaaatcatctctcactcaaaaaaatgaggggctggtttgatttgaggcctaaattaggcttaccaatatttggcaatttcaatagtgtttagtgtctatttggtttgaagccaaattttggcatgcctaagaaaataggccatttcaatagtgaacttaggctattttggcttcaatctaaacacaactttaccttaccaaaattagtcatgccaaaacttgccaaaatttggcattgacaaaatttggtaaggcctatttaggccacaaaccaaaccaacccgaggctatcgaagtgctactccggcatttccctcttctgactcctcagccctgattatgcagtaagccctcatatcactttcgaactgaagaaatttcacatcaaacatcccacaattgaatttgcccccaaaaaattggctttgtcaaaatttggcaaggaaaacaaacaagagtctacaaatctaccagctcatactgttggaaacaacaatctcatttggaatacaacaacttcgcaaggaacaattcaattccataaaaaagagctggggaaaagtctcaaggtcaagtgtttgcacataaacatcacgctttccatagccataataataagatctctcacaaattcactagttacataactgaatttctgtacgcatgcattgacttgtgcataggagcactgcagacaagcatagcaagcaagttgtttttgtgataaccattagtacatgctgatggaatccaatcgttctactggaatgaccaacaagtctgcagcaaagccccaaaatgacaactcccagaatttcatcagtaaagaccaaccaacaaaacttctccaaaccccaccaaaaagagttcggcaattaccaccatcagcatcctaattcatcagaacacttgcatgtgttaggttaacaaaacctgaaaagtaaatgcgcaacattaaaaacctgaataaccataggaacaaaaatgagtgttttgggaaaatggcaagtttagcaaggttagtttgaacacaaacaaacatagagatgtattttattagagcttagtctggatgaaaagtgaacagaatctatgactactgtaacaagtacaaaacattttttctgcattcctttgggattgaaatggaaaaggagttatcgattattgtcctctggatgatatgcattgattaagaaggaaacaagagcaatactctctctgtcccataaaaaatcaacctagtactcaatacgacacatcctagtactatgaatctggacatacctcagtccagattcattgtactagaatgtatcacatccagtactaggttcattttttgtgggatggagggagtacttgctaagaagtaacaaccatcatttccggcttcatcagtttgtgacagtataaagtattgtaaggcaaaaagccaaaaatacataatgaatatattttatagtaaggctgggaaccataagctcttatgaataataacttaataagataggcccagtattaagtttgcactcaatcatgcttgttcagaaaacaatactgagcctgaatgacatacaagtagaagcaaatcaaaccagaatcaccagtaaatttataatacagttagtagtagctggttacctgataaattaactacttcttgtcactgcctgaacgaaccagaatgtcacccaacgtcttatttttcgcattgtccttgcctgaatgatttttcgttgaatttaatcacaagaacttgagcaacaaccatacattacaattctaagtaacacaatcttactacaatagctaaggaattaaattgacatgtattcgaacaatacaacacaacatacatatgttgatgttaatgagagaaaatagcagtatttggacatagataactcagaatagtatgttggtcagaaaagcaacaaaaacataacagtccctttaccaataagcttgtttgctaataattgattaatgattacattgttaacaactgatgtatgttcgagtagcaggtcaaataaacaggtcttaaggcacaattaaatggaaacaacatccctaatgctaacctttaaacactgtattgcacaaaaaggagacaaaaaaaaaagcagattacacagtgtacatttgagattcaacacgcagtataaatccagtgatgttctacacaagaacactaaattgcaaatgagctacattttgtactagcaaattcccagagaggctgctattagcttgtggctcactagtgtggtttagctgagagttactgaccaattcctttcaatgcccagatgcattccatgaacatcattacacacaagtgacttaaatttaaccaaccaaacaagtgactgaacttataaaacaagacaagtgaaatagtgctaataaagtgataattgcatcttgaaaagagacatgctaattaagcgatgaaatgataacctgaaggtgggatctggcatgacccaagccacgaagggagaacgcaaggcatgagctcggagggatcttccactagactactcccaatcaccacccctctctccatgtcgacgccgatgacgtgatcgccgaccgtgggataggcgacatgggcgttcagcgggtcgaggaaaccaacgcacggcttggtgccccggaatggcagccacgggtagcctccgtcgccccagatctggctgagctccacgcgatgctccagcgtccacttccagccgctgccctcgacggtgtcaccgtcgagcgcgaaggagctgagcacgaacggctcgtcccaggacagctcggtgtaacgcagccgcccctcactgacccccattctccggtagtcgcccagcctcagcttgtgtcgccactcggggtttgtcgcctcgggattgagcagcacgctgccgatcggcagctcgaggaagcggaagtctgggtcatggctgaacgggtcgacgtggacggcgccccaggtcatgtcgagccaccacagccggccgccggcggcgaccaccgggtggtcgactataaccttgcgcggcctcgtgagcccgcacccgaacaggtagtccggcagcgcgtcccatctccccgtctccgagaggaagcgatgaatggggaggtccttgccgatgaactcgaccacggcgaatcgatcaggcggcccgcccccgctgtccgattgggtgaggaagccggcgtacgcctgccgagccagaccgccgtcggggagacggagaacctcgccgctgagagggttgcacacgacgcgggcgacgaccttgtcgaagtcgtacctgatgccggactgcacaaaccaagaaggatcgccgcggttgtcgaacatgttcgtcgcggcttggccggtcagcttggctacctcgtcgacgacgcggagcaggaggaggccgtcgctgttcgcggtgtacctcgggccgtaccgccggatctctccctccaggccggctgcaggcccgctggggcggcgccagagggcgccgtaggggacgacgagctcggaggcgagcgggggctcggcgaggcggaacgtcgcgcgcgtctccagcggcacgttcggcttggggagcggcgtcacggtgttcaccatcgcccactgagggcgcgaggggcccgtggagagggagcggcggaggcggccggagacctcaccggagaggccaaggaggcggcgccggagctgcatcgcggcggcgcggcgcggcgcggcgtctcgtctcgccttgtcgaggggatgagaaaattgagaaaacgggaggaggcttttgcaattactactcctcagagaggcgcagaggcgcagagcctggtgcatgtggactcggcgcacgcggcgaggatacgtttggttgcgtggagaaatggccgtggggttggtcttcctgggagcggtgagagggagctctactcgggcccatttgtcagtcacaatggtctatgggtgttggttcacggagaggcttttcgccgttgctccatttggaacggccgtacgatacgagtacagtctactacggcctgtcggcgaaatgaaaaattttgggtcatatcacgtttgaccggatgtcggaagtggttttcgaacatgaatgaaaaaaataatttcataactcgcatgaaaaccgcgagacgaatcttttaaacctaattaatccgtcatcagcaaatgtgagttactatagcacttatggttaatcatggactaattaagctcaaaagattcgtctcgcaatttatatgcaaactgtgcaattagtttgtctttttatctatatttgatgctctatacatgtgtccaaagattcgatgtgatgtttttggaaaaaaaatttggggactaaacaggcccaaagtttgcttgcttttttggtgcgaaaagcgaagggatttttttttgaacgtttgaattgcctcgattggctgtggcgactgtggcaggtctgcacatgacccgatccacgtcacctgtttcccgccaaaaatattttaggtcttagtagctgattgggcctgcgggtcatatcatatcatagcccacaagtggccacggcccatgggctcacggctcagctggaggcatctactacatcgaaggcatcgacaagacgacaagcgaccggagataatagataatctctcttttgaacggaagaattttacccaaaaaattaacagagaaaattaaatcttgaaagattcatcataaggccagggatttctagagaagtactgaatagctcaagcaagttatggacttgggtccttgtgagtcttcaaaggaacaacctgtacagagaagcaatctccaattcctacttcatattgtacggggtagaacataacatgcacataaggatatgaatttgctgaactgatctttgaaagtctatcctacgccattggtacctcatctgttttataatacaatactttctaacattgcccatatttatatagatattaataaatctatatatatatatatattcattaacatttatattgatgtaggcaatgttagaaagtcttataatatgaaacggagggagtagtttggaatgtaatgttggggggttctattttttaccgtcagatagctagcaagcaaagcaccagtgtcagaattcaaaagaccccgaaaaaacatattccattgatgaatgatgaacacataacatcgaagaaaacttagatataaggagcatatgcatgatgcaaaaatgtaatcgttgtatgtgttgttctagactgcggttcaaagctcaactggcgatggaatcaagtcatttcactgaaataataataaacatggctcgtgcatagctaagagaagttgcaaaatgtttcccagaatttgtcaaaatgaggggccacaaagttcatcaggaaagccccaaaacccaaacttttcacagcattcccacaaggtgtgtcagaaaccatcaccattcgcctcctaattctccagaaaaacctcgtctgtcaattttgagaaaccctgcaaatcaaataataaacatgagactcccttgtctctactatctttgtaataattctgacaaagaagtaaacactaggggcatatgaacacacatgaagaagagctacatttatctgtttttaattcagtgaaaataaacaagtaaatagaaacgccactacataatgagatgccgtctagctttatagtttaaacactgaaataatgagctgcgtctcaacagcattgcgacataatttaatttgagggtttttagggtccatgggagtatgttctagtgttaatcatgactcatgggtttgtatactgaacctctccatagtcaatactcccaaggagtcaagggcactccaagaactcattcaatttatataacacagaattctaacatgatcaatagttaaggagcaacaacaacaacaacagcattcagtctaggcaagatcagttggtaataatatgtgccatatacttacagccccatgttttccaataagtcataatgaactagagggcagcaatagtccctattggcagtcagcacacttacagttgagcattatacatttatacttgtgtctgccaagtctcttattgcaaattaattcaaaatacacaactattctacatcttccgcaaaagaaaaatgacattgcaaatacatgtaaataaacaaaccatcctgaacttggaaagcaatcagataccgccactaattgataaaacagtgaaagttagttaacagaaagtaccatgagatcaaaagctgataaaattcacttcttcagttctatgtctacatgaaccgacatgtctgagtatgacggagtattgcttttcatcttggccttcttgctccaatggatccctttattcacaaagataagaaactaaacaatcagtatatgcttctctacaatgtatccaagatataaaacagcaaacgaaataagacactgaacaggggcatcacatagatatacgtttacacccaatttttagataatggaaatggattacatctccggcgtttacactaaattagatgaatggaatgcataataataaacatactatattcaaattagccgagagagagagagagagagagagagagagagagagagagagagagagagagagagagagagagaaatcagcatcctttggctttacatctactcctaaatgcttcctgtttcaaccttggctacaaaagtatccaagttccactctttctccccaaattcaccatttcgccacaactattcccgatttgccccaaaattctagtacaattggtaaaataaggattttaaagacatgttaaaacgaaatatactaactccaactaacatttacatagtgcacttcagcaattggataactcaaacaagcatcatagaagaagcgtgactacaaataaaagtatgaatcttgtttcaaaagtaaacaaataccttcaggaatctggcttgattcaagccacggtgggagtacacaaggcaggaggggaaagtcagcacaacccaaacgagaactgtcaatcgccctctccttaatcatgtctatgctgagcatctgatcaccaactatgaggtgcacgatgttggcgttcagtggatcaatggccccaatccttggcatgccacccaagggaaccgacgcgtggtgctcatccttccagatcgggccgaaggccacctcgtgctccagcgtccaggagtcgccgccctcgtcgtcgtcggcgagcgagaacgacctgatcaagaactgcttccccaaagacacctcgacatagcggagcttgccctcgctgacccccatgcgcctgtacttgccaagctcccttagcatcaccacgtcgtcaaggtcaggcagcacgctctccttgggcagctcgacgaaccggagctccggccggtcgctgaaggggtcgatggtgacggcgccccagctcgcatcgacccaccatagccggtcgccgaaggccaccacctcctggtcgatgtcgaccgtcctcctggctggcaatggggacggcatgcccaccagcttgtcccactccccggaatccgagagaaatcgccgcacgagccacccctggccgtcttcctcgcggttgccgtcgagctccgccaccgcgtaccgagcaggcggcccctgaccggcatcggactgggtgaggagcccgaagtggaggtacctcgaggtcttcttcgtgccgttgaggtcggggaggcggtacatctcgccgctgagcgggttgcagatgaaccgcgtcacctccgggtcgcggtcgacgccgtcgagggcccactcgcgcatcggctcgccgccgcggctgccgacggtggggaggtggttgcgggagtcgtagaagcggacggggacgaggccgtcgccgctcgtggcgcggacgtccgtggagaccgtgccgaacatctcggactcggcgtcgtggcggaggcgggggtcgacgaagctggcggcgaaggtgaggtaggagacgcacggcgggtagtcggcgtggagcgacgcgcccggctgcgacgacgccccggaccggtccatcttcgacagctggagcagcgcccacgggggccgcgccggcgacgcggcgcgcgtggagaggtagcgggcgaggccgccggagacggcgccggtgaggcggcggaggcggagcatcgcgcgcggaggcgtggaggtggaggtcgcggtgatttggtgtagtagtagtagtagtagtagcctgtagtgtactactggtagcagagaaggggagaagagggttttgtgtttgtgggagaaaccgagagaaggggatgcggaatgaacatgaactcgctctacggaccaaggaaaagcagcgtggtcaaaagaagaagggaagactcttcagactttactatcaagctgtactcggatatttttttttctttaattacaagctgcatttaattactttggatattttaactacaaagctgcatttaatggtatttcagtaggaattaatttttagaaatccaaataatttagaaattttctcaaactgaacgcgcccctaatgctttctcaggtgacaaaatcgaagggcctaataaaacctttatagttaagataactgttgggcctgtagcccatctacagtaatttatctatgagactccgactacaaaccttcccgagttgtagaattttttttttaaaaaggagaaaagcaaagttggagaaaaaaaatttcctttaaaaaaaaaagaaaagccggtctccttcatcttcccgtccgtaaaccctaactgacttatactcatcaatcgtcctcctcgattgctcctcccctgattccgatccactccgaggcctcatggcggcgaccgattctcgtcgccttgcagacctagatgtcgacgagctggaccgcctcctcccgttgatcaaggtcacccccttcgccgcgcaccgcacttctgcccccagaggatgtggttgtccttgtgcggcgccgaggcggatggaggagtctcagggtaaatagtttttttccccatatttctcttgtgttggttttaggactatctgcatgatttatctgatcatgcagcctcgtcggagaggactccaaatcccccccacaatcgctcagtcgcctttggacaattccaagaaagactccgagaaagctttacgcagtaagtacatgattttatcatacaagaaaagaaaagcaagcaaataataaagccaataattgtgggaagttaatttactcacttatgggggtggcatgtattacccgacccatcattaataaaatggttataaggtagagtatatctaccttccagcataaaaaaaaacttatgggggtgccattgtacaaagaatgagatatggggtagaagaattacgattgtttgtctgtttttttttctgtaaacaaatgtagtctgcttcctagattgctttgctggactcgtcatcttgccggcagagcaagaacaacttgtggtgctcaaagccatccttgattccttctccgaggccactgggctaaaaattaattttcacaagagcaccttcctccctatcaatgtcctgcatgatgaggcggttcggctggctgggactctcggttgcccgatagcttccttcccccaaccttatttaggcctccctctctctgttaccaagctatgcctcgcggacttccaaccgctcatcgctaggattgacgaacgtcttgccggttggcgcggtcaccttctgtcttctgatggacggctcactctcatcaattcggtgctctccgccctcccttcctatatgatgggagccatccttctccctaagggtgtgttgccgccattgacaaatgccgaagagctttcttctggacaggggatgaacactgccatggtgacaactgcaaaattgcgtgggacattgtttgttctccgaaggaaaaaaggtggtgctgggataaaaaatcttgaagtccagaacaatgacgaggattctgcgtcgtggattgactgttttcaaactgaacgggtctatagtgctttctcaggtgacaaaatcgaagggcctaatgaaacctttatagttaactgttgggcctgtagcccatctacagtaatttatctcagactacaaacctttccaagttggagatttttttttaaaaaaaggagaaaagcaaaagttgaagaaaaaaaatttccttaaaaaaaaaaagaatagccggtctccttcgtcttcccgaccgtaaacatcgagattctagagagacgaggcgcgggaccagtgaaaccctaaccgagctactcatctctcgtcctcctcgattgctcctccacccgattccgatccactccgaggcctcatggcggcgaccgattctcgtcgcctcgcagacctagatgacgacgagctagaccgcctcctcccgttgatcaaggtcacccacttcgccgcgcaccgcacttccgcccccggaggatgtggctgtccttgtgcggcgacgaggcggatggaagagggtcagggtaagttggtttttcccccttgtttctcttcgtatttgtttttccctccttcccgtgttactgggtaaccccctatctcacacaatatttatctgatcatgcagcctcatcggagaggactccaaatccccccacagtcgctcagtcgtcgttggacaattccaagaaagattcagagaaagctttacggagtaagcacatgattgattttattgtacaagaaaagaagagcaagcaaataatgaagtcttatttggggaagtttattcacttatgaagtcttatttggggaagtttattcacttatgggggtgccattgtacaaagaatgagatatggggtagaagaattagggtagcttctctgaggtagaagaattacggtagtttctctgattttttttaactgtaaaacaatgtagtctgcttcctaaattgctttgctggacccatgtcgcaagttcgcaacttgtgatattatttgagctacgggcattgtgtacagttagattttatttgccaatggtctgagcttacttctactttcagaacgcagtataaagatggcaatgaagattatcaattactctgaagactgtatgagaaagattgtagagttgaatgccactctccctctggatcagcatttcttccctgcctgcatctggccacgggaccttgaggacttgcgtttttccaagattgggttttacgttgactatcgcttgaatgacacttctccaagtaaatgcttctacagtttattattaaaacaagttgcttttcttagcttcttcattattgaaggttccagtatcagtggatttgaaataactctagatttttcatgtactgtctgtcccatgcaccccaagggatctcaaatagtttagcaaacaatcatggagtagtgtcagtgttatatgtttatatcagttctaactcatttgatctaggattataaggatcaacgttttatatatttaagggtgttattataatatctatatgtgattatgtcataaacattggagtctgaagtaaaatgtactcttgcctgacacgagtacaagctgcttctaatatcgatttcaaatcttttacagtcaaccatagcaggactctgcaacttatgtcctttcttagatctgcaatagttcaggggcactgtcgtattatctttgttgttttttgatttcttgttttcccagagtcgtaacgtttcattttgatctattgcttatgccactcacagccacttgggggtgtaagcgctttgcacatgaagacaagtatgttgcatcaactatgctgcggatcaatggactagtgtttactggagatttcccacatggccggtccatgcatgtttatggttttgtggctgtgagggatgataaagagccattgaggaactatatcttcaatgtcagcagggagaaggcttgtcaattgaacctggttagtacatctatactcaaagactttttctacagttgattgtattttgattggtatataatgagcgtccatagctagcgcttatttttttagtgtctataactttggaggatttattgattagtagcatattgcccatgcattgcaacaggattttaattaaagaaaattatcattaacccattattaccatcattttctgcacatattacctcttaattgctgtgtatatttgatactgccatatgacctctttggccctacactatccatttcctttctcgcaaaaagtagagagttggttttgggggggggggggggggttgatatgtggggcctctagcccaactgtctttttttcctccgaaaaaaggaaggtggctgaaccaccaccactattcccttttaaaggagtatagaatctcctaaatgcacaacattcccttccctcccattttccctcttaaatggccatatgccttttcctttcccatccatattgtagagcatgctttgtagaaaacacccacctgaaagtaggaggaataagtggtaggtccggcttaagacttctgtagcagaacaagcacttctacatattagtaaatatgtctaaagaatggcgccatgaatgtgctaggaatatatatgtgtgtgctaggaaaacgaagagaaagcacttctctttgttttttggcccaataaatcttatattcagtccaatactccagttgtacgctaaactctttggattgcactgtgttcagtaatatcatgatttggttcaattttgaagtgaaaagaacacacctgactgggttgtacagagggaactatatatatgactgaaaactttaaaaaacacggttgaatatgctatgagagtcctatatttaacatggaaaatgatgttattgcttcagactatttgcagcatttagcttgccgtagctaaatatagcattcctctaagcctcaatcagtcatttttgtcatttgacttagcatagaatgtagttctttgttcactgatatctatataatcatatcacaaaaactgcactaaattatatgtgtaggatgaatctcattgtaccaatctcatgtagtcaatcctttattttgatatattgatggtaaaagctgggaaaaattgagcatgaagtgctagctacttataatattggaagggagtgtctctagttcaaatgtgcaaattatacttgcatagaatcacatgaggtaggtctagcccattatttcttgttaagatcttggtaacatcttgacattggtagcggcttaccatgtttattttggaattcctaataatctgattcaaaccagtgatatgtgtggagtaacataaccatattttgaccttatccttttctctttggtcaaaatgcaggattcgccttcattggagattagtccccccatgcgtggcatctccgtatgggacagtgctttaatcgagtttcacttgaaggttaagggcagtgacagtgatagtagttcagatgatgacatactcattaacgcctgtatggagttcgactatgagaccattgagcatgacaaaaagttgatatcaagaattgatggcccgttcggtccacttgatatgcgttatatcttcttaaagaatgggattgaggccactatcgatattgatctgggcagcacatctgaagcttatgatattttgcttgtagcattttcaggcgaggattccatgacgctttacaaggaccgtgttggacagcataccaagtttacagccgttgtaattgttcctttagacgagttgttacatatcaaagcatttggcacgtatggttcgtctcattttgatggcaatattgctgtgcctgtattaaagcatggaagctgtaagaaaccgttttggtttcagttggcagagaagaagtcggggcataagaatctgcctagagcttgcctggaggtcacgttttctacgatgggttactataacacgggagagatgtagaacaaatgactgcaagaactgctattttgctctagagcatttcgttttcctgggctgtgaaatgtttaagagttgtgatttgatactgaaatccgtaagttgtattttaactgaaatcgataatgatgttttatcgatcgtcagtttctttcgctgtgatatggatgcttgtatgttttccaaagtttgagtcacccgttgaagtagggactgaccacagacgggcagtcaaatcttgtttgtcatgaattcacaactgagctgatctagcacttgctgccatggattttttatagtatgtaggttgatgatatcttcatagtacgtaggcaaattaattgcgtcgattaatcaatacaagcgtttttatgcaatcagaatacctactgtaattttttttaaaaaatacaaaatccatacagtgcttagaaatacatgttctcataacatgcgattaatactaaactatcatagcatcaccaaaagatatctacaccaactagtgaagagcaagaaggatagaaaagaggattctaattttaggaaggtaattaaagaatagaaaagaggattctggtttttataggaaggtaattagggaaactgttcgaggcaactttcaaaagaaaaagcctaaaattttgggattaggatccattcggtgatgctcttatatattttctttaaaaaaaatatcttcagtgagatttaaaggcatgaaaaatatcttaccctcaaacagatggcctaattaactttctaaaacaagaaaagtaggctacgacaaaaactatcaacagaattaatcctttcccctacacgctcaattccttatcccggtgcagcgcttcccgtgtacagggaagcttcgagtggcggatcgtgagcctcctaatttacaaggacatttacaatagtctctatatctctctattatcatgcaagtaaatttgataacatagatgaaagataaatgaggaaagaaaaatatggttgttatgcatggcaacggctcagagtcgactcttagcatttattagagcaaattttgttgcatggtggtgaaagaaaggaaagaatagtaaaaaaaaaatattttaatacattaatgattagagcttatattgtctctaactattgtaggatctctaaataacgtagagctcatacctgacacctttatacatgccctaagactgaaattaactctccaattcttaggtactctctccgtcttattttaagtgcagtcatggattttcgtgcctaacgtttgaccattcatcttatttgaaaaacttataaaattaaaaataagtcacacataaagtactatttatgttttatcatctaataacaataaaaatatgagtcatattttttaaaattaaaacggacggttaaacattagacattaaaaccataactgcatctaaaatgagacggataggtggttaagggatctgttggagtgatgcttttacctctaaaagtctctgattttgggcttgggaggagtttaggggaagtctccaatatgcttagcatgaaactgtgacaaatcccaataatatataaaccaatgtctctttataagttcataaatcatgggtctattgtctaaaataaggccagtaataatttactagaagaagccggtcaaatttggctggctcaaccttcatctttaattttcgttcaaaaaaaaaaaaccgtcatctttaaccggccggcaataaacacttcccgagtaggactgtagagtagtgctaattaaccatcaccatctcatcaaggaaatctttcaatgcaaccaatagcaaatttctatgtgagccactcatttaataaattaaaggtgcaattatgcgaattgagtatatgatctagtcaggagaaaaatcattagaaaggtaatacgcagttttgaatatcattatttgatattttgttgaagtcgggaagatcaatgatcctcgacacactacttgttcctctgttgctttgagtcatttcctgttactgttaaatggataataggttctattaccaaacagtattgttggaatttgcaaggcagtcatcaaaggaactggttaagctgcaacaaaacaaaggatttattcgccaatggaactgattaatatgcataaaagaaattgttaaccgtcattactgaattgcatatatacactttcaaatgctattttctttttctttttgatattggactttcagtagatattattattactctagagaaaacagttcggaattagacaaaagaaagggaacaatttttttgtcgggtcggccgaagaggtggctgaccaatttcattaagaattggaagaaaattaaagtgcacaagtgtgttacatcgataggaggatgtcgatcaggtccaatgcaagacgcctcagtcccgtgaacagaaaaagcctaaagactggacagaaactgtatactcaattaattacccgggcgaaaaattcatgcctctgtccagatgataatttcctctttgatgtcattcaccaagtgctctatcgtcctgagacattggtcgaaaattctcccgtttctttccttccaaatcagccagcataccagtatgaagaggcagtcaaaggacgctctgtagctcatccggcaacgtgctctgttctgcagccaccagtccgccagagcatatccttcatctcctggaactgcgaagaaaggtaacaattcggaattctttacttttgagtcttaaggtcataatattaccactatggcatagcttcttccttaaacacgaaaccacaatgggtaagtgagtgccatctggtaagtctaatatacctgcatttggttgtcattcttgatgtaaacatagaaaatcaacaattgacatacgtgaaaaaactacaaactattaatagaaactagattgtaagagaatatatgggatttaagttttggaaggaaattagcccactggcattataaagatcaaatgatagaaaataacatctcaactagatgaaagtatgagaccaggtagtagtaacatcctagagagagaaatctatctacacctaactagttacctcaggaaaattcccacataaaacttcagaattagtaaatattaaatataaatttcatttgtatataaataggtttcgaaaaagaaggttactaaacatctgtttacatataatttcaatttaataactagtatagttaggcagatatacttaatatcaatagcccatgcaaatgcgtggtttaacaactagtgcacctttgttaggttctgttatttaccagttcagtttagttgcagtggcatgttgctaaaatgcaatcttactgatacaacttacgtagttacctcagagttgtgggcagaccaataattgagacttcctgagttcaaaactccaatgtttgaggtacaacttctcccttcggcctaaatcaagagaaactcacagattcagtgttactttctgtttgtttatgaagagaaaataagtaatgcacttgactaaccccgtgccaacgccacacattcctttcatacagaaatcttgtgctggacaagtcttccaaaagtgctttagcaaatctgaacaacagaataccagcatgctgtgatgcctacatgggaacagacaaccgtgaaaacaaatatggaatgtgtaacccttcgctaaaaaaagaaactaaatgctgtgataggtgcaccccaaagatcataggtaccaccatttatccatctgtcacgcgaccatcaataatatagtaccatgatcatttgtatacacatcaggggcatttcaaaaaaaaatacaaacaccattttaaatttcaaattgttgagcagcaatgcaacaaagttacactagaacatgatgttgatatctggtcagcacataaagtgataagggaaacatgaagtatgggtcaatttatcaaataaatgtacctaaaactcacaaattcatggttgcatacatgctgcacagatttttttggaacacatcaatggccaattgctggttcatgtgaaaccaatttcccaaaaattccatatatagaattgaggacagtatgaaggaatgcagtgttaatgtatacaccatatatatatttctgttttggttcagttggcccacttagcccatttggcccatgtatatgtatataaccttcactaccatctagggtttactgctgaatatatttttcgtgatttcccccaaatgttgaacatggtatcagagcttgcctgggattcgccggagctgcgtcctggacgtcgcatcagcgatctgctctgctgctaataatctcttctcctccgccggcaagtttcccctgtcctcaatcttctttgctgctgcctaccgaatctgctaggaagcaataggtttcccttgtctctacacccacggctgctgctggttactgctgctacatggttggactgcctcttactacggggaagttaaagcgggtccatttgcagccggtaatggacaaaatcagagcaaggatggggggctaaaaaaacaagctagtttatcaaagcgggcggaaggttcttgtgcaattagttctcagtgccattccaacctacttgctgaccattcttaaaccaccaaaaggattcctaaatgatgttgacaaagcgcgacgaaaatttctttgggccagagaccaagaaagcttgggcggaaaatgtaaagtgaattggcagcaagtatgttctccgactatacatggtggattgggcataccttgtttggagaagttctcacaatcgctgaggctacgttggctctggtatgagtggacaagcccggaaaaaccatggataggaaccccgccgccctgtgatgacaccgatcgtgctttgtttgctgctgccaccaaagtatcggtcggagatggacgaaaggcaaaattttgggaatccaactagataggagatcagccgctgaaatacctagccccaaacctcttcaagcactccaaaaggaaaaacaggtcggttcttgaggcaataaccaatgatgcttggatcgaagacatccgcggaggggtgacaatacagctgcttcaggaatatatatgcgtatgggaagtgctccacaacgcaggagaggtgatccatgaaggggctgaggacacaatcctctggaggtggtcggccagtggcttgtatacggcaaaatcagcatatgtcatgcagttcatgggcaaaacgttttcggattctactgagcttgtatgggaaacttgggcaccggggaaacacaaattcttcgcgtggttgctggcgcaaaatagaatatggacggcagatcatttgcaatgcaggggctggccaaataactatttctgccaactctgtttcagaaatctcgaaacggtacaacacctcttcatggagtgccccttcacgcagcaggtatggcgggacattggtcgcaaattcagaccgcaacgtttcctacatgtgaccacagacaacactctcctcaattggtggcgcgagcaaacagatgaggcagaaaagttgcaacagaaagggctacgttcagcagtcttgaccacgctttgggagatttggatggaaaggaacgatcgcatcttcagagggaaagaatctacaccatcggcacttgctagcaagatcatagatgagcttcgtttgtgggaaatggtaggtgccaagggagtgaagtgtattatgttaagagattaggcttttgtttttttagggagtgcaggcaggaagaattcctccgggaacgtctcccctgccttctgttctgtacagtttctctcacttcttctataatataaaaccagcttgctgggttctttcaaaaaaaaactgctgctacatggtgtttgatttggtctgtagcttggttcatgtgtgttacagaggctgctagtactgaagtattattgtggatttgtcacttctgtccattatgatttcttcagtagggattcttcctttacccccagtgagctctatttctccacctacttggctgaaacaatgccattcctgtttgaactggggtcatattcaaagaaattgcaatcagtatcgttgtcatctccagtcaaataaaccacatattcatgataaggatgctaagtctgaatttgccacattcttgaaccagcttgcacacacccctttgaaaacagatccatcctcatgtattgctgatgttagtatggatattacgggctgttcactttcagcaaatgttacagactcttgttggatattggactcaggggcatcctttcacatgacaccggacatttcacagctccagtcatgctctttgacaaaagcatcaagtgttcagacagctgatggcaccattctaccggtttctcttcaaggcactctccaaactaaagaatacacaattccagatgtcttttatgtgcccaatctatctatgaaacttatatctgttggtcagcttaccgatatgaagtgccatgtggtttttgatgaggctgcttgttatgtactggatcgtgctacaggcaatcttgttggagctggtcatcgactcaatggtcctaggggactttatgtgcttgatcatttgcatcttcccacttctacttcctctggttttcctggaaactctgcttctgccacctctataacttccaattcctctgtttattcctctttgtcagcctcttttcctcagtggcatcatagacttggtcatttatgtggttctcgcttgtctactcttgttcaacagggtgtcctaggaaatgtctctattgagactgatttcgtgtgcaagggttgcaagctcggtaaacaagtacaacttccttatcgttctagcatgtctcggtctacctctccttttgcattagttcattcagatgtatggggtcctgccccatttcattctaaaggaggtcaccgatattatgtcatttttgtcgatgatttctctcgatacacttggatctatttcatgaaacatcgcagtgagctctatcaagtttacaaatcctttgcttccatggttcatacacagttttctacatctataaaaaattttcgttccgactccgggggagagtacttgtctaatgccttccgccagcttttaagtgaccatggaactcttccacaactttcatgtcccggtgctcatgcacaaaatggcgtcgctgaacgaaaacaccgccatatcatagagactgctcgtactcttctaattgcgtctcatgttccaccacatttttgggctgaggctgtatccacctctgtttatctaattaatcttcagccttcatcaatccttcaaggccgcagtgctggtgagtgtctttattcctctcctccaaggtatgaccatcttcgagtctttggttgtacatgctatgttcttcttccacaacatgaacgcaccaaattatctgctcaatcagttgaatgtgtttttctgggttatagtcttgagcataaaggatatcgttgttatgatccttctaatcgtagaatgcgtatttctagggatgtttcttttgtagagaaccgtcctttctattattcgccctcctctacacgctcttcttctcctactgaggatgtgtcttttctgtttcttccaccaattgagttgtctcctgttcaaacccctacagatcctactgttccatccactacttctgttcctcctacatctactactattgttcctcctgttactccctcttccccagtgactagtactcctcctgctacttcatctttgcctcccat

SEQ ID NO: 61741 - DNA, 33649 bp, Oryza sativa
tatgtccaagtggtacatcgcacaaacacatgtatgtcttgtgacaatagaggatccagatattcctgaaatagccaacgtggacacgctgtaccctatgcagtcagcgccagttacccacctgacggtaacatattatccactaaatttttaatgaaacaataatcttaccgcaacctgtaatcattgtaacatttattttcgtagggcgatattgtggaggaactatattctgacacaacctcactgtgggagaagctgcgtgacaatatagctgggtccctcgaggagatgatgtctgctctagaccgaatgcgacagaaatgcaaacgtattatgcgggggcatagtacaggcatgcatcagaagtccaccgtcccacaggacacaggtttgcggaccccctaccggaacaaccgtctacctcttctaggccttccacatcggcaagaccctcagcttccacacgtcctggacgtcggcaaggcctgtggcaccgtctacgataaaccgatcggacaatgcaggtaaagcctattatgatacaaatagttttcgagcatactacttgttaacttgttagcacgcaagtggttaggcctataccaacaataacaggaggatcacagtggcatcaagggttcacatcggtaccgggtagaaactgtttcacaaaatatttttgcatggatgacttgttaacttctcatctagtacaactgtatatagtctagcattcacactactttaatcaacatgttacaagctatgtatatgaaaatatatgaattatattagatgcacgaattgtttttaatcattatacttatggtaacctttctctaaattaaaccaaaagctctacgcattattatgaaaatcgtcctaaaatttagctcatttcatgcacagtttttttaagtacaagtggcctaacttatagaattaattgttccgcctaatgctaatttaatctatggacttaaaagtacaatacacactatttttatggactaattttcagaatatactgaaattaggtggtcgttttaccatttattttctgaactttgcaaacctttctacagccatgcgctgtgtgggacaatggattgcttggaaagccttttatttctatagttctattgcaagttctattccctatgcattttttttctttgctctctcatatatgtgaggcaggagttgaaaagctctagaaaaaccaagcttaattatttgttgtccattagatggtcctatttttttttccgacatggatcaactggtgctatttttaaattcaatgttcacctatagagattattgcaggtagtatagcagtgatcccttctattctgcgtgtaagtacctccagtgaatggcagggagggtttgtgtggttcgcaggatccagccaaatggtccctctgatgtgtacagaagatggaagcttacagttctttccagggcacgtagcgttttccggtagttcaataaacacgcatgttaatgttcatcattttgtaatttagttagtcacaaacatatttgcttaattttgcaggtgtaccttaagttaacatgctcatgtttccaacgggtatgaacgatcagtggtatggagcttccacatacaacactggttcgtacataatgtgtttcatttttgacgatccttatattgcgatattaaattagcgctgcacctgcaggggatctaccaaatgtccataactgaaaatgtacaaccacaaggaccaagctttttggacatgttaggccaaggagattggttgttcagtcaatcacctatcatgcaaccacaaacaacatgtacaaattacaatatactttaaaatattttagctccagtatgttagtgggctacaactttggattccatgttttgtaggaatgtacactgccgaccaaatgataggatatgccgacagcacacagtcctacagagaaccatgtagctacggtgggggtcgtcaacagcactacacgagataggaccgtcgcatattgatgaaccacctccaataactcagctgacccaagactacgggcatgttgatttcagcggtgttaaggtggcacataggtctgtccgcgagtgacattcacctgaaagattatctttgtcaagacgcagacctccagctagtgctagaagaaagggaaagaaaaaggacactagcacatcacgaaattttgatgatgaggctaatgagtggaacgattttatattttgctctttcgaactaatatgtaatgttgtgtgttcaaactttctaatgtgtcagctacatttctaaagaaataaattcgaaatatttacccgctttcccttcacgaacacttacagatatttacctttacacaacacttcagtgggtttgagcgctttgcaaattcacagcattatcttttggtaagcccccaatatgcgccataaatcatcgcgtactcagttcataccacaagatagggcctgtgaattcgcaaagcgcactaacttattgaagcttacaccaatgatagactctacgaatatgaattatatgctatacttgagtctgtttctttcatttcgtaactttcattttataggcactcaacgagtaggctctgtaaccagacgacaacaaacttttggcggacatcccctgaaaaatgctaggactagagaagagaatcactctctcctttatttctggctgagaatgccaaatggagcaagaggacaaaagaactttcggtggacaaaacaactttcgatgcggtcccgcagaatggaggtgcggagtagtagtgcgatcccgcgcgctaggaatgtggcatcgatgccccacgggaccggctcggtgctaccgtttggggctgcgttctgtgtgaccggtcgggccggtggccggtcccgcgtgcaacaccaactcgcacagccgtgacgcgggaccggctcggttccgcacccccggtctgcgcgaccgtgccggtcctgcactcccaggctacggtaccgcgttcccgcgccgtgccctgtgttactatcttactcccgcatttccagcgcgtggaggaggtatatgtttgctaaactttaccacccaggtatataaatgcaaattattaaaaaaagtatatttttaaatttaattcaagttaggatcagctgtaccacagctctcatctagccgtattagttttgtcctttttcgtatgaacagcacctagtttttagcaacaatactttgttttcctttttatttaaagtctagatttgtcggctacctatttcaacatttcactagttcttgtagttttgattaaagtttcagcttgcagttttctaggttaggcactttagattcctgaactagtaaagtattagtagaagcatgtagcagcatatgtcactaagtaccttttaaactaaccgaaatcaacaatgccagttttgtcagtgtaagtattaatccataaaggaagctacgttgtaattggtaattgatgatgggaagcatgacttaaaaggtggggacagtcctcacctatatcgactagtttttttggattgtgtaggcccagcaccactaaagttgtggctagttgggcctgtggtagaacaggcccaatatgatctgggtggcctacggttgatgggtcgggctgcgcattctaacagcttatatagagggcaaaatgtccattgatagccttaacagcacccatgcatggtgattcaattggaatgtctgtggatagtaaaaactgaacaaaacaatccccattaccctcatatgctaacctgatggagaaatttgtcagttagtaacagttaatcaaggttatgttagttttgtcaaccgagtaactaattcttttctacaagaaagtaccacatctgagctgaccattgctaatgctctgaacaaaagacacagaaggctaaagacgatagtcggaagaggacactgcggactggctttgcgggatcgattggagcagcctatcagaatgagggaagaactaaagaagtaaagaggctgacaagcttagtacagtaggttaatttctgtaatgtttgcagatcttctacaaacaaggtatgcttgttgtgtgtatatagattgatccccattgatgttgcttgctctgaataaaaggatgatgtgattaggagacaaggaggcacaggtgtgacgctatcaggtagttgggctaccattttaacgattgtgtgttgatgggcttgttttgttgacgaacaaatcggcaagcctcagaatttgaataaactcgcacaaaagcgtgacgtgcgcgcgggggaggtgcccgtggcagggcagtcaacagatgacgctacttgtttcatcatgtggagaggaaaccgactaaaatagtataggacccgcgcagattgtgcggctagcatcgttatatttttctcatataatagcatatataatttaacattttaaaatggcaatataattttaaacttttgtctcaaatgaccgtggtggcgtggtggtggagttgtggctgcatgactccacctagcagaattcaaatctggtgcctataaatattatgcatatttaagcttttgaaccaaactttagtgtgattagtaaaaaaatgactcaactaactatgatattttgctaatatagtaatttctctgtctataaagcaaacgtgctaggatatgtaagtcatggtatttctttttgtcttctttcctccatcttcatcctattagtatcatcctcttattatttttagtggcatttttcatcaactagataagacatattgtattagtgatagtttatattgtatcaaatattcctcacagtttcgaggaaatttgttgtcacgttagtacagattcgaggatataatcttatctgttagtatattgttttaatgtagattgggaataaagttatttttttgaaaaaaagtatgaattgccccataaactattctagtcgacccaattacccctgaacctaaaaaccagacgtcactcactctaaactttcaataccggatgaattacccccctcaatctaatccaaagcggttttgtcccacgtgaagtacgcgtggcgatctaatcaatattttctttttaaaaaatggtgagacccacgtgtaatacctcctctacccctctttttctctctcctcgcgccggcgcgcacagcggcgcacggcagcgcgcgaaagcgggcggtcgacgcacaagacacggaggcggtgggcccctcggctgccaccgccgctgccgaggcagaggtggagaaggccaggacagagtgggtggccaggagtgcgcggtggtggagggagtcggaggaggtggagatggaggaggaggggatgggggcgggagggagagaggaggagcggagggcggcgcgcggggaggtgtaggggatggggccgcgcgccgctcgacttgcgcccatgccgatgacgcggcgctcaccccatatccctcgcctccttttcctccacgagctcgaatccgagagtttcgattcggcagcgacgacgttggagtgggtggtgcttgaggcgatcatggtgctgcttctgacgctgccagtgctggacaggctcccggtgcgggatgatctccgtggtgcggagcgcgctgaagacgatgatgttgatggtgctcttctgcctcttcctgctgatggacatctactggaagtacgaggtgcggcccacctacaatgacgagcaccactgcaccccgtccgagcacctccgccaccagaaatccatcatgaagccgcagcgcagcgcgctcctcatcgccactgcgctggtcctctactggatccttcttccctgtcaccttcctcgtcgtcaggcttgaccagctctagcagcgtgtcaacaagctcaagaagcaggatgactaactctagctgatcctgctaccccctgattcagcgtgtcgattggcccgaccgtgacccgcccaccgccgacttgcacccgcgccagacgacgcaaggagagagaaagaggggggaattggggaagaggaggtatgttatgtgggtcacatcattttttaaaaaaaagaaaatgctgactggattgccacgcgtacgccacgtaggataaaaccactctaaattgcataggggggtaattcgtccggtgttgaaaatttagggtgagctatgtctggtttcaagttcagggaggtaataattaggtcgaccgtaattgttcagggggtaattcgtacttttttcttatattttatttgatcacctcgtaggactaatgtggggcttgaaaaagcgccccccccccccgcgcgtggccaggccggcccgcacgggcgccgcctccacgaccaccccggcgccggccccaccttttcattgctgccgccacacagagccagccgacgctcagccgagcacggacgcgagctgcgccttgaaggaagaggaaggcggggtggccatgggcgccggcgaggagctcaaggaaggaggagggaaggtcggcgatgaggccggcgtcatcttcttcatcttctgccagccgtcgatttcatttagggagagaagagaaggggaaggaggccggcaacagcccctctctgtcggcaaccattgccgagacagaaagaagataaaagagttggcactatcatctaggacccgccgccgccatgtcgcccgccacctcctcctctcccgcctctccccggcgcctcctcccttgccaccggccggctttgcctagagaacgtgacaagagtgagagagaggaggaagggagagagaaggatgatgtggcatccatacatgtgggtcccacgtgggtcccacgctgactcagccgccacgtaggacaaaaccggggtcaaaaccacagaatgacctattgtgattggttttgattagttaagagacgccggatatctggttttgcggttgggggacgattttgtaactcgatgacaagttgagggaccttcggtctactttttccaagaagagtttgccaagtcctaaagaccaccttttatgattttatctaaggaaaaagtatacttggactccctcaactatcgcccgagtatgattcatgtcctccaaccacaaaaccggtgcaaacaatgtccctaagtggttttggaggtggttttagctgacgtggcgcctacgtggcagtcttgaccgagtatttgtcctacgtggtgcttatgtggcattagaataaaaacaaaaataaaaaatatgtgcgacacatgtcattcacaaaaaagagtattgtgggactcacatgtcatcctccctctccttcccttcttcctccccctctctctcccttatctccctccctctctctctctctcctctctctctctcgggagcagcagcggtggtggtggggacgaggtggaggggaccggtggcaacggtgcgcggcggtcgggagtggcggcagtggaggtgaggacgaggccgaggggagcggcagcagcggcggtcgggagcggtcgaagcacgagctcctcccagaagcacaccgtcctcctcctcctccgcctccgccgcatcgtccccgcaaaaccacctcttctgccttctcctcctcctcctgaccgccgcagccgtcgctcccctccgcctcgtccccaccatcaccgccgcagctaccgagagagagataagggagagcgagagggaggatgacatgtgggtcccacaatacttttttgtgtgaatgacatacgggtcccacatttttttttaacttaggtgattccctgcgctttgctgcggaaattactaagtaacttttatattttgtaataatctagctaaaaataaaaattctattagttattaaaaacaaataaaactgatttgtgaaactatgttaatagagaaataaatttagtagactctgtatgaaatataatattccgcactttgattatatggatgaatatttgttaagtattataaaaataatggatatatatatgttaaaaatattgtgaaaaataatgtgaaggaagatgattggatattgatttgtagaattcaatgaattatagatgatgttgcatgcttgcatgttacactatgataagttttgtatgtattattgctagtggatgatgaggtggcatgttgagctttagaattagtaggttataactctatagtaaagataagatttttgtttttattttaataccacgtaagcgccacgtaggacaaagaatcggtcaagaccgccatgtcagccgaaaccacctccaaaaccatctaggaatattgtttgcacatattttaataattgaaggagttgatatatctaattttatggctggagaacatgaatgctactcggacgacagttgagggagttttatctgacgggccctcgtagtccgagcccacacgaccatctaagtgaacagggcccagagagagagagagagagagcccaaagtcaagtgaagtccagcccacggcggtgctcgcgcccgcggcttcccgacgccacccaccgctgccgctgttagtaataagtctagctgctcagagtagttagtttccctctgtttttacgttgagtcttgcacatgatctgttcatcctgtttgtgtgcatagtgggcttgacgcacgctgcgttcgtgcggagtccgtggtgtcgtgcatggtgtgctccagttcgtgggatggcgcgaagtggcaaggagtgtggcacgcacaattaggaggccactatggccacgtttaactttcttgtaatttgctatttaaggttaagctctaatccagaaaagctgccagttaatgcagcgccaaaatactctgtgttgctctgtttctgttttgccagacaagctacagtttttcgttttgccgctaacaattggtatcagagccttcggtgatcgccggggttcctgatgtcgctaccaacgccacgcgtctcccactcaccaccgcgtcgtcgctggcgctcgccgtctccgcgccgtggccgtcatggcagccgcggccaagtcgtggtggaacgcgtcgtccgcgaggcgaccacgagcagcgtcgtctacccgacactcacccacacaaattaccaagactgggcgctggtaatgtgggtgaacatgcaggcccaaggtctgtggggcgcggtggagccggagggcgatgatctcgtcgactatcggcaggaccggcaggcgctcgccgcgatacttcgcgccgtgcccgccgagatgctcgccacgctcgctgtcaaggagacggcgcaggaggcgtgggaagcgatcaagactcgccgtatcggtgtgcagcgcgtgcgtgaggtgaatgcacagcagctgcgccgagaattcggtgatatcctcttcaaggacggtgaaaccgtcgacgacttctcgatgcggatcggcggcctcgccaacaaccttcgcaccttaggtgataatatcactgaagctgaggtcgttcagaaattgttgcaggttgtcccagaacatctccagcaaatagccatctcgattgagaccttgctcgacgtcaatgaggtgtctctcgaggaggttactgggcgtctgcgctccgtcgagcaacgcaagcagcgcaagactgcggcggcatcgagtcaggtcgacgccaatggccgtctcctcttcaccgaggaagaatggctggcgaaattccgcaaggcggcctctctgcaagacgccgctcactcctccggcggcaacggcgaccaccggggtcgagggcgtgggaagaaggacggtggagccccgaaggaggcccagcccaagccagccaacccgggaggccgtaacccgggaaattgcaagaattgcggcaagaggggacattgggccaaagactgtcgcagcaagcccaaggcccagcaagcttacgtagcccaggaggaggacgaagagcctgctctgctcctagccaaggtgcagctggatccgccgcgtcctcgcgtcgctgcaccgacaaacgtcgtctcgccaccgagcgcgccgagggcgccttcgccgatgggcgaactcgccgtagtcgaggcaagggtcttcgcgcagctagacgacggtggcgaacatgatccggcaatgtggatcctggatactggcgcaaccaaccatatgaccgggtcccgctccgctttcgccgagctcgacacggtggtcaccggcactgtcaggtttggcgacggctcggtggttcgcatcgagggccgcggcaccgtcctgttctcctgcaggttcggggaacaccgcggcatcgccggggtctactacatcccgcggctcatggcgaacatcgtcagccttggacagctggatcgttccggcagcaaggtactgattcatcacggcgtcctgcgcgtgtgggatcctcgagggcacctactcgtccgtgtccgacgctccgacgactgcctctacaccatcaatctgtacatcgaccgtccggtctgcctcgcggcaaggagcgccgagccggcgtggcggtggcacgccaggtacggccacctcaactttcctgctctccgcaagctcgcgcaacaggaaatggttcgtgggctgccgctgctgcaacaagtcactcaagtctgcgatggctgtttgctcgggaagcagcggcgagcggcgttcccgacgtagtccaagtaccgcgctgacgaacacctggagctcgtccacggcgatctctgtgggccgatcgaacctgcaacgccggctggtaattggtattttttgttgcttgtcgatgacatgagccgctatatgtggctaaccttgatcaggagcaaggatgaggccgcgaacgccatcaagcactttcaggcccgtgcagaggtggagtccgggcgcaaactccgtgcactgcgcacggatcgtggcggcgaattcacctcaatcgaatttggggaatactgcgccaatctcggagttggtcggcagttgacggcgccctactccccgcagcagaacggagtagtggagcatcgaaaccaaaccatcgtcgccactgcccgcagcatgttgaaggcgaagggtgttcctgggcggttctggggagaggccatgtccacagcggtctttctcttgaatcgttcgccgacgaaaagcttggacaaccaaacgccctatgaagcatggtatggccaacggcccgctatgcatttccggcgcactttcgggtgcagggggcacgtcaagatcaccaagcccgggctgaagaaactcgatgaccggagtgcgccaatggtgctcctcggctacgtgcaaggctcgaaggcctaccggctctatgatccagtcagcgagcgcgtccatgtgtcagggacgtggtgtttgatgaagacgccgcctgggactggggaccagtgacgcccgatggtgctccccagctcgagccgttcaccgtcgaataggtggtgacgaccaccatcgggacggcacctgcttcgttgccgactccgccctcgccaccatcgccggctccgtcggcccccacgacgccggcacctccgtcgcctccgttgccggaggcggttgagtttgtcatgccgcctacccaggattccatcctggacgccgacgcagatgacgacgtcgtgcctcgctaccgcctggtggataacctgctggggaatgcctcaccgcctggacacgctccgcgggtgctggaatagctcgagctccatgttgtgagcgccgacgaacctgcttcactggctgaggcggatccaaactggcgtggcgccatgcaagacgagcttaacgcgatcgtcgacaacgacacttggtcgctcactgacctaccccatggccaccgtgcaattgggctaaaatgggtctacaagctgaaacgtgacgaacagggggcgatcgtgcgctacaaggcgcgcctcgtcgctaaggggtacgtccaatgacagggggtggacttcgacgaggtcttcgcacctgtcgcccggctggaatcggtgcgcctccttctcgccgtcgccgcgcaccaagggtggcaagtccaccacatggacgtcaagtcggcattcctcaacggcgagctgctcgaggaagtttatgtctcgcagccgctgggtttcgtcgacgacaaccacaagaacaaggtgtatcgcctgcacaaagctctttacggcttgcgccaggcgcctcgcgcgtggaatgccaaacttgatagctccttgctgtcactcggctttcaccgcagcagctccgagcatggtgtgtacacacgcaccaggggaggaagacgactgacggtgggcgtctacgtcgatgacctcatcatcaccggcgatcacgacgacgagatccgcagcttcaagggagagatgatgaagctcttcaagatgagtgatttggggcactcagatactacctcggcatcgaggttacccaggacagtgatgggatcacgctggggcaagccgcatatgccggcaagattcttgagaaggcaggactcaaggactgcaatccctgtcagactcccatggaggtacgtttgaaattgagaaagggttcagattttccacttgtggatgctacattgtatcgcagcttggttgggagtctgcgctatctcgtcaacacgcgacccgacctggcattctctgttgggtatgtcagtcgcttcatggagtcacccagggaagatcatctcgcagccgttcggcgcatactgcgctatgtggcaggcactcgctgctggggaattcgatttggcccaggtgcacggtgcgctttgccaatgttggttggttactctgacagtgatctggctggcgatccagatgagcgaaagagcacgtccggccagattttcttcgtcaatggcgggcctatcacttggcagtcctccaagcagaaggtggtggcattgtcctcctgtgaggccgagtacatcgccgcagccgccgcaacatgtcaaggagtatggctcgcgcggctgttagcggaggtgctgggcgacgagatcgccgcaccgctgctgaaggtggacaaccagtccacaatatcattgataaaaaatccagtgcatcatgaccggagtaagcatatcgatgtcaaatatcattatatccgggagtgtgcagaaaagaaactgatcgaaatgatgttcgtgggaactgcggagcagctcggtgatatattcaccaaatctctgggcagaaccaggtttcaggagcttcgtttaaagatcggtgtctgttctcttgacaagagcggtcagacttaagggggtgatttgttagtaataagtctagctgctcagagtagttagtttccctccgtttttacgttgagtcttgtacatgatctgttcatcctgtttgtgttcatagtgggcttgacgcacgctgcgttcgtgcggagtccgtggtgtcgtgcgtggtgtgctccagttcgtgggatggcgcgaagtggcaaggagtgtggcacgcacaattaggaggccactatggccacgtttaactttcttgtaacttgctatttaatgttaagctctaatccagaaaagctgcctttctgttttgctagacaagctacatttcgttttgccgctaacagccgcccactccaccactagtccactgcctcgactgtaccgccgcccccacgtggccggcgccggcgccaccgaccgaccgcccgtgacgccacgccatccaatccgcccgaatccgccccgcaagattccgccgccgaattcccccgccataaatagccgcaagtgtgactgtgtgtgagcactgcagcagcagcagccgccatcacagtctcagctcactcgctcttctccagaggaggcggcggtctctcctccccccctcgccgtctgccggagatgaagtgggccgccgccgccgccgccactgcctcggccgcggccaccgccgtcgcgtccgccgccaccgccgccgccaccgagcgctgcgtcaccccatgctccaatcccacggcacgctccatcccgagacctttgttccttgtggctgggtgtggattgctcacgctcgcgcgtgtttgtttgttacttctgcaggggtcgccggcgtcgagggggaatgggcggaggagcgcggcggaggaccggttcgcgccgcggttcgacgggctgcgcttcatcgagaccctcgtcaccgctcaccgttgaaccgccatggcagagcaggattcatggcttagttaggtagctagattagcattcgcgaagagcagaatggatttcagttagcctcaggatgggtgaaagatgaacgaattagttactactaccatcattaattgactgtgctgttcttcctgcttaatctgagtttgaattttgtgcaaattttggcaaacgttttttttcttgggcaggtatattgatttggctcgcgtcgcatttcgagtattcgatgcctagtagaagtactgctgcctactccctccggtcaaaaaaaaaaaaaaaaaaaaaaaagacaaacctccggtcaaaaaaaagacaaacctggttttcgtgtccaacgtttgaccatttattttatttaaaaaaattataaaaaaaaataaaaagacaagtcacgcataaaatattaatcatgttttatcatctaacaaaatgaaaatatgaattataaaaaaatttcatataagacggacagtcaaaattggacacggaaacccagggttttgcctttttttttacggagagatacggaaactcagggtttgtttttttcggagtaattacttaaagttgactttccgctaaatgtcaggcttcaagtacacatgacatggtcgcctcgcctgctagtaaagtgaatactactcccgtccgttcattataaaactaaaaagatgctcactttattaaattaactatttcttattttatcagcttctaatacatttattatttttattttcactaactttaatttactagtatttggaataaacagaagaagaaaaaattaaacaacttagtactatttggcaagagagcgagtaatactaatggtaacagtgtgaaaaataaagtaacccaaggtgaaaatggatgtggggcatctcgcgccgaccacgcaaagagagccaaatcttcacaagtgagtgtgaacgcagacagattctctgccccgtgatccactgtattcctatgcctctttctctgtccacgtttgcgctgttcccaccactggaactctgcaaattgccttgcctactttccccgcggttcttctccacacgaatttggaattcagggcgagtttggcacagctccagctccatccctcctagaactggagctcagctaaacagttttagctctatcaaaactgggaatgaagctgggtaaaactctctcacaaaatgaactagagttgtggagctgggtttaggcagctccacaactccactctatacccaactcctggagttaaatttaggagttggagctgtaccaaaacagcctctcagtttgtttttgggtggttcttcgaatttaggattgaaaaaaccatagaaactaaaagaacaacatataattttaacagaaatacgactataaaatagagaaatagaaaacataaaaaattacagaaataatatttgagtatatcacataaaaaatgaaggaatcaaataaaagggatagactttaaagaaaatttttcaaaaggtaccagctcttactgatttttctctaaaatttttatatgattgtctactgtaaaggaatttgaaaagaaaaggataatagttgtttgctcaagtcaaagcgagcacacctattttcctcgcccgtaatagttgttttcgacaagtctttcatcgacaattagaaattaacagcagtacagtgatgattatttaatagtgtcatgttacttaatctaatttattttcctaccaaataaagttgacattaacttagtattgattagttggttatctagtatacatgcctatactaatattttttccatgaatttagagaaaccgttaggttcagtttttatgtttaatggttttccccggatatttttctagttatacatgaataacatctggttgaatcttatccctaatctctggatatcctaaattggatatagaaccggcggatgcatatgcatgtctaatcagttcgaccatacataagctagcgatgacaatgtacacagtatccaattatccatcacaacgcatcacaaaggtgcaaggcgatcgatcgaggtgcaccatatattttggataattcatcccaacacgcacttttgaatggacatatagcatctctcatgcagcctcatcttgtttttcctctcctttaattaatctagtactccatcttttgcacataaaaaatgtgtacaggaatgcattttggagggaggtatattctcgacgcacacgcactgcccctatctccgaaaagcacgtccaaccaaaccagaaagccgacgagggagggacagcatgacggaacaacagcgacggccccggttgatcgatgcatgatccttacatatttatattcaacaacttttaggctctgtttatttcgctagacgaaaagttttggcgtgtcacatcggatatacagacacacatttaaagtattaaacatagaaaaaactaattacacatattgcgtgtaaattacgagacgaatttattaagcctaattaatctgtcattagcaaatgtttactgtagcaccacattatcaaatcatagaacgcttaggcttaaaagattcgtctcgcaatttacatataatctgtgtaattagttttgtttggtgaaaagattttgtttgtaaactaaatagggccttaatttcatttctttatgattattaggtcgttcatttatctagccatgatgcatgtgtggtccactcatcaagcttgaaaaaaaatatataacaaaagcgaaagaagctaaaactgaaactgtatataaaaataactcccatggaactggcaatttggatgaggccggttgtcacaatccgtggcgacgcaagcgcttgcgtgaggcgccgggtgaatggatcaatcgaatggaacggcactaacattaacataacggggaagtatgcgtatgatgcaaatatggagcatatctactatcggttgggcgccttcctcggctggggactgctttctccccacgcgatgctcccagccatgcgtacattccacggcgacgacgacgttacttcccctcgctttccccgtcttcttttttctccgaagatgatgttcagctagcgggtctcactgaactgtggcccatgaaacatgctaaattgccaattgccgacatcctcccttggtctttgaggttaggcgggtctgctgtgctatagacatattaattacgctccccttctcgaaatataaggaattttagatgaatgggacattatctgtctagattcgtattattaggaaatgtaatcaccgacggatctgatggatggtctggtggtccccggaccacctaaaaaattgccgacccaaggcccatgtaggtaggtacggcaaaaaaaaaatcccataaaatatattgccgtatcatgtgggttgctaactggcgcgcgcacgtcagcaacggaggtctcgcgcgccctagctggtaccttctgtttcttttttttttcccttttgtgattttcacttttttggtgtttttttttattttttttaatcttcagcacatgtatttttagatctttgggttgaaagtttttagatttgaagttgaaagttttcagatctggtttcgaaagttttcaaatctcgagctgaaaattttcaaatccgagttgaaagttttcaaaatttgtgttacaaatttaaatttcgagtttgtcgagggaagacccccgatcgcggggagtcgcgtgacccccctttcgtgagttcggccgaggtcagagactcatctctccgaagtcgcgtgttcgtccctccgattcccggttagaaagcacacaagtcgattacccaggttcaggccgctctggagtgtaacaccctactcctgcgtttgggattatcaatgaacttttttacaaggttccccttgcctccttctcttcctctctctctagcccccctcttttggtgggcaaggtcctccttttatagcttaaggggataccacatgcgccgtttctacccttcccctccatcggagggaggggagggggcccttctccctactgccaccgggtttcaacccgtgccttttgctggaagctaagcatcggtcggtccttgagtggggcccagcgccgtctcccgcctgacacggggggcagccctgtcattccctcataaatgaatgaggacttgcggtagccctgcatcgaccgacgcccggatgtgacggggcgtacctaccgccactccgcggagacagaggcgacgtgggggcacgaccacccgttcaatcgaccatgaccggcaatagactggtcacagaccggtcgcatccgactgacaggagtcggtcgggcacgccgcacgtctgccctcgccgcattgaatgcagcaagggacggttggggcgctgcacatttatggccgcctagcctggactcccctctcacacttccccccgagagagggcctcgggctaaaacgacgagagagcccgagggggtgacgtcacccccgaggggatgtcgtcgacccccgaggctctccccatcgccttagtgactcacgaggtatacaggtgggaccagctcgcagagccacgtggctggaaagggaagcagctctcctttactccgcatactcctttactccgcatacccccgggcccatatctccgacagagttgaaaatttttaaagtttgagttgaaagtttttaaaatttgactttaaagtttaaatcttaagtccaaaattttcaaatctaacttgaaagttttcaatttgttagtaaaaaatttctccaaaaaaatagtatcctcttaattttgtcattattcttaactaactaactagctacttaactcatcaaaatgcgcgttagcggtgcgtgcgtgcgtgctaattagcttttccgcgtatcatctgctcgcctcgcgtatcggcctacttgttactgttagggctcctggtggcctggttggcatgcctgatccttctcggtgaccagcgtccacgtgcggtgatcggggccgacgatcgagtggcgacggcaaggccgcagcaaggggtggccacgcgacgtgcatatgtagaggacaacggcggcggcggcaagccggcaccggcacgggcgcacgtacggtggttggccggcggaaagtggcaccgagccaaggaagcaaggcagggcagatgattaggccttattcgtttcgaaggattcctaaaggaaatctcaattcctatgcaataagcactatccatgcattcggtttgtaggattcaaagaaaaattttccatagaaacgctatgccaatcctccaaaaatcctccaaaatatactaattccacagaaatgacaacatccactccatccttttttgtttagctaagtataggaaaaatttctgtgttccaatcctttgttttgcacgtgcattcctaaattatttttacgtttttcatattcctatgattttaaaatcctgtgaaccgaatagacccttattgattagccgattagattttctcttctattcaattcatctcagctgggatgcgtcacgaacgaacgcagacggcgagcggaggcggggggcagtcagtggcgtcggaaaggtaggacggcgagtgaaggcagtggcgcgtcgcagatggaggcggtctccgctttctcttccttaccgcacacattcaacttcttcctcgagcacttcatccatttctgccatttgccgctcccgactttggcatcattggatccaacctaatatgatcgatcacttgatcagaaataggtatgggtttatcgaaaaccacagagaagttggtcacggacgttagtttctttccattcacaaatcactgatcgaagtagctccagtccatccctgtctctccaacaaaaaaaaaaaagtctaattcgatccaaaaacagtgatggttccattataccctacttggtcctcagaccaaatacatgtttaaagcccacaaattttcaatgtttcaatgtatcgtgcaaacaaacgacggtgtttgagaaagattaagggaaagataaactaaaaaattattaaggcatgattaattggattttaactaatataaatttaaaaatatatttatttaatattttaagacaagttttatatagttttcttttaaaaaaaccacatcatttatttgaaaagtataataacacaaaccgaggttatatcctagtctgaaaaaacttgcaacatcatcttttcgcttttgcttatactaatcagccaaaatttaaattttcacccttaaatttaaagttaattttgggatttttcaatcatagtttattttcggtctttgctttaagatcactaaaaacacgtatataaaagttttattcataaattatttttttatttacaaatataccgtttcgcattttcctccagtatgtcaaacgatggggctgttagggtatcccaatagaagccacacctatcagtggcctcacatgggtcatacaagctgagaccacacatgagaaacatatctcccaatagaagacactccaaatgcccctacaaaaaatctgaggcaagtgtccgaagacacactagcccacaatgtcccacaacgtgtgttctctagcccatggagcccatgtgcattttactatcctacccctacgttttattttagcccggcctctttttctccgtcacccgtcgcctatctctctatctctttcgccaccgcttgcctctctctccagccgctcaccgctgtctctctccctcctcacaacgagaggggcgagcggtgcacgaggtggctggcagcgcggggtggctgacagtgctggttgctggttcccttcttcctccgccagtcaccgcctctctctctctctccacggttggtcgggaggctggatctagtgggttgctgcgttgtcgctaggttgtcgctgttgcaccgcctccagctcgtccactacctcaccacctccggccaagggtagaagggaaagatacatatgcggagcagagaccatgaaagacttagccacgacatcgtccaacatggagcctagctccgtggcttgatgaaaaggggccgagtagcacagtgaggtgtgtgtctcatagagaagtcgtgcccctcttacgagagatggatccggtcctaaaagaaacgttcgcatggacaaccttatagccacagtacaaagggtaacagtacaggtggaaagatttttcccccgaggcagagctcgtcaacgcgaggtgggagtggacgagcagttgacccaacgaaatgtacagtacagtacgtggaggagcagcaaatgcagaccggccgtggcgtggcaggcagccatcacattcaccgaggttccgctccgctccgctcgtctgcggatcgccgctctctgtctcaaccacccgcacagacgagctccgggcgccgagcgggtgggccccaccggacgcgacgcggaaaaaactccaatccgattaattcccccaacacgccacatccgcccctcctccgctataattaaaacgcgactagccgacggcgcactccgccatttcctcctccaccgcctaccgcatctcctcgcgttcacaccacgcacccgaatcttccgcgcctaccggacgccggtgggccacgccgcgcttcggtcggcgcgtcgccggaggaaggaggaggagccgtctcgttgccatgaagtgggggatcgccgccgccgtcgcgtccgccgccgccgtggccgccgcgtcaggggccgagctgctcgcctgcgactgcgccgatcagccgccgcagcagcaggaggccgccgccgccgccgtcgggaggtgcgacgccttcctcgtccgccacaaccaggtttgcctccccgatccccttcttcttctccccctctcttcttcctcgatctcctctgatccccttttctccttttggctcgtcagggttcgtcgttgtcaagggacgcggaacgcgcggcggcggcggcggcgggggagcagcgtgtggaggggaagaagttcgcgccgcggttcgacggcctccgattcatcgagacgctcgtcacggcgcaccgctgaactggggctgagattccttccttccttcctcccgtgattcggcggaggaagaggaggaggagacgccagatgcgcgcgtgatccttcggcgatttagatgcagcgccaagaagttttgttaggacaattgagaaattgaggctttgaaatctttcctcttctttctgtttgcttttctttctaatttcttcttattttcccccctttctattgttactgctattgctgttgacaattatggtgatccttgttaagctgaggcgataattgtgatgatttatgtaaattgcgagccatgattgattcttcatccaatttcttaggactgttcatgatatgatgttgatatccgcctcctctatcttagcatcccaagggatgtgggtgtctctgctgtaccttgcttacccatgtctgtccttattctcagcttgtttcttttcccttctttttcttctttgatatggtttctttttttttaattattttcttgatgtgatctctttccctccatgttggtggattgaattgctgcatgtgtgtgtggcaacaaattggtgctttgtcatcactcatcaagagttgtgatgctattggcacctgtgattgtgatgttattgtggcaaggggccatgtgatgtggctgcttgctctccatgctttccatttctactcctgcttttcttgattggatttgtatgtgatcaagatttcgaatggatgggatcaacctgagcaggatgtccgaattgaaccgtttatcagcaagctggtgacattgatgggcagaatggatgcaggaggcattgctggaaaggaagtacagtactggagatgattagggctgcgttttatgtgcaaatgaatgggacaggatcacggaagggactctggagcatgttcctcccaacttcctttttccaaaccctttctttcgttgtttattgtaccagcatgacacatgtagtggaaggcaagaaaattggacaaattttgtagtgtccaaactttttttttcatatttgtagtgtccaaactttttttttttcatatttgtagtgtccaaacttttttttttcatagttattgattataacagcctggtacatgtggaagcacaaaaactggacagttctttacactgtacaaacaaattggctggcctgaaaaggaatatccaaggatgaagttgccctgcccgggtttaccttaccgccgataaccgcgtggttaccgggcttaccgcggggtacggtaatataaatatcacggtaaccttcttaaattcaaataaatttaaaaaaaattgaatttttgataaattttgcacggttttatacgatttttcacggttaccgcgcggtaaccgtacttaccgctgggacgcggtaaccctggccccggcggtttgggaaaccctagccatgcccgcatgtgcacatgatttaatttatttttggctggagaattgattgtatttttttctattgtaaattacaaaccagtatgacggaatcgattttataacacatgcctctcgtgctgtatgagttttttcttttaaaaaaaaagaacagcaaagagaacctattcaggtattttcaaaatctactattcataactgcgggaaaagacaagcaaatatttatcttattaatagtattttcaccgtcggtaatagaaaaacggcaaaatttgctacaggacactcaaaaaatatgtaattagttgtcggacaccgcaaagacgtgaatttgctctagtacactccaaaagtgtggtaatttgctgcaggacactaggcgcattaaaatataatatccacccaattgatgagagagaaaccaaataaaatgacagttttactctcatcttcttatctcttcttcctgtctttttccgtcgctcctctcacgtgtgcaaatttcttagattaacgtacagtgagggaaattacacctaagtacagaattgatgatgctgctgatttcttggctaattaacagattatggtgttgattaactaattactccttgctagttttactaggcctccaaaaatttttagacggagtagtcgaagacgatggagaaccttctcgaattaaatttgaaaatatactgttcattcgattttttctcacaaatattcgggatgcaaaatattttacagaaatataccgtcggtctcgcacaaccgttgcgcgaaagtgacataggaaagacgtcgtggacggtatcgcgcagggaaagcatgagaccgcacggtctcgcggattggaatagcgagaccgagcggactaaaagagacatctcgcggtctcgctcattgcacgagcgataccggtccagtgccgatgtaattagtgattaatgattctaattagtgattaattaattattaattaatcattaattaggataattaatcactaattattattagttaatggttaattaagtaattaatcactaatcaaatcgagccgtccgactgtgtcgctgtttgattttgcgagaccgttcggtctctcttttccattccgcgataccgctcgcgacgtcattcccacatcactctcgcgcaacggttgagcgagaccgatggtatatttgtgtaaaaagttttgcatctcgaatattattgagaaaaaattaaataaacagtatattttcaaatttaattcgaaccttctccgggagaaggagcggctcgacgagtgcgggcttgacagcggcgaggagcattgcggtggcgggtaacgatggtggcgatcgtcggcgtagcacaccacacagagcgcatccatggataccacctgctgcatctcgtgcacgtcggcttcggtggcagccggccgccactggatgctacgccgaggactcctcgagaagcaacacgccttctcctcctcctccttgctgtgtgctcccgtaggcagggctcatagacccccgtgtgctggcacctcacaccctccgacaacaaaagaagactaggagaaggaagaagataagggcaaaatagtcatttcacgtggtttctctctcattagttgggcatatattatattttaatgcgcccagtgtcctgcagcaaattaccacatttttggagtgtcctagagtaaattcacgtctttacggtgtccgacagctaattacacattttttgagtgtcctagagcaaattttgcctagaaaaacgtgtctcacatgtgaaacgaaacaatcacttactccctccgttccaaaataagcgcaatcatgagtttccgtttctaactttattcgtccatcttatttaattttttttaaaaaataaaaaacataagtcaaacataaaataatattcatgttttataatctaataacaacaaaaatactaatcataaattttttttaaataagacgatcaatcaaagttggacactgaaacccatagctgcacttattttaggacggatggagtaataaaaaaaactcgtttccaatctgagcacggcaacaccacaaccgctacctgtggcctcaagccgcaggattgagatcctgcctgacgacacatcgggaccacatgtcaattataaaggcacggtgcagtgactgcagaggatcctgatcccaagctgcgacctgcgtctcccttgtcataaaaacgagacccatggcggtcagttgccttttgagctaacaaagatctttttctagtgggttccatgaatctgccttcaagtgtatataaattttatgactgtgattattcccttcatttcatattattttttttcactcaaccacctttagctattaattatttttgtttcattgattcactagttgcatacgtaatagttcgttttcttaaaaaaaaataggagatacttcctccgttttatatcataagtcattttgactttctaagataaacttattgaaagtttgaccaaatttatagaaaaatatagcaacacttatagaactaattagtttcattacatctaaggttgaacatatattttttttgtgttgtgttgaaaatattggtatatttttctataaacttggtgaaatcaataaaaaaattgacttagaaaaaaatcaaaacgacttaaaatatgaaagagaggtaatacattttgttttcttaatgtataggggtggggtttgattcatcttccgcacgctcgccaagcccaagagatgatttcagcctaacacgctaataaaaaggagttttcacatgagtccccctttactctttgtttacatttagatctgtatattaatttgtcgttttatgtaccctgacatagtttcctggacaaaggtttatacacaatagactgaaaatgtgggctaaatttctgagcatgacaaactctatatgctaaatttctgaacatgacaaactctatatgcctataatagcatgtttagacctacctgtgacttatttcttgtgtttgacttcagaattttgttcctaggacataggttatggaccttgggcaagcaagtagaagagtagctgcagcaatcttgatttcagatatacagtatatcataactggccatcattcaacataaaatattcagctcaaacaggaataggcactatctgtgctgacatagcatataaaaacattcagaacctattcatattgatgccattttaaaccataccatctttttgataaaatctaacatgtggatgcattaggtttgttaccaaacattggttatgcactaatgcttatgaaacttggcaacatcatagtaagttaccaaaatctgggcaggtcaaatgttgccaaaatttggtaatgtatatgtgggcactaaactaaacagataaacaacagcctaccatgttggtaacataccaaatttggaaatgtttattttggcatcaatctgaacaggctatcaaatttcagccattgtttgacatcaatagattcgaccttgaggcttgaggtcctagaccacacatatgctacaagaagagtgtcacagcaaagatagtgccacaagattaataatgattaaatctggagtgtcagctcttgattaattctgatagggaataaggcaatgtgtagttgtgtactatacaataaataaactaaactatagtttagagatgtcgccgaatttcaccatagcaaatcacttcattttaacattaaagcaggattcgaaattttgaaaccaccccccccccccacaacatgaaatgatttcaactaaaacttttggattttgtgaatttgatgaaaagaaatgttcaaattcaagaattcaaattatttcggaaattatggtcatatcggtgatcccgataaaaatagcgaaaacaaatatttgaatcctgaattaaagtatagggtttcctaaaaagtttaagtgaacagagacctcataacttttaattcaaaatcataaaatgacagcgggaaaaactcaataagcaactatctaacacaagttaacactgtgccagaagttaggttcctctgcccattatcaagtatccacaattctacacatttgtgaagagaatgaaggctattatcagtctgattagcagtacccacacttcacattctaatcacacagctaatcagctagctattctaatttatgatgcaaacttgcaaattatcagccaacatttcattcgattaacatatcacaagaaaattgcatgtcttaaagcagcattttcatgaattattttggagcaatgcattcaaaccgaaaagaggaacgcctgacccaaactatctgaagattaccttataagtctatacgaacgagggctatcatagcccggctatgacaaacttggcacaaaccaagtgcaagcatgcatcgaggggccaggcaactcttcgatttggccatcctccatcctgaaccggtagatgaaagacctgctggctctgtccatcttgaagaagtaaacacaattcccctcaagccccgcgaaatccgcggcgcggagcgagaatccctggtagagaccaacgaacagcattctgtctctaatgctcctcatctgaacccaccgcgatttctcccccgcaatctctagccggtgaacctccaatgcacagcaatcctccagcaattctcctgcttgttcactgttcttgctcctgaagtaccgaatcacgcacaggagatcatcgccggacgggaataggcactatctgtgctgacatagcatataaaaacattcaggacccattcagattgatgccattttaatccataccatctttttgataaaatctaacatgtggatgcattaggtttgctaccagacattggttatgcactaatgtttatgaaatttggcaacatcatagtaagttaccaaaatctggacaggccaaatgttgccaaaatttggtaatgtatatctgggcactaaactaaacacataaaaaatagcctaccatgttggtaacttaccaaaatttggaaagttttattttggcatcaataggttggaccttgaggtcctagaccacacatatgctacaagaagagtgtcacagcaaagatagtgccacaagattaataatgattaaatatggagtgtcagctcttgattaattctgatagggaatatggcaatatgtattgtacaataaataaactaaactatagtttagagatgttgccaaatttcaccatggcaaatcacttcattttaacattaaagcaggattcgaaattgtgaaccccccaacacgaaatgatttcaactaaaacttttggaattttttgtgaatttgataaaaagaaatgttcatatttgaccaaattttgttcaagaattcaaattatttcggaaattatggtcatatcggtaaaatttgaatgaaagtataggacttcttaacaagtttaagtgaacagagatctcataatttttaattcaaaatcacaaaatgacagcgggaataactcaataagcaactatctaacacaagttaacactgtgtcagaagttaggttcctctgcccatttatctaatcatagatatttgcatacatgaatttgcttcaatgtcgcaaggttggcactgatatcaagaagaattcacaggtaatgaaaataactgactatctcgaactccaagaagtatccacaattctacacatttgtgaagagaatgaaggcaattatcagtctgattagcagtacccaaactttacattccaatcacacagctaatcagctagctattctaatttatgatgcaaacttgcaaattatcagccaacatttcattcgattaacatatcacaagaaaattgcatgtcttaaagcagcattttcatgaattattttggagcaatgtattcaaaccaaaaagaggaacgcctgaccaaaactatctgaagattaccttataagtccacgaatgagggctatgacaaacttggcacaaaccaagtgcaagcatgcattgaggggccaggcaactcttcgatttgaccatcctccatgctgaaccggtagatgaaagacctgctggctctgtccatcttgaagaagtaaacacaattcccctcaagccccgcgaaatccgcggcgcggagcgagaatccctggtagagaccaacgaacagcattctgtctccaatgctcctcatctgaacccaccgcgatttctcccccgcaatctctagccggtgaacctccaatgcacggcaatcctccagcaattctcctgcttgttctgtgttcttgcgcctgaagtaccgaatcacgcacaggagatcatcgccggacgggacgaaggatgagcacttgaaggcatccctgtgcagggtcaccggcggtggtggcggcggcgcagcgtcaccgagcacggcaagcgtggcggcgtcgaagatggtgaggtggccgcggtcgttgcagacgaacaccttcccggcgtggtacatgttctcggcgacgaggtccaccaccggcaccgtcgtccacccgccgccgccgccggcggggtggtggaagaagatcctcctggtgtcgtagagcaccaccggcgagtcgggaccggggaggtagtagccctgggtgatgggggagaaggcgtcgaagggggaaggcgggagggggaggtcggcgccggtgagggggttgacgaggaggaggagggggccgtggtcggagaagaggaggtgggagtttgtgtggccgaggagggagcaggtggcggagggggcggcgacggagcggagggcggcggaggagagggagtagaaggagagggaggggccggggccggcggtggggttgatgggggcggggcgggcaaggagccatgggaggaagggaggaggggaggccgctgcggcggcggtggcggcgcgccacgcgcggcagacggcgcggaagcggaggaagtcgagtgggtcgtggaggcggccggagaagaggcggaggaggtcgccggggaggcctgaccagtccattcgcggcggcggaggctacggcggcagcgcgtcttgaatgtttcagattggggagacggcgaaatggctcctattttttgtttctttttttccattttgctacgaatctgtcgcgtgatttgttttgatgataggatgtgtttagttcacactaaaattaaaaatatgttaaaattaaaacgatgtgacgaaaaagttaaaagtttatttatgtagaaaaattttgatgtgataaaaaagttagatgtttgaagaaaaaattttggaactaaactcggctatacttgtctcatcaattaacgagccagagggaccattaaagctgagatgcttgtattttggaaaggaggaattgacagcttagcatggccattttatgctttaacccattggctgtgtttagttcagcgtaaagtttggatttcaattgaaattagagatgatgtaactgaaaagttatgtgtgtatgacaggttgatgtgatgaaaaaggactgaagtttggatccaaattttagatctaaacacagccattgttttgtttgttatacagagaaaccctcttggtataaagctaaccagttgaacaaacacatacaaatgacaaaagctgggaccataatgttgaagcaacattgttcatatatattgaaaaccaacagtaacgaaaatcctgctccgtaagattcacaaggatccagcatatacatatcgcaagccacaatattaggggaagtgtcatatttacaggtgtcaaaagatgaatacaattgaccaaaaaaaagcttatactcgaacaggataatggacagacgacttattgactggatgcagcagccactgattggaatttgatagtcagaaattacaagatgaatcaggtcctaagataagacgatcatgagttggtacaaatggctaacacaacagacaagacccacgactatcaactctttcacagaaaagtggaacaaagatatatgatcacagacgctcatctcttaatgagaaaaccaagcaggattctcagaatagcaataaccagcacaaaaactagtgagaaaccaccgttctgactccccatttgcctccttagaagatcctgttcaattccaatagaagataaatgaaactacgtgagtgttgcagttcagattcagatttcattgatgcacaaagccataatagacaaacaagatgatatttgtagataacgaaatacatctgtacttgtagaaattagtgggttgcaaataaacttgacaaaaaagttaaaaaaaaataaataaagcgcatgtaaactgcttattctatctatctaactcaaagctaaaaattgtattagtgtttttttccggtggactggtcactgctggccacagtaaaagaacagggaatgagtaaatcatgtggtgattatttattggagatgcaaatttagcgacaaagctgttactcaaacctaactagtttttttttttttggggggggggggggtaagttaatctagttcttactgccaaagttaaaaaatataatgggtcattaaatgtttgcataatcaagctaaccagttcttcttgaagcttcatgttctgttgaatggcagaactcttctcctccttcaactttgaaatcaaggccaatggctgcacatagctgtgaaagagatcagcttattgtgctttggcatcattgtcaagcaacataggaagtcggaatcctctataataagacctctcagttcctcagtttgtaacaaaagtaaaatgctaacaaagtgaatatatgctagaagatgaagcatccctcagattaagttaccatttgcatctaaatatgttgagatgaaaagccatgatttatgcaaggagaacattaatcaaaatatcattagagcaagaatattggcaagcaaaaaaaaaatgttatagtagtgtgtgaaattaggattcagtgataacatggcattgtcaaatttaacaggagaacaatgcaacatatatatcaagcaaagtccgtagttttccccagggaaaaaacaaagagcatagcataaaacagcacacacatagttctgttggatcagagttctaaaacaagtgtcatgcagaggactaggaaataagaagagcacagcaacactgtaaaatataattaaacaacttctgaagcaatgctcttggataaaatcagacatagtagtatctctaaattatgacacctatcagaagaaaacatagatgtttcccatctgaagatgcatacctcagaggttactgtttcttattctctagatccttttgttgcctgcaaagaaaagttcacaatttgtttcagatgataaggaaatgaatctctctgaaacgagaaatttaactatttgccactttaggtttgccaattatccaaatgcccttattaggtttgtccttaattttttttgcccttttaaggtggtggcatcttaactatttgccacttttgcccatgtggcatgccaacatggcaacacagtgtaaaaatcgacgtgggacacacttgtgagccgcacagctatccccttcctctcgctctccggcctacccgtcggctgccagcgttgctcctctcggcgacggcggtgcaccggcttgcagttgcggaggaggagggggagccgagcgccgccgagagtccgacctctcttcaccgcgctcagctgcaaccgcaggattcgccaagatccgcggagccgtccgcgttgtcagtggatggccgaggagggagggacgcc

SEQ ID NO: 61742 - DNA, 26873 bp, Oryza sativa
aacggcactcggctccccctcctccttccatggctccatggtgagagagacaggcgctcggcgaggacggcgaccaccgtcggtgcaaacaacgtgagcatgacctcgcacgtccagtctagtgcgtacatcctcgactacggtggcgctcggctccccctcctccgccgccgcgagccggcacgccgtcgccgctgccgacatggttcgcctctgggaaagagaggagcagcgctcggctccccctcctcctccgcagccgcgagccggcgcatcgccaccgccgccgctgggaaagagaggagtagcgacggaagccgatgggtatgtcggagagcgagagagggggaaagaggatagctgtgcggctaacaagtgggtcccacatcgatttttacactgtgttgccatgttggcatgccacagtggcaaatagttaagatgccaccacattataggggcaaaaaaaaattaaggacaaacctaagaaagaagggtatttggataattggtaaacgtaaaaatggcaaatagttaaattccccctgaacccccaccaaattgaagcccccaaaagtacaacgcacaaagcctccatgggaaggaaatgcaaagatagtgccaccgcacaaacacatcccgcaggtggcggcggatctagggcttggggtgctggtgctcggcgtcttcggctaggagcaaggagacgctggatgagatgaagagggtagaggcggtggccgtcggcgggggttaggctggtggcctgtggcggaggaggcagcgcggggtgtagaaggagagggaggggcgggtggtgtgctggaactggaagggatcggaggaggggaggccgcagctgcctgcatgtggcggtggctgaaacccatcggtggagaggagtggagtggagtggcggcggcgcggtcagaggctactggccaaggaagaagaagggctgatattataggatacaggtgggacccacgtgccagtggaagtaaagggcacgagcccacctgtcatcctctctgactctgcttgacttccatggcgcggtgcgaccgcgagcgacttcttcccggcttgctgccggtgatggccgagtagaatcgtagaaagtgagggaaggggacgaggatgtctgagcgcaagtactcacctagactccatgggcgtcgtcgaggaagaccgtctgctgcagtgcagggaagatgagaagatcgattcaatcacctgccaccaccggtgcggcaatattccttcttcaggagatgctgcaccaatataatggccgttggactgcctatacatttgtcgataaatttttccctaaaaatttgatagatgtaattattgtacaatcataatgtaattacgctgtaacttatatataattacactgtaacttgcatgtaactacattgtaacttatatataagtttcacataattttgaattattagatttattacaagatttgttttggtgaggaagaaaacaaatcatagcacacacatatatgaaagaatttgttcccacgacctccattttaccgaaataacatgttacggagagatttttgaaagttatatataagttacactatagttacagtgtaattacatgcaagttacagtgtaattacactacgattgtactgtaattacatctgtcaaatttttgagggaaaatttgtcgacaaatatatagcaaaatcgaatgggcgtaaactgtcacctcctcctggcaatcgatgtgcctgcatccgtgtccgtcgtgggtggttagcgccctgcaggaggacggaaaaaaaagtggtgtggcatatggactaggtcttgagaccgagaggacacacaagaatttcagcaagtctacgttatgtgattatgtcaagttgtcaaaacggtaaattcaacctggaaacaaccactaaaccacaattcatctacataaatgcataaataaaagggtaggcactgaaaaatacttgaaagaataatgtttcagacttttagcaatacatatataatcgatagatatgataaatatatatagaatatgcaaaagaaagagtaaagatggattaaaagactacctttaacatggattaacttaaaaaaaaacaagttgaattttttagatggcctttactcaaaagagctacaaccaattattacatagtagcaatcaaaaacagagtgtaaatctagagaataacaaagaatccagcctaacgtaaggagatcacaattattgaagtctatttgtaaatctccaaccataattgataaaaagttgcataaccgtagtctctaactttcgacgtgcaactttcagaaactcttcatcttcatcacacttttgtagttgtgcccgaaaccggagtcaatatgttgccctgaaaataacctgcatataggaaaatgatggtgatttttcaaaaaccatatcgttcctacttagccatattgcccaacaaatggcagaagctccaacaagtatcagtttactctttttcttatcaattcccaaaagccacccattaaaaatagaggtaagttcatccgaggtcccttaacttgttaaggaatccgactttcgtccctcaatcggaaaactagacacaacgggtccctcaactattaaaactggtgcagattagatcccttggcagttttgagagtggttttggctgacgtggcgcctacgtggctaatttgactcggtcttcatctgacgtggcattgacgtggcgcttacgtggcaattcgatcaggaaaaataataaaaccggtaggacccacatgtcagtttcacacacaaattaataaaaatggtggggcctacgtgggccccacatatcatgctcacccctcctcttcttcctcctccctccccatctctcctctcttcgtctctctcctctgctctctccaggcgacggagaggcagcggcggccggcggccggcggccggcgggagagaagggagcggcgcgcagcggcggaggcacggctccggcggttgtgggcagaagaggaatcggcggcgggaagtggctctggctgcggcggccgcggtcgctgcacatgctcgaccccttcgcggccgctgccgcgcccgccgctgccgaggctccgtccggggaggccgccatcgccgctgtcggagcggcggcggaggaggcaaccccgacgctgatcgacgcctcagcaagctcaacaaccaccttgataagatgctgaagtaagatttctcatgttatggcaaaaactgaaaattgattccacaacgcttgatgcattccttaaaaaaatgtttgaattttctgttgttgaaatcgatcatatttttaataactttttggttctggtatgttatgttccttttgaacagagacatggaggaatcatggctggggccatggaaatgccttctcttgggatacgaatgtacgatttaactgaccaacacattgaggcagctctgacaaacctgattgctggtctggaatcagaatacaaatttgaagtaaatccagtgctcatcaaggtcatccttggtggtgctatgtcagtggatgaagtgcaggactgtgtttctcaacttatatcgtgtaaaggctattttggccgaggagggtgttgtgggaaagacagacttagagccttctcttcttgctgtattgagtctgaagctctggagacagtcgaatgcttaataaaaagtacagtgaatgagctgagtgaaccagttgatagagatccaggcatttttgttctcgacgaacctgctgcggccacggccacgaccacgagtccacgacgacacttccgctcccgagatactgccacgtagcgagccctccgcctccagtccacgccggggtcgcgggcttgggcgacgagcagcaactggagcagctggcgagggtgctctcctcgctgtggtacaacgagatggcctccgcggcgccgctcctcgccaactcaacgttgctcgcggcgtggccagggtcgatcaccgtcttcgcggctcccgacgtcttcctccgctcctcttgcaccatgtgctcgcgccgccatgtcctactggagcacatcgcgactagataaatcatttgttgccacgaaaaaaatcgtggcatcaatactaaaattgtggaaatagatacatgttgccacaattgtaaaatcgttgctagccgtagtaataaacagcgtggtaataggttattgcaacgatttttattttgtggtaataaatttagatgttgccacggaatggatgtggcaaaaagtcatattgcaacacttcacatcgttgtaataaaaattattgccaccactccatatgtagcattagttttacgtaccaagttaaaagttcaaatattagtctatcatcctatctatttatctactctttttttttgattttgtgtcttggctaggattcgaacccaagacctgtccttcaggtgtgctctcctttaccaactcaactacacatcaattctgttcgaaaatgcatatagttctatttgagcctagctaactgagatttgaatcatagatttgatatctaaaagatttcaaatgaaaaagttatcacctataaaattgtagatctcgtcgagagctataatttccatataaaatttgtctcaatccgtgtccatatgaaaaaataaagttaaattatgagatggcaatttttttattgcaacaattttgttgatcatggcaacaaaaaatagtgaaaagtactgtgtactatataaattgccacaaaaataaaaattgtggcgatagaacatgtttttttgcaacagtacgatttttcgtggcaatatctcattttctattgcaacaaaagtactaaataaaacaacgattgtagatcgttgcaataaaaaataattatttgccacagaaaaattatcattgcaatactataatatattgctacgaattattttttgttgtaataatttggtggcaatagctcaattatcttgtagcgccctgggagggaggaggaagaacaggaagggtgagttctactgacatgtggggcccacgtgggtcccccatttttattatttatgtgtgagattgacatgtgggtcccacgggttttattatttttcgggatcgaattgccacgtaagcgccacgtcaatccacatcagatgaagaccgagtcaaattagccacgtaggagccacgtcagccaaaaccactctcaaaaacgccgagggatctaatctgcaccggttttgatagttgagggacccgttgtgtctggttttctgaattagggacgaaaatcggattcgttgacaagttaagggacctcagatgaacttatttcttaaaaatatgagatatgctaactggaagattaaaaaccaaaagagaactgaactgctatccatatgaacttcgcaaaatgacaattcacatagagatgttgaatagactcattcttcaaacaaaaagaatacctcaagctgccattccagttacgccttgccaaattatccttagttaacacaacccctttaagcaagtaccacatgaaaattttaatcttaagtggcaacttaagcttccaaatacacttatttctctcgatatagccattattaattaaagctaggtatatagacctcaccaagaacaagccattctgatgggaattccatatgaaactatcagacgaattattcaactggatatgtactatagaggcacacaactcatgccaacaaacaagattctgataaactaaagctctcctaaaagaaacattaagcggaacagatcccataacagtggcaatagagtatgttttccttcggacaatagtgtataacgacggatatttatccttgaaagccaagttgcctagccatttatcttcccaaaatctaatttgttccccattattaacaatccaagagcccatatttaagaaagtacttttgacattcataagaccaggcaaaaaataggaatccccttgtttcctatcaacttgggttatagacttattataaagatatttcctcttcaataagtcatgccaaaccccttcctcattaattaacttaaacaatcatttacttaaaaaacatttattttgtatctccagattatgaatcccaagaccccccggtccttgggttgacaaacaacatcccacctagtgagcctgtaatttttcttatgatcatccccttgtcaaaagaaccgcgatctgtaataatcaattttacgaagaacccctttcggcacctaaaaaaagatatcataaatatggctaaacttaaaagaacagaattaatcaacaccaatctaccaccaacagataaatgcttgcctttccaactactaagctttttctcaattctctcttcaataagtttccaatctttactagtaagcttcctaaagtgcatcggaattccaagatatttaaaaggaaaggcacctaacttacaaccaaagataccagaatattgctcataacattcctttgcctgaccaaaacaaaataattcactcttgtgaaaatttatttttaggctaggtaacttttcaaagacagattaaatcaatttcagattctttgcctgttgcaagtcatgctccaaaaagatgatagtatcatatgcgtattgcaagatagacaaaccatcgtcaacaagatggggaataatcccattcaatagtcccacctctttagccatcttgatcaatagagtaagcatgtcagctactatattaaaaagaataggagataaaggatccccttgcctaaaacctttgtaagtttgaaaacaattaccaatttgatcgttaacctttataccaacatcatcgccttgaataaaagatgctatccactcacaccatctaggagaaaagcctttcattctcaaagttttttgttgtacaaaaggccatttaactttgtcataagctttctcaaaatcaatcttaaaaattacaccgcttttatctttgcgatgtaattcatgtaaagtctcatgtaaaataagcaccccttccataatatttctcccaggaatgaacgctgtttgagtaggactaattaccttttgagcgatatccattgttctatttgtagcaattttggtaaaaatcttaaagctaacattaagtaagcatataggtctatactgttgaatcttcatagccttaacacacttaggcaaaagaatgatagtaccaaagttcagcgaatataagggaaaactcccagaatgaaagtccttaaacagttctaagaggtcgaatttaatgacattccagaaaacttggtaaaactcagcaggaaatccatctggacccggagctttgttgtgttccatttggaaaatagcatccttaacctcattttcagtaaaatccttagttaaggcttcattctccaattgtgaaacttgaggaatgtcagtaacataattctcatcaaactgaaggtcagactcatcaagagggccaaaaagacctttataataagtggtaatatgtgactttaaattggcatcaccacttatgcgactttaaaaacaagttgaatgaaacgtaaaacagtaaaagcatactgctcgacaactactagactacctggtgaaatagctcttcaaatctacaaacaaaattacacacatgtgaatcaatgacaaattgtgcattaacttttgcaaattgcaatgttttcacttgtcatttgtcaaatactcaacaaatgttatctttttaagatgccaaagcctttcctttcccctttctatccatttgtgctgaatcgggccagttgctttgctgccttgcccttgctgacttgttggtgtagctgccctgctcggcttagagctgggttgctgcgtgcagcccagtggcggacacaggattttgaagatggtgtacagagttatcaaatcgttgttccataaagaaactaaagcttaatagtaggaaaagtaatgagaaagtttttcttgctagaacaaataaaaatagaaacattgcaaaatagctaaagaaaaattaaatcttggagaagagatagtatgttttcatcccaaacactccatagagatttttgcactaccatttaactttttgactgctctaccatataaattcagatatgcacattaatcaaatttcctaaaagcaaccatcaattgaatcaaacattaactacagaaagatgagttaggagcctaaaaatatatatgatacgaacacattcaacccattgagccatgaggttgcttctccagtgcagtggcttgtcgatcagctgcttgttctcggcttctctccgtgaccacgagcagcgcctgcacacggctgccattggttggttgtcccaaaccataggaaggcatgcaatatgctcggtattctggttgtaagccccatagacaaaccagagattcagggtcatgagacgagatcgaggagcttgtgttgttctgccagagccgttttctatgagttgtattgtgattttaggctaaagaatagctgttttgacccaactaatgatatatataggtaatatacctattaattcaaagattattagtcaaaaattttgggggtacagatgtacccccatgtcccatgctaggttcacccctggcgcagccgtgcatgccaggtggcaccgcgacactaggagcagacgagcaccgccatgccggcctgcagcctgcagatgctcgccgcctagcctagatgcattgcccacgtgttaacaaccaaatttggtaatatcggcatcggaaaagaagattagatcgaagtggagtcgaaggcggagatcgattcgagaacagagcaagaatcggctggagtccagatcggctacgaataggatcggctgggtctgagtcggactaggtaagccgatacagccaattccgacaatacgacttggtgtatgacatcgggttgaattgaggtacttcaagatgattgccgcacatggatagagtcctgagaaggcaattgtatctattaatttggatattttatgtaatttccatagagatatgtttgggcaaaagtctgccgcaaagacttatggtatcttagagtatgttagagataagagtcgtgtccgatatggacatagtttgtaattttcgggtataaatagaccccgaaccccgtgtaatcaattaacacacatgttcactacaatttcggcgcatcaccacccttttgctttagttttatttcgacgagttcttgctttcgggttgagctgcatcggtttcgatcttcaacaaaagataaaacttgttatgacggcttgcgttctcgggattagtgcttccatctttatgatattctaatcttgcttatgtaattcgtcgagttatcatatatcttacataatttctggcaatatcgttatctaacctacaatcggctaacatctatcggtaaagggcagtcgattaggttagatttcaacgttgatttaaattatataagatatctaccactctatgaaatttccagcggcttgattgtttagatgttgttcttcttttcatacttaatgctgcatcagttgagtttgatctattaagtcgtgcttagcatatcaatctctagcatgccttctggttgccaattagggtagtatcggagtttcagcctaccttatctgatttaactatatttgctctatatgcttcattgacatgttaaatccaccctttatgtcaagatattattgcatctaagtatactaagcttctgtttagcatattctgcttgttttaacatctaaacatagagttgtatcggagtattagccgatacatgctagatcaatctgatcggctatgccatgaacatatatagtccttttattaatatatatttcgatctaagtgatttatactgtttcggcatggcgaccgatctatcccaatcacttgatttaagtatataccgatataagaactacatattgttaatatctacaaccgatcgggtagatttagttctttattacctatttacaaccgccgatcgatttacatatgacatcggctcaaagataaatgatatgtcatcggcacttagccgaccggctatcatttataggtttaaccgtggtttctttgtctctatttcttgttgattacaggatcaaatcaactggcacgctaacacacccgaaggcgagctttggacctgcactggagttaagcagatctcccaggcctcgtgtttttcgtcaacaccacgccgacgccatcgcgtcacacgtcggctggacgccgcgcatggccgctgcccggcttgaccctggagctgaaggccggagcagggggtactcgcaggcagcctaaggtatggcgagcgccagacctcgccataccgggtcctccgccactggccgtccacaagcttgacgcgcggtgaaattgagcaaatcaatccagaactagttttttttttttttttgtttctgcattgcatagaaaagttaccagtgaactgaaactggtcttaaaaatttacatctatgctatcacaagaacctattgggagttgttccccagagataagacattgacactccatccatcttccatcacaatctccaacaccacaaggttatctcgctctttaactggatgatgaagcctatggtccaaacacttctgtgagctgaagctgagcttgcatgtcaaacagaaccggtcttttaaatgttcttgattataactcgagtttacgagtttttgcactgtctgccagctccggccccgttgtacctccgcaacctatatgggagagaaatcaagaactcacaaaattaaatctggactcttttgtagcacgaattgaactcgattcaacgattccaatttccaagccaaagaaatgtccacaagaaaaggtaagaacagaaaataatcaattatcgaaactcacagaatgaaatcaggactctttctacaacaaattgaactcgattcaacgattccaatttccaagcaaaagaaatgcctgcaagaaaaggcaataacataaaataatcaatcatcgaactcacaaaatgaaatcaggactctttgcagaagaaattgaactcgattcaacgaatccaatttcagagcaaaggaaatgcccgcaagaaaaggcaataacagaaaatgatcaatcatcgaactcacaaaacagttagaaacaacagaaacaaacaatttattcccaccttggatttcgggctacaaaagttgtatcttgacgctattggtaatcgcagcggcatttctccctcagacccgaaagtgttttcctcagcctatctcttcctagcattatctaggtgtttgcttcgtgcttgaccctttgaatcttgtccaattacaacccatcctcttatttttggcatctcgatggctcagtacaggaaaaccattaacaatgaaaatatgtcaaaaagaaggaaacatgtggagttagttcagatgcatgagacaggacatgtagatgattgaaagaaagattcttgccgcaacgcaactacctccactgtaacagcattggtgccagggtgaaggatggcggcgtgttccggacaacaggacaaacaaaccatggctgagtagcgggaacaaaacctctcatgacacgaaatcctcatgcaaaatctgttctatgaagggagaaagatccatttttgttgaagaggaggtgaagaaattaagaaagacgatcggggtggacgggaggaagaaggagaggcgaggaagaagaaaagagtctatcggcagagacgagaaaaaaactattataaaatgttaaactaactagttaaaacttataagtattattattactcagtaagttacccctttcaaattgatattctagcttcgctactgtaaagtttggatcaaagtattattactaatgtcatacttcttgatttcttctatgatttggatgtccgctgaattccgctgtatgacgtaaaagcatcactaaattctattagttgtttgtttaggtagcggtggtacaatgcgaccaaagctggcaattggtgcagaacttgtcaacataaattttaatcaattgagctgcctatatgaggaatttttcgtgcatcactgcttgagacatatgtcccactacccagtttagcaggaaattaactttaaccaaaccgcccagtttagcaggaaattaactttaaccaaagttagagaaaaatgcattgacatctattccaataaataaatactttctccgtttcatattataagactttctagcattgtccacattcatatatatgttaatgaatctagacatatatgtgtgcctagattcattaacatctatatgaatgtgggtaatgctagaaagtcttataacctaaaacggaggtagtatatatgttacaccatgatcactaattttacgctatataatataacatatgatatacttatacatagtgaaagacacaactcagttgaacaatatttatagcgcactatgatcattagatttacaacaaatgttactcacctatatatgttattagttaagaacattctagattatatttaggaaaaaatatctctcaaattctaaaaactaattaatcaacttggaagcatacataattactactaactcatgtaaaaattacaaataatataatacaaaccatgggcacacaaaccaaccgggagtttttagtggctaaagctatcagtatcatcatcaataataaagaagaatgagataacaaggagatggaagagtggaagaataccatgagaaaattgcagttttaccctacattgtgctaaagaacaaatccacgttgaaaaatatgaaaatttaataatatttgtaaatcattgatgtgtatattatacaatgtctttgtgaaagatatgacttccagcagagagtgtgagcttgtcatgtgagttgggcacatctttttgctgggagcctatctttattgagattcgaagtgcctaggttgaggtagttttgtatccactgcaataccactctatctatcatgcgcttcctattattattcatgggctagctgcttcagcttcattgagtagcttgcttctatttttgtgctcggcgcattgtcctcccctgcttttatcttaccatcattgtgtcgaatagctttctcaacatggacacatatgtcggcaatctggaaaagcctcattgctaagggtgtgttttgtgtcgccaactcttggatggtgtactgaactcggacgcctaccttgaaggctcgtatgacagatgcatcagtgatctcaaggattttgttatgacattcattgaaaatcctataaagtcttacaatgacatgccatttttctacctcatggcatgtaggtactccttgaccgcgtgccacttctaggtgcaacgacgagacaaggagcgaccctaggctgttgctgttgttgctgctactgcatgctgctcaaagttcgagcaggagtgcaccgctgcttctgttgttcctcggcgccctgaactcgctgtaaaatcaaggagttgatttagattttgtgatgaaaatattggtggtttgctaatgttattttggagattttataagacggttgattttgtgaagtgtgcagtttcggttgaccctagcggtctgactggtcgcgtgccgccagtcagaccacagatgttgcggcggtcagaccagccggctcgacggtctaaccggcaggatcatgttcgatgtcggtttcgggttgtcttgttggatttggatgtttccttcggggatttggcttctagatggtttctatgcgtatggatactattgttatactaatgtgagtcaagttgggacgaacttgggctcggaatatggtttcttggttgttgcatgtgcaggtgttgcttgaggcctcgggagagtgttgccggtgatagattggagtcaacttgggacaagttgatgtccagagatcaagagatcatgagggatattaaaggctagaggacaatgcatatggtgatgaagaaattcatatggtatacaagagggattgtgtacatatggtaagaggagtcaaatttggaagggagtccgaattcaggaagattgattaagataaggaaagagataagttggatacttgcaagagagggtttcctatgtgggttaggagttctaagttgtgttagattcgtgggctatgcacagcctacctcatgtataaatagagagggaagatgaggcctcccggtatcgattttagagatactagagttgagagaaagttagggtttcgagtttagttcgagattttggtgaggagtgttgttggtgcactttgtaaacactagttgatgcaataatgtcaaaaagtttcaatctacatcttcgagtttgtcatctaccggtgtttatgggtcccgacggtctaaccgcaggtgtgcgtgcggtctgaccggtgggatagcggcggtctgaccgcaggtctacgggcggtctgaccggcgaggcttcggtggtttgaccggcggtaggagggcggttcgaccagcggtgatagggcttcgacgtctaattcgttttgagggtaatctttaattccgaaaaagatttttgggttttcggttttccctaccattcaccctcctctggtaggtttgttaggtttgtttggtcttgtgtgatcctacactcgcctggccccccctcgatttcgccaccacgctgtcaggaagccagccacgggggcatcgtcgtcggcgagccccattgccgaccgctccaccactgctgccctaccacggctagaatcaccgagcaagaagagtcgaggaagaatataagtgtaacatacgggtcccacttgttaacctctaaggctgtgtttgtttctgtgtgctgggaactcatttcccattcacggaaaacatagaggtccattagcgtgcaaggttattatgatttttttaagcaactttcatataaaaactttctgcaaaaaacgtaccgtctagcattttgaaaagcatgcacgtagaacacgaggaggtgggttgtgtgcattttggtttgtacgacaataaagactccatcctttcgcttattggcggaataagcgaaacgacatatttgcaaaaagaaaataatttgtaaattaaacttttatatacgtgttcttagcaatcgaaaagaaacgaaaagactggaaaataaactacaacgaaaaaatacctcaaaatcaactcgaaatttaagattgaaaattcaaattttgacttataaccataaggccagaagatgaggctgtaaggcatgaaaatatctagtctatccgcatccgagatgtatacagtcgcattgtttaaattttacaaaatactaatgacattgaaccaatattacgaatagtagtgatatttgtttaatggcaaaatttgctacaggacattgaaaaaacgtgtaattagctcgtggacaccacaaaaacgagaatttgccgtcgggcatcacaaaagtcgtgtaattagctcctggacactcagggccttattttattatttcttgttaatttggagagagagaaacactggtgagagtacgattttgcccctaccctcacacggcggcggtagcctgggcgagggagtggcactttggcagcaatggcatatggatccaattaactcaaaagtaaattagagttggtagagttgcaatggcatatggatccaattaactcaaaagtaaatctatctattatattattaaaggaatagaaaaaggagccctcacgttcgctctcatggcctagaaattctcacattaatcggagaaaaaaaaagacagagtccatatagaaatacaatttagaaatagctgaaattcggaattaaaaaaaaaggaatattagaagaggagactagagtccatatagaaatacaatttacaaataactgaaattcggaattaaaaaataaggaatattagatgaggagactagagtccatatagaaatacaattaggaaatagctgaaattcggaattaaaaataaggaatattataagtagaggatagagtccatatagaaatacaattaggaaatagctgaaattcggaattaaaaataaggaatattagaagtagagtatagagtccatatagaaatacaattaggaaatagcttaaatttggaattaaaaataaggattattagaagtagagtatagagtccatatagaaataaaattagtagaaaaaggagcattcacgttcgctctcatggcctagaaattctcacattaatcggagaaaaagaaaagacagagtccatatagaaatacaatttagaaataactgaaattcggaattaaaaaataaggaatattagaagaggagactagagtctatatagaaatacaattaggaaatagctgaaattcggaattaaaaataaggaatattagaagtagaggatagggtccatatagaaatacagttaggaaataactgaaattcggaattaaaaacaaggaatattagaagtagagtatggagtccatatagaaatacaattaggaaataactgaaattcagaattaaaaaaaggattattagaagtagagtatagagtccatataggaatttaaaactaactaaaatttgaaaaaatataatgaaattaaaagtagagtttagagcccgtataaaaatacaatatatttataaataactaaaattcgaaattaagaaaaacatgggaagaagaatttaaagtcaatataagaatgcaatttagaagtaactgaaattcgaaattaaaaattaaagaatattgaaatatgagtttagagtccacgtagaaatacaattagaaataataaaaattcagaaataaaaataaataatgttggaagaagagtatagagtctatatagaaatacaatttacagaaaattcgaaattaaaaaaaagaaatattgaaagacgagtctagagtccatataggaatatatataatttacaaataactaaaatttgatattaaaaataattaataactaacacgtatataaaatacaatatgaatattacacattagtagttttgtaaagttattgcaaaatttaaaattatgttgtcattttaatatatttgaataatataataaaaatcatatatgctattatatgagagaaaatataatgatactagccgcgcaatctgcgcgggccaccatgctagttagaaagtaaagatatattcactttcgtgggatcacgctactaactaaaataatctaaccaaccagagtattaattcccagtgacaaaaattgtgatgtcaacaggtattccatgaattgtccgttgtcaaattccaattacgacataccaacttaccaagggcatgcgcacatagaattgtgctaaacccaccgctgtccgctctcggcttttctcatcttaccgtaggccaattctcttccttatatataatttttacgcgatttgacatcagaggatggagcaatttggcatcaggcttccacggcgaggccaatctgcatcacctgcccgctcgatccctgaaaatcttcttccgtttctctctggagattgctgacagcgaggctgcggaagcaggcgaggggttcagggctggtgactggtgagatcgatctctcatctctccgtcttgctatctttctccctatctctaagtcgatcattcctgtaaattgtattgctggtaggcttttcttgttacctttgctgttaaagccatttaggatttttctattgcctgtgacctgtttgtggaaatgcctcaaaaagatatcacagctcacaggggcaggattctaggttcccaggtgaaaagcaacatggaagagggaggaggatgaatctgagtttttttagagtatttctttttttgtatttgtaattggagaatttagattatttaccacctaattctcttgtaattgaggcattcattttctaaatcatatttcttttggctaactgcactatgagcacctgcaaacaccaaaaggtatactattagagcatgattttcatacatatataacagaagtttcagtaaagctctactgtaatcagattctgctttattgaattgcaatttctggtttagtgatacaggattttaggtgactatgcaataaggaaattcgtgcccttgtgtgcgtttgggggctgatgtttacaaaataataatcactatgttgaggatgttaaatggaacttgtttgctctttatatttagcattgtcttgcactatgtctcttaagggttatattatacgagttacatcatccagaattggactagaagtagaacttcatatttggaagtggaattaccagtctaattcggatcataatataacagtcatcatcccctaacaaattttgaccactagcagctacatggcacaggtaacaggtaatttagttcatagtatatatttgccataaggcatgcagatagggactaagcccagatcaattggtgagaggtgtggatgtacaccaccatcaccaaagttcagaaacctcttggactcaacttgggtctctatttcttctctattaatttgataccaagttcctttttagtatttgtttttgtgtcaatcaattaatcttcacaaatataacgcaagtgttcttgaatcttatataatatctttttctatgaaatcacccatttctaacaaaagttcactatttagccttaaaagtcatgtgctgattcattttccttccttatcgagtggcctatattgtatggcatccacaggtctgtcacatattttactttttttcagaaggctcagttcttacaactatggccgaagtacttctgtcaagttttgccgtgtcaattattggaaaaataattttgtttgttagtgaacacggtttgatggggattaaatcagacaggagtgtgcatcaagaactggggaagctacagaattcgttgcaagctattagtggagttcttctagacgcagagaggaagcagagtacttctagtgcactcaaggaatggctgcgaaaactgaaagatgtcatgtatgacatagatgacattttggacgatgcgtcaactgaaactttgaagcgcagagttagcaaagatgtggttactcaaaccaattgtgtacatatttctcgattgaaattgagaagaaaattgctcaaaaggaagaagaaatggagcagcagaataagagaagttcatgaaaagcttaacgaaatagccgctagtaaaaaggactttggactgaccgattggacagtgggtggtcagtgttctgaagaaccagaaagagaatcatattcttttgtgtatcaacctgatataattggaagggatgatgctagagatgagattgttagtaagatactaagagcagcagaacatcatgatatttttgtgcttcctctgcttgggcttggaggcattgggaaaactgaactagcaaatatggtgtatcatgatcaacaaatcagggagaggttcagcaagatgatgtgggcctgtgtctctaataaatttaatctgaaaaatatactacaagatataatcgagtctgccagtggtgagagttgcaagcatctaaacttggaacatttacaaaataagctcaggggaattctgcagaatggaaattatttcctggtattggatgatctgtggactcgtgatgtaaatgaatggagagagctgaggaatttgttgtcaagtggtgcaaggggtagtgtgataattgttactacacgcgaaaatgttgttgcatctatggttggtacctcagacccgtacaaggtgggtgcactcccttttcatgagtgcatgcaaatttttaccagagttgcattcagacaaggtgaggaaaataaatatccgtggttgttgaaaattggagagtccattgtgaagaagtgtgctggagtaccactggcaataaaatcattgggttctctactatttaccatgcgtgatgaaactcaatggctacgtgttaaagaagaccacttgtgcaaaattgtacaaggtgacagagatataatgccagtgctaaagttaagttacaatgctcttccagctgcccttaaaccatgtctttcctatttatccatatttcctaaggacttcgaatattacagaagatgcataatcatgttttggatggcacatgggctactgaactcgaacaaattgagtgaagaaatagatgttggtaatcagtacattattgaattgataggaagttccctttttcaagactctctaattacttttgatggaagcatgccacattgcaagttacatgacattgtacatgatcttggtagatatgttttggacacagacctagctgttgtgaactgtgaagggcaacaagtctcagaaacagtcaggcatctagtatgggaccttaaggatttcacacacgagcaagaatttcccaggcatttaatcaaagcaagaaaagctcgaacttttattagttcgtgtaatcatggttctttaagcaaaaaatttctggaagtgctgctgtccaagttattgcttctacgtgtattgattatatccggagttagaattgacgaactcccagattcaattggaaatttgaagcacttgaggtatcttgacctcacctggaacaaaaccataaaataccttcccaattccctatgcaagctcataaaccttcagacacttgatctttatcgaagtgaccaactaatcgagttgccgagagatgtaaacaagttaatcagcctcaggtacctgagtttgacatcgaagcaaaagcagttgccagaagcaggacttcgtggctgggcttcactaacatccctgcagcttcactcatgtagtgaactaacatcactgtcagaagggattggctcgttgactgccctacagatgctgtggatcagtgattgcccaaagcttccttctctcccagccagcatgacacacctctccagtctgcgagagctgttcatcgacaattgcccggagctggatttgatgcatccagaggaggccatggatgggctatggagtcttcgatcattgcagatcattggacttccaaagctagagcgtcttcctgacactctttgttctgcctcgggttctcttcggtatttattgattgagcaatgccccaatctaagggagcttccaagcttcatgcaagatctcactaaccatcagaggcaggggggtattcattaaggatttcccgagcataattatataaagggatgacaattagttgattactatctccccataaaatcttcatggaggtatagagcttatgctaaaagaaaagccccacaggaagtgaaataggtaagttgcattgttctctcagaaatttaaatctttataatttaatacgaattgcagtgtttgctagattttaggtttgggtgttaagcttccacacttgtatgattactttgtctaatataattcagttcagtttgggagatggatttttcatttttattttttttgcattataggtatgtatggaagtatagcaaccagtgaagctaagaaatcccttttaggcaccaattcaatggatttccttttgttgcagagaggaccaaagtacacactagctgggatgaaaaacaataactgagactgctcataatttgttaaccgaataggccacaagtttgaattacgatgctcattagggtgattgtaaggttgctctttttgaaatgtatagtgatgctctgaataccatgtccctgtttctaaattgtaatgatgcatttcaaatgtgccatgtctaattcagtttatgtttttcacatgtttaattatttcagaccttaattgaacttatatggtcgttcgaagtcctgtttgtatagaaatttcagtttaattcccgagcttgaaattttattatactcatatattgccagctgattaaatattccatatccgtacaagttttttagtttctcatttttatatgttttattaattcaaacactgctacagaaacaacaatgtgtaccggttgggaaaaccccatggatgctaaatttcccaaatgacacataacataacagggggcacctttgaggtagtcaaaggtgccagtttaggaaccggtagctttgaggttccagaaataaaaaaaaaaggcggcttgatcagctcgaaggataggggaaaggaaggatgtaggagatcccaatccaatgcacgtcagatcgcctcgtggatcccggtggtgatcggcggcgggtgttggtggaggagaatgggagggtggggaaggcaaggaagagtcagagatagagagagagagagaggagaggataaggccgagtacaagtactcatgggttcggcaaaaagtatctccctcccacccaccggttcggctcggctcggttttacgggcgtcggtttattaaaaaaccatcacctataatatattatagatgttgatttttttaatgaaatggtacctatgataaattaaaggttcctttttttagaaaaaatcagcacatacagtactggtttttctctagaactgttacttataattgctcaaatgtgttggttatttaatgtttcagcccttggagacagggaaaggtttatatatgccagttttagtacatccgtcacctatagtgtcgtcctctttgtgtatttgtgtggtagtgagaccttaattttgcaccttccatacgatgttctacatgatgctcacacatttggcagctgacaaaattgaattcatagccaaatttttgtatgtcttacatcataatgttattgaatttaccgtggaatttcatatgcgtagtaattttattatagattagtttatgttttctgtaggtgactgtaacctttgttcttttgtagtttctgtacgtagtagtagtttgtgctagcagaatgtttatgtccaatgttcagatttctgatattacctgcataggttagtatttcaggaagaggctaaaagtttgtgctaagtcttatattttcttctttatttgaatgatacttgcaaaatgcctagttggtcgaggcattgttttccctgttttattgccgaagaatggtggtcacaaaatagcgaaggtaaaattagacaaccatacaaagttttatggaaaatattaccagggctttgcccagtagctatatattaaaataaaagaacgcgtgtacagagaacataaaacaaaggccccagaacaaaaaaaccaaaaaaaaaagctaagaatgagaatgctaagagaatcctttattctgcaaacatgcagaagaatttcattttttaaagcaacaaaccacctattaagatctggctgaacattgttaaaaaacatggctatttcgctgcttccaaatgcgccaacaagcaaaacatataaagtccaagaaacctttcctccttagccaaaacctgcatttggcaaattttcaaattagtattccacctgattcccagacgctcccaacacatcttactgaaaggacaaatgaagaataagtgaagcaaggtttctcttggtcctccacaaacaccacaacacaaaacaacatcttcaggggcacaatgcctcctgtccaacacatctctagtgttgagtctatcccacagaagtaactacacgaaaaccttattctttttgatgcactttgatttacagatccaaatgaaaagccttggaatcgaaattcccaaaaagttagatggataaaacttctgagtagagtacacttgagaattccaaatgaaagaccaagaatctcctctttgagttttgaaagataaactactcattgcaactgaaggaactgcccataagcctgcgcttctagaggaagattgaaacaatcttctagatggaagccagaaaaatttcttacagattcccatctcactgtggtttgggaaaagagagcttagaacttaagttttctgtcttccccattccagatatcatcccaaaacaatattgtagtaccagactggattgagcatttagagatagctctgtatatattaaccaattgaataatatccctccaccaaaaagatcctttattaaagatcatgtgaggcacttttgttctgctgtaagaagtccatataagtctaacccaaggaaagtcttgcacagtgtaaaatttatgcagatgctttaaagaagcattagcagttaatctcctttacactctatccaccattggtgccatgtcaaccgctcttagtttgtagtatacccattggcaaacctaagtaagtaaaaggcatggtgcccacctttacatcccagcaacagagcaaattttctaatttatccttaggaacattcaaggggtaaatactggccttatgataatggatttccaaaccagtgtcttgagtgaaagtgtgtaaaagatccttaaggaaaaaaaaaatctctctaggatgcgtttatgaaaatgagggtatcatcagcatattgaaccactggaaagtccccctcatcttgcacatttataggtttagataacagtccgattctcatagctttatttaagactgttttaagtaattcaataccaagcacaaaaagcaaaggagaaaggggatcaccttgcctaacccctctcttgcacttgaaaattttcccagggactccatttgacaaaacagatgaacttgcagaactaaaaaccatcttcacccagtttatccattttgcagggaaacccatatgcttcattatttccaaaattgtagagtgttcaattgtatcaaaagcattttcaaagtccaatttgagaatcagaatctcccacatagactggtaacactgatggataaactcaaaagaccaaaacataggagaaaaagacaaaaacaataatagtgttattcgtatggttgtttatttacatatagcatgtgtgattttttttaattttttgcgaacatttataaaatatcttgttcaagttttcatgtaagatatagtttccactatactttcctagtaaccaatgtgatgcggacaagggttcctgatcttctgaaaggttttgataaacagtcgattttatggagtcacagcacaaattgatctggcttctgaacgaacatgctcttgagccccgcaaccgcagcaccacgtctactctggttatcaaccgtacgtgtcgaaacccggttgacctcaccgagaaggctaatccctatttgtgaatcgaagaacacaaacaagaacaagaaagaatacattcaaaatgtatatgaatgattaagctcacaagttggggtcttacaaactgaaggatcagcgaaactattcttgacagattaatctaagcaaaacccaaaccctaaaggtggcagcagctactaatatatagagtttagggtcatgcaaataccccttgacgcaaccctaatgggctccaacacgatacatagcccaaagaccaaaatacggcgacgcaacaccgaaacagattctagatgtcaacttgtttggtcgattcccaatgactcggaaagaatttggatatgggaccaaaccattggaaatgttatcttcttagctttccatccatataaagaaagccccaatccgagcacgtatgcgacctaggcacccattttagtgcagactggtcctagactacgaaacgtacttgaagttgacttggtttgggcctccatattgacttggacctccttgctgatcctccacacctctaagtccctctctaagtgtctccttgtcctctccattattcctaatcataatataatcattaggtagcaatctgttctcaaaatcatataaagataaacataggaacgagctcacatctaaattcaattgttgcgtgcgagctcttgtgattggttcttgaatgaccgatggatgattgttgtgtatatccaaaggagtgatgtcctcatcacaatgtgctcttctggcgctctcccaagatagggaggttggggagctctctggaaacaataagaaaggcgacaaacagaaaaatccccttctctcgatccctcttactcggttccggcagctcactgccagtgatggctgaaagaggggtcaagccccttcctactagtagtagtttagccagtatagtgttgggttccacccattcttgggctttttcccgtatcttcgtgcaatgtcctgttttgactgaggtcgccggagtcgttcctatggaatctggacttgctaataatggatctgatggtggcaagttccggaggcggtcgattaatctgctccgatctctagccatggcagattgacaaggtcagtagttgccaatgctaccttctggtgattactacgctggtgattccactgttcatcctcttcacatgtggggagatggcggtcatcaggagtggcagatctggccaggcagaagcttagtagtagctgatctgcttgcccaatggctgacaccatcgaccggtggtgagcacaatggtagtggctggtgacttcgttcgggtggatttgtccatgcatgccttctcatccaatacagaagtgccgatctcattagacgcacatgcaggtaggctccttctcccccagaatgatgcagtcaatatcagctaggcaaaatcacatccttcctagtgctagaatgatcaagggttcctgcttttcgg

SEQ ID NO: 61743 - DNA, 66987 bp, Oryza sativa
cttctccttcttcttctccgcttctagtagacttctagtagtagtaaacttggcgtcgcgatctccgcgcgctccgggtgcttcgcttcggaggtttgggaggatggcggaggcgtgaggtgaggtgagggagtgtgagatcgcgggggggcaatgtcggtgctgggcgcggagggggcggcgatgggcttcctcccggccgcggagcacggcttcgcgcgctcggcggcgccgtcgccgctgcgggaggaggaggaggtgctcgacgacgacccgaagctgccgccgttgcggatgcccacctccttcgccgcgttccctgggtccagctccggctccgactccgactccttcctcagcatgagctccacgccatcaggtaaattttgcttcatcaatgcgtgcgaacagtacaaaatctcctccagagagaggaagcgtgtgcctggggcagtatgatctcgatctctccgcgcgtgattgggagacgcgccgcctcaaattgtctgttttttttttgctcgaattctggtccaaaatttgtcaatctgtttggtggtggtggttgctgtttttgggttgatgtcagggctgatgaatccgtacggcgtgtggtcgccgcgcgcgccgccgtcggaggcgtcgtcgtcggagatggagttcggcaccgcgcgcgagtacgacaccaccgatctcttcttcggcgagaattggctctacgacgaccacctcttccacaccaattcggacggcgacgagggcaatggagaggacaagttcatcgttggcgctgactctaccgcccagtggagcgaaacgcgtgagctcgacgattgcggcggccgccaccaagtgcacacgaaatccaaggccgacgctgaagcctgcgcggaagtgtatacctgctcttcagcgccctgcagctgctgctacggagggaggaagaatgatgatgggttgacgagggattcttgctctgctgtctatgggaggtacctgatcatggatgaccagacagaggtgctggatgagtgtggtgcagatgcattcctgttcacacgggatggagatgccatgctcaaaagtgaacagccaattgattccaaaggcggagatatcgagttgctggacatgagtacggtggagaaggagcttcagatgctcagtccgtatttggctgaggcagatgctcttgagagtgagtattttctgacttgtcctcttaattatgttcaatcttgcagttcacgaaatccttgaagctcattaattttgttgttgtactggatccagaatactcagttcatttctcagaatttatttcacttatccttgcaaagttttgttttcttgtggactagttggttttaattgtggttatctcttgcagaggctgagcttgaacacgatttcagcggcaatggggaactagatattaacgttgttacaaacgagaaaactgccgatgacaaagaacttctaaaaaatagttacagcatacattctttacctgagataggtgatcctctagatgtttatgagatggaggactttggacgaacagatacaagtgttcaaaattctacagccaataaaatcgctgaagatgcgagaacagatattgatcttgcactttctagatttcatgaggaatatgaggtatttgagctgagaattttccaccggaagaacaggttcgtcatcagatgctttcttttttttgtttattcttccgccatcatgtaaatatactttccatgctcatgtcataagtgttctttgcaggactggttttgaggaaaacaaagagttccctattgtcatgaattcagttgtaggtggaagatatcgcatcactgagtatcttggctcagctgcattcagcaaggttgtacgggcacaggatctttggacgggaatggatgtctgcctgaaaataataaaaaatgacaaggatttctttgaccagagcttggacgagataaagctccttaaatttgtaaacaaatacgatcctgatgatgaacatcatatattgcgcctttacgattttttctactatcaggtatgtgatgtaaagataaaatgaacacaatcttttggtgtgctttactcaatctcattttgtaccctgtggaatgctgtcatccaaaaaaatgacaggaacatcttttcattgtcactgaattgctacgggcgaatctgtatgaatttcaaaaatataaccaagagtctggtgatgaagtgtacttctcattgcgcagaatacaggtatgcctgactgttattcccttttccctgagagtatctccggttgtgttgttatgaaagcttgtaaccatcattttgtctgttaattttatgaagccttcattactaaagaaatcatggaacgatgcaaaagtgtttacttctgttgttgcaatacacttcagttgtaaagaaatttctcttaagaaaaacagttgtagagaaagatctcttcatccattgatcttccatgattaatatttctctgacattctgttttatggaaggttaaaataaatacttctagcatgattaagttatgctgtaaaaacataaaaaatcctgctgaaatatgatatgttgttgtttttcaggctatagctcgacaatgcttagaagctctggtgtatttgcatcatttaaatatcgttcactgtgaccttaaaccagagaatatcctcatgaagagttacagcagatgtgaaattaaggttattgatcttggaagtagttgcttcttgacagacaacttaagcttatatgtccagtcacgttcttacagagctcctgaagtcattctaggtcttccatatgatcagaagattgacatttggtctctcggatgcatcttggctgaactgtacactggtgaagtaagttttcaactattcatctttacttactaatgtccatttgtcggtactatattacattgtcacgacatgcttacattttgtctagggaaattgatgtatttactcagtcgaaggaaaagaaaagtacaaaccaggatttgtccatggttaaatgaattattgtgccttttaactcatcccgcaattgctgcagtcaaggttttgattgtgggcttgtggctaatgttctttcttgtataactattcagttcatcccaagaaaattaccacctcctcaattgtcatagtcttgaaatattggtagaaccttcattgttatcgcaacactgttattaattttaagaaactgtatgcagaaattggaagagtgattcaagtgcttatggcttatctgcagaacatttaccaaatttaagaaatgatctattagtaactgtaaatataccggggaatccccatcatgtttctttttatctagttccaattgaagatattgtatttagtatttaccacttttgttaaaagtacttgaaacataaaaattgttttgtaactgtaaaccaaataagccaatgctctcttttttttttctcacagagacaatgtgattgagatctttcttatacatgtggcaggtgctctttccaaatgaatcagtacaaataattcttgctcggatgatagggacaattggtccaattgacatggaaatgcttgcactgggacaagatacccagaagtactttacagaagactacgacctgttccacaagaatgaggtacatgctatttcttgtgtactttcttctgtgctggacgtattgtcaatacttaagattaagaaaccaatttaatttaacaaaaccaacgttttttgctactttatgatgcaactcttatttgaaccaataatcagtggatgatatgcaagatttgatctctctttttggatcctctttgtgctacatgctttaaatgttgaataccaccgacaatatcattgacaattaaatctctcttaggaactgcacttagctcatttggtgccatactgccatgttcctccttactactcagttttaaacggttgcattttttttttgtttctgtagaatcttatatcaagtgaagctttactctaaatcttgttatagaaaatattttgagtcgttaagaaatgatagctgacaactaaaactctagtatatgttatattggtggtagaaagtttagtcagaaactgagagccttatgttcctgtcatcttaatgtttctttgcccaaggtcttctgtgattgggcacccagattgtttctgtactttcgtgtggatctggttcccaactcaggcgttttggctgacactgttgtttgttagcgtgatctttagaacaagaatttcagttgttccccgtcactcagtttggtactgttgccagtgttgttcaagcgatgccattaatttcttgtccaacttgttttaggagacggatcagttggagtacttgatcccagagaagatttccttgcggcgtcgcttgcagtgccccgacaccaaatttgttaaatttctttcctacctgttacaaatcaaccccagaaagagaccaacagccagtgaagcattgcagcatccgtggctctcatatgcctatcagtgagatgtcaaccaaatgtgtttatacgggatggatcgtttttctgaagttccatttgcaccaggatttggcttttccgtttttttcagggcagtccttggttagcatcgaaaccctgttttccgagatgaatgcaaacttgctcgtgcatgtaaatatgagaagaagaaaaggttccttgttgcatatatgtatagctgtcactttgatgtacttcacccaactcatcaatagaaatgtgtttcaagtttcaacatacccgggtctatctttggcgtttgctctgaggcacttcacctaattcaagtttcaacggtcaagtgcgatgtcaatgatcttagtttatgatgttgccactaaatcattcattaacagaaaagcagtaacattgaaaatttgaaatccaaacatgtgaaaaaggatggggggcacaaactaactgaaatctgctggaagcctaaataaagaggggatcaaatacaaggcctgacatatgaaaccaaaaaaatgcacgatgtagctccaaaagaccatcttaaggtcacaggtgccactgaatcatcgctgtagaaccttgatcaaaatttacaagccttcaggaactcacagaccattataactgtcagttagattatcagaactgtcagcaacaaaaggtcactatacaacaataaatttacgctcaggatacaaatagtgatctgcgatctccgtgtcgaacaatggcttcgccatacggaagggcctggatgaataacattatatacaagtgttatctccaagagtataggtggcctttgagcctttgcctaataatccaatgccctggtggcaaaacttatgctgcttgatcaatttgtgggatcccatgtctttggaaccactctggcatgtgaaatgtttcatacaatgccggtctaacatcattttgcagagaaaggtgcttgagaagtggaaatataactcccataagctaaaatgtttgagaatgtcagtggatcagtacaccagaaattgtatgttcagaacaaaaaggagagttatctaaattgtaaccttacctgatcatcaacaggttgtccagccgagaatgtaagacaaggtattccattcaatggttgcagcaggaaactatatggattgttatcaacaaggacaattctgtggaaatctttcgacaaacaagaaagatcttttacatgctctctatattccctggaattcagcacacggcagcgtcaaataagtgaaaagctcagctaacgcagcaggtagcacaatttcttaaagaatatgtgtctttgactctttgtgaaatcaagctggtagcaaaaccaggaagacatgaataagttatgatcaacatgatatgtgaattaccaaaaacatcattacaataattcagtttcacataaaacagctatacattagagattccatgggcatgaatcggtgctacctatgggtgggcacttgcaatatttaagtttgtgcttgcaaaaagcctcccactaaaatcaattgaaatcacatctcaatatttcagtgagcaagacaataattcattaaggcactatggaagtcagaagcaaaataatccattatttacaatccacaaaaatgctaacagtaacttacgtggtaacagttgatggcctgtagagacggtgacagaatctgttgtgagcatctatcctgtcaactaatggttttgcatatcctggagagaaaagcacaggttactaaaatgaggtgaattcaattgagttctagttgaggatcaatatgactattcaggtaacagaccttctaaaccagcagtgaagagaataagatcagcaaattcgctagttctctgcaaaaattcgtgcaaaccaggacgctcaaatacagtaacacggttcaccctctgacttccctcagcatcctttatatcaaggaaaatacaaactctgataagcaacttcctggattttagcagaatatcaataagaaaaggatggcagcttacttgccttttcagcggatatgcactccatgtcaaagcaatgcagtcctgcttcaacagcctcggcacgaagagcagcaggaagacttgatgactcatatgcacaaactagagtttcatccaaatcaagcactacctggagtcgagcaatcccaattatatgattgtaagttacacaggtggatgataagtttattaaaaggggattagggaaatcagtcgatgtagaggataagttcattagaggggattatggaaatcagtcgagtaatcccaaatatacgattagggaaaagataggttcattatgtccttgttcggttaatccctcctcgaggccttgttcgtttaaggattaattccacactcccttaatcccctctaatcccttttctcctcaagaggatcgaattaataccgatattaaccgaacaagacctaaagggaatcgatatgaacacaacaaagatagatagaaactaggtctaatacgctgtcaatggcgactcaatatcagtataattaacctgctatgtgtgaaatgaccacaaattagcaatagtagtttgtacgatcactcaacagtcaacagcaagaaagtgaacacaatacacacagctcgctccaaagatgcaggaatgaactaacacacatctcggtccgtaccgtgagccgcctgagcggcggcggcggccccgtcgacgacgcgtcggcgggagcctcggaggggagccgcacgaaggcgaccgacggcgacggcgacggcgacggctggggcggcgcggcggagaggagagggtggcggagcccgaggaaggagaggaggtgcgcccaggaggaaggcgtgccgcggacgatctggagcaggatctggaggaggaacccgagccaccccaccaccgcccgccacgccgcctcccccggatgctgctgctgccgcaccggccccacccccgccgccgccgccgcctccggcgacaagaactcggccgccgccatctcccccccgcgccggaccacggggctgggcttgctggctcccggagtgcggctgcctgggcggctagggggagagctcggggaggaggagagcaatcatagggtagggagaaggagaggaagaggagggaggagtagggcaggtggccgacggagtgtgggagtggatgtcgtcggtctttgccctgcgtcgtcgtcggacacgagggagggcttcggcttccctcggataaacggtggaattcggtgacaggctgacatgacagcccagccgagattatacaaatcagctgttagacatgttcttttctgcaacgaaaacggtataaaaggacctctttttaaactgctaaacgatgtgtttcgtgtgaaaactttttatatgaaagttattctaaaatataagattaatctattttttaagtttataataattaaaatttaattaatcacgtattattatcatctcgttttacgttaaacacttaatctttattttcatcttcgttcttcaggagatatcaaacaccaccttagtctcaaatctgcattcgcaaaggaataatctttcttttctttaaaaaaacggaaggaataatcacctcataaactcacttcattgggaagtactccctaacagtgaatcaaattagtttcacagtatactttcatattatggcctattcactttgatgaaaaaaaccctaaccaaattttgccaaaattttggcaagttgtcaaggcagaattttttatatagttattaaaatttggcagcaaactaaatgttgccactttttttggtaattttaccaaaatttggtagggttgaaaatgaccctatatttgttttgcgataaaaatattactatattttttaaaaaataacttgattatatttatgtaagtttaacttagaaaaaaaaataaaacgatttataatataataaaacggagtactcaatcacccatatgcactcaatctagattaaacctcggatctcaatgcaaattatacggatgatgagctgtggtgttgccattttttttccagaaaactacctacacctgaactggtaatatactcactacatccatttcaacataaagaatttcttaatcatataattaattatacggacaaaattcattacattttggggacggagccgtgcacgtaaccactcgctccaatttatcttctcacgtccaggtcccagccctttggtcgcgcgagaaaacggaacaatgctgctgtgtgcagcctgcagccaaccaaccaggcacgacacgtggtgcggatcgcgaccgaagcctcacaaaacgcggttcatagccaccgtgccaccgcccaccgctgcccagcaccgtcccaagtacaatgaacgatttttttcaaagaaataatgcagctttaataaaaaaatgaaaatagatatcgatcatctaaaatcataaatttaatacctcgtcaaataaccattgtttaataagttttaaaaacttaaaaacttgagatgtgagtatggctgagtttagttccaaactttttcttcaaaattcgaatttttccatcacatcaaaactttcatacacacataaacttttaactttttcatcacatcattctaattttaaccaaactttcaattttggtgttaactaaacacaccctacatgcatatgagtaggtcgtgggacctatcgaactttggagcttcaatagaccacccatgcttgctactcctatttctttttcttaatcaagctagttaacctatggaatagcctgtcgaacaatgattatcgaacttcagttgtttgagagggtgttaaatttatgatttttatctatcaacatatatttatacattttttcactagagttctattattttttaaaaaattctcaacaaacactcggtctaaattatcccgtcacattacatcacaccacgtcacagtcaactcactaaaatgcagcagcaggagtagcagcgaccgatccaaaccccagccctcgcgccgacggtccgagccgtctcgatcaccacgcagctcatcatcccctgcgccgaagggaacagatcagagccagccgagccagcgcggcgcggtcgcctttgccctgccctgcactgaccgttggagagccaagcaacccaacccaagcgctcttctcttctcctcctcttcctcccaaatcgatcgggatccgatgcgcacggaggaggaaggagcatggtgaggacgcccgagaggagctactcctgctcctccgccaaggaagtcgcctacaggttggttcgcttcgatccccttcccccttctttttccgctgcttggatcaagaacacgggttctaggagaggctaggataggcgaaaccctgggttgaatcattcgtcttgattagtgtacttagaagagtgtttcttgggttgttcaagagtgcagttataaattcgatctgtttgcagctgctgggctcggatggatcttgaaatttcttttaattggttttgactgttagtgattggtgtgcttgctaatggctcaaactggactgatcagaaagcgcaccaacttcgatcagctggactgaaaactgaattagtggcacttttacttcttgtgacagatcatggtcttttgttcaatagaaggaattgaatgtgacattacgtttggcttgctgaaaagtgaaaattacatcctcatacctgaatcgacagtttgacactaacaactctcctatgaaacttaatttttaggattttgattgcgtattgaacacggaattgtcattttcgtgaaaattgtgaaaattttcttttcgtggaaagtggaaacggtagcatggtgatatcagttgtgagaaaggattcagggtcaattctcatggtgtgtgcaactgtatacacgtcttccatgtaatggaaaaaaattatctgatggtgtgtgctattctaacagctgtggttactgtggctatgcattgaacctgagctcctcaacacggaacacagcgaacattggatccaagtatggtaagcagatcaggaaaggtgtaatctcattctttgcgatcgacgagagtcggttcacacaaactgatgaggtgagctgcatgccatacttccattcaaggcgctcctggggtttgttcagaaagaggacaaggttgatctgccgcaaatgtggtggccgtatcggtaatgcttatgaggatgaggattccacattgtatgatggttcagatgatttgcacatgagctccgagggctacagcatgtcgagtggaaagaaatatgttatcaagattaatgcactgcagccttcaaccgatgactctggtgttcccttcaccctgtgatgctgttctgaacttctgcagtatgcacttttcgattcttgccttgcgctatactggactgtcaatcaagtaactgcagaaccaagagattacgtgctagtgtgtaactgtatattttgataggaatgctgaattttgcctacctgtatttataaaatggaagagtttgttgtctatttacatatacattcagagttcagtgggtgtgcaactgtgcatcatggacctggatttggcaatccatatttgggcaaatgtttagttagaaatcaggtttctgatgatgttcagtggtgtgtacttgtgtcttgtactgaaatattgtagtgtcttttgattttttgtgtatctaaagaatgatgtaaatcttcagctattctaaacggcagtttttttttgtttgtgttttgaagctatgccaattaatttctgccactaatgttgatatgatttgaagtgaattcctgtgactctgagcaatgctatgccattttcagaaattgcaattgtgagtaatgtgcaagagccaactgccaagtgcagaaactcattgttaaaattttcctgcggagaaatctattgaatctaaagctcagatgaattttcctgaaactatccagatttcaggctaattcagttgcaagaattaactgaaactaaagcacagatgaatttgctgagggaatacaaatgcaactgcagtaacagaaataactaaagcacagatgaatttggctactgcagtaacagaaatataaagtccaaaatattaaacgaattggatctatcgtcaaattaaagcaactcagacaccgcttgatattctgcaaatccgctgttcttagtattggtcagcgatggtcaaatcaatatatagcacatttcaagatgtatcagcccaatatgcaatgtagatttcaaccagaaacctatatcgaactcagcctaagttcaccaaatcgcactaaccaaaacaaaatttcatcccaaaacggacaaacacaaattgcacatcaacaagaggacagatccacaacattggctctgaaacatgtttcaattcaaatcccagttgcaaacatcatttgcttcacaatttcatgattcaggtaaacactagaaaaactaaacagcgaactgaacaaggtggattccacggctttccatcaaactttttttcttgaccgcaagacttgtgggcacggccagacgacatgggagagatggcggagggaggcaagatcgatcagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatcagcccggagatgcgcttcacgccgcccctccttgccagcctccggatcgccggcttggtgatcccctggatgttgtcgcggagcaccttccggtgacgcttggcgccgcccttgccgagccccttgcctcccttgccgcgccccgacatggccgccgacgacgacgattccggtggctcgacgcacgagagagagagaaaagcgagtggaattggagaagaggtggtggtgattggagtgggatttggggaagaaaggggagggggttttaaaaggggacgagaggatggagtggggaggcggctgccgttggatgggggagggaatggacggtgaggatctggatcgcggggggaggagcggatcgttgacgtggcgtgaggcgcggatcggtgatttggcgggatagtgggaattttcgtggtctgagaggcggccagctcaaaattttgacctgcaggcgccgccaaatttggcctgcggcgcggccatgggactatgggagtagggacttggcgtttggcctttgagagatttttttcactgtttagtgtttacgaatttccaagggtcagtttttttcttaaaagtcaaagctgattttgaaatttgaaatttaatttttaaaagtgattttagatagatctgtacttgtgattttacagtcatttcaaaataaattgcgcaacaaatgtgacggagaaaccacccaaaattagccctagaaccaattatgagaattcaagatcaattgtagctctttcagtaacacactgggctgcgttctaaaataaggttgagttaggctaatccctcatttatcatgagcatattttccaaactactaaacatatattctataaaaaaatactatatatatataatatcaaataaaattatttttaattttataatagtttatgttagttccgtcctaaaatatacttcatccatttcatattataaaactttctaggattatcctgtctatctagattcgttaacatttatatgaatgtgggcaatgctagaaagtcttataacctgaaacggatgtagtatcatataatatcggatagtatatgtagtattgtatatatggatctcatccggtgttagattactatgttttataatggatgagctactttattaatcatgtgtaatgaataccttgggttccataccagtgactagctaagcccaacccaacagttgtaccaaactcaaccttagaaggttcaatatctacgattgttgacgaaaaatctgcactcgcccaatggtacaggaactgtgttggcgcgaactaagtcgacgaacacaatgacctaggagatctgcttagttctagtgcagacccaaaggttgatgagatgcaggcataccagtcagtttgatcctacagcaagtgataaaatatacaaatagcatatcaatgagccgatcggctgtcaagctgatggagtaatccagccaatgtcgataccagccgatgtcaatagtgtgttgagcaatcggctatatgtctaatgtagataatgatatagagacaatctgtcagggttacgggttaggcataccctttacccttcgatatacgttacatatcggtatggcatacccacgcgcatatggatacttcccgcgtacactaaggaaatccttcacgaagtctacggatgggaagagtcttactcggacaagactgggtcatcaatgtatcgtatagggtctgttatctccgagttctacttggaaaccgcctgacctgcgatataaaagggaccccccggggaggacctgaggcatcgaatctcagagccaacacaaccctcacagcctacgaagtcggagcctgcaaggagccaaatcgccggggatctagtcgaaccaactcgaccacgatctcgccggatccgtcaagttccattgttccctttgtaacctgtgttttctaccatataatcccacatcaactggattagggctattaactaccaaggggcctgaaccagtataatcctcgtcttttgtctgtttgatgtcgtattacgtagattattgtaccaacgtaccccaataccctctatatccggtctacgggtaccacccgtcgacagtggcgcgctaggtagggggccttggtactcaaggttctactactatgtcatccagcctcgtcgacaacagcgtcaacaccaacctcagccaagtattccctgcttcaacaatgctggtgtagactcaagtcggcgaaatcgtcttcccggtttacaccacgacgccgatctcaaccggtccgtcaatgactggaaacgagaacgcagtggctacaaaccaaggtgactccatgtcaaaaaatcctcccgccgaggcggagaacggagcatcgacgacatccgagctcgagaaggattctaatgcggccaaaccttgtcgttccgacatgaaccgcgagccgacgaagatgacttctgaagcgacaaggtcctggtgtcctatccacaaaaccaggaaacacactttgcaagcctgctgggttttcctcaacgtccgcgctgaaattcgcgcctgtaaagagcgtggaattcaacgtatttctccaactcgtgatgtctactgtcctattcacaagacaaagaatcacgacctctcaagctgcaaggtcttttccagcgccatggaagcgccatcccctaaggtccaacaggcacacatccccatcagggataaagacaaggaacgaggagcgatgccaacttcagatcgatttgttggggtaatcaatatcgatcctcacgaactatcagtcttgcaccttcttgaagactatgggtcatcgacaacaagcgcgccgcgggaggtattggctatcgatgatgtcggcatatcagcgtgcaccaatgcagaaacagagaatcaattgaccactccagctcagcacatcagagccgtcaacgctataatgagggaaaccccctacggtcccgttctaaacgacgatctcgcgcgttggacagaatgactacgggaatcagtgaccaacctcagcaacgcgttcgaagaggccgctgccgcagcgcacccagagcagccaccaactggcgatgccaacggtgaaaatcctgaatgaagggaatcgcctcagcgagctacccctcaacctcgcggcactggcgatctccgagatcacatcaacggccgccgagaggcacgacgcacacgagacaatgagaatcgttcccgacgtcatgtctcttcacggcgccatgataacgaagatcgaggagaccgctcaaacgaggaccgagaccgtgataaccgccacaaccaccacgatcacaacgatcacaaacggcgggtgctagacgatactggttgaggacgtcgccataacgacgactatgatggagaccggcaccaagacaacagcgggagacgacgacaggattctcgagatccaggccgacatcctcgtaatcgtacgccagaaccaagcgacccatcgtcatcgtcatcatcctcgtcttcctcatcatcagacagacatccacgaaggacacacgatcgccgacaacccaccgcccccagcgctgggtgtagggctttcagtcgttccctacatgatgtccgatggcctgagagattccgacccagagcaatagagaagtacgatgggagcaccgacccagaagagttccttcaagtctactccacagtactctacgctgccggagcagacgacaacgcattggcgaattatttgccaactgcgttaaaaggctccgcacgttcatggctgatgcatcttccgccctactcaatctcttcgtgggcagacctgtggtagcagttcgtcgccaacttccaaggaacctacaagcgccacgcgatcgaagacgacctacacgcgttgacacagaacccgggtgaatccttgaggaaatatattcggcgcttcaacgagtgcagaaatacaatccttgaaatcaccgacgcttttgtaattcgcgccttcaaatccggtgtcagagatcgctatactacccaggagttggcgacaagacgcatcacaaccactcggagattgttcgagattgttgagcgatgcgcccacgcagatgatgcgctaagacgcaagaacgataagccgaagaccgagggagaaaagaaaccagccacggacgcacctgagtcaagcaagaagaagaatcgcaaaaatgggaaaaggaaagctcaagcggaagtcctcgcagcagaatacgcgaaccctcccaagcgcccagacccacaaagtagcaacacaaagaaagcttggtgccccatacacaagacgaacagacattctttggaagattgccttgttttcaaaaaatcgctcgagaagcacattgcatctgaaaaaggcaaacgagtacgcgtggtcgaaaaggacgcggaggcggctccctaggaatcggactcagcatatccagactctgacctccacgtttcacacatcttcggaggttccacaacatactcctcgaagcgagagtacaagaaagtggaacgcgaagtctgttcgacatggcagggggctgcacccaagatgaagtggtctgaacagaagatagagttctcggaagaagaccaccccaagaccgccgtcattcctggacgatatccgatcgtggtcgaacccactattcggaacatcaaggtcgcacgggtcctcatcgacggtggcagctcaatcaaccttcttttcgccagcactctggacgcgatgggaattccacaaagcaagttgacaccaaccgatcaaccctttcatggaatcactccccaatcctcgtccagaccattgggcaagattacgttgcctgtgactttcggccaagccaacaacttccgaacagagcagatcacctttgatgtcgctgaattcgatacagcttacaacgccatcatcgggagaactgcacttgcaaagtttatggccgcatctcactacgcgtatcaagtgctcaagatgccgggaccgaagcgaataatcactattcaagggaacgcaaagctggaggtgcaatgcgacaaacggagcctcgacatggtcaagcaaacgcccagcccacccgccacaactgagccacccaagaaagtgagcaaaacaaacaagacgccgaaaccggacggcgcaatcaagattgttccactctccagtgccaaccccgacaagaccgtcaagattggggcgacactaaccgagaaataggaactcgcgctcatcaccttcctccgcgacaatgctgacgtgttcgcttggtagccgtccgacatgccaggggtccccagggaggtaattgagcacaaactcatggtgcaacccgatgccaagccagtaaagcaaagactgcggagatttgcaccagaccgaaaacaagccatacgagaagtacttcatccagaatggctagccaatccagtcatggtgcggaaggccaacggaaaatggagaatgtacgtcgacttcaccgacctcaataaggcgtgccccaaggatcacttccctcttcctcgaatagatcaactggtggactcaatagccgtctgtgagctgttgagctttctcgacgcttactctggctactaccaaatcagcatggcaaaagaggacgaagagaagacatcattcatcatgccgttcggggtattttgctatgttaagatgccgttcggattgataaccgcaggaaataccttccaacgcacggtccagggcgcacttagcgatcagctcggcaacaatgtcgaggcatacgtcgacgacatcgtcgtcaagaccaagacatgcgactcattgattgacgatctgtgggaaacgttcgacaacctccgacgatatcgcctcatgctaaatccagagaagtgcacgttcggagtaccatcgggaaagctgctcggtttcctcgtctctggcagaggaatagaagcaaatcccgagaagatcaaggcaatcgagaacatgaagtcacccacaagactcaaggaagtacagaagctaaccggatgcatggcagcattgagcaggttcgtcgctagtatgggagaacgagggcaacctttcttcgctctgctgaagaagcaagacaaatttgtatggacacaggaagccgaagaggcattcgttgcactcaagcgctacctatcaaccccctgtacttgttgccccccaacctaatgaagaattattcctctatattgccgccacgccatattccgttagcaccatcatcgttgtcgagagagagaaagtacaacgaccaatctactacatcagcgaagctctccacgacgcaaagacaagatatccacagatccaaaagcttatttacgcggtcatcatgacatcaaggaagctacgccactactttcaagcccacagagtcacagttgtctcctccttccctctcggtgaagtcgtgagaaacaaagacgttgtcggccgcattgcgaaatgggtgttcgagctgagccagtttgatgtccactttgcgccacgaacagccatcaagtcccaggtactcgccgactttgtagccgattggactatgcctgataacaaatcagacaaccaagtcgacaacgaaacgtggactatggcgttcgatggtgcactcaacagccaaggagcaggggcaggatttatcttgatgtctccctccggagatcaattcaagcacgcaatccacctcaacttcagggcgaccaataacacagccgaatacgagggactactcgccgggataagagctgcagccgcacttggggtcaagcgactaattgtgaaaggggactccgagctagtcgcgaaccaggtgcacaaagattataaatgctctaaccctgagttatccaagtatcttgcagaagtcaggaaactagagaaaaggtttgatgggatcgaagtcagacacgtctaccgcaaagacaacatcgagccagatgacctagcacgacgtgcatccagacgagaaccgctcaagcccggcacttttctggacatcctgacgaagccatcagtgaaagaggttagcggcgaagttagcccggacaccctgtcgcgaccgagaaaaatagattttcccgaatgctagtgtattaatccccgtcccagtaaaagccggggtacaccacacaaacatgatataaaagacacatctttattatatcgataatatttacattattacaaaggcacttaaggcctgacaataaaaaataaacagtagcggactagcgggcctacggctccatcttcacaggcgctcaactggggtataagccaggactccacctaagacttcttctccaaagcttctcttactgaaggggggagggaaagattgagctaagaatgagtataaccacagtactcagcaagccacaccggtagatgcatgattaatgcaagggggtacaaggggtaataatataggggttaagttttgcagtaaacagcatttaaaattcacttagttgcccaaagctattttataaagacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccatattttagttgttaagtaggttttaagaattaaaacactaacttgggtacattgctaggcttgcccataatcgagggcgcggctattcgaataggttatactttgatcagaggtgtacatctttacccacaagacacatcttcctcacatgtaaccacgtgccacataccaccacggtatacggacggaagacgtgacatagttcccaacccatcctagccataaacaagagtaccgacccaaccccacctacggccggaacctccgggacaggcaggcaggattgagcccatagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcaccttgagcccagcctaaaaccattttgggggttttgaatagaggtggaggtgtgtgtccaattccaacataagccaaccactccatagtgtccaaatgatatgagaattcccaaagtctaaagttataaaaccacctaatgttgcctaattaaccagcgaagcatctacctaagttcatactagtggaaccataaatagagtacccactagttggggttttattttcctagggtgaacaaggtaataataacaatagaaataataataaggtcataacaaaggtaaataggcatggctaaataaaacagtgataacgcaggaatttaaataaagcgataatgcattaatttaaatcaaaataattttataaactgggattcaatatgctcaaggatgatgtgactttccttgctcagagacaacggccttccgaaccttcggcgacgaccacgaaccatgcttcgggaacctccggaacgatagaagctacgcgaagcacacaagcaaagctacaagcctataaagaagcaataacaatacataaaaagaaagcacacagttctttaggttataacaaacattaggagacttgaacggatcgattcggagctcgtatgaccaagacatggtcatccgaagtttaatgctgttatatggagatttgcggattattataattaggttttacaactataaaacatgtgtaagcgctagcctggaaaagacaggaaggctgcgccgttgacatacggaccccacatgtcaacctaaaggaccgcggtagaccgagtatacagagacggtccacgggtcgatggaagcggaccccgtgtgtcaaccgaggcgagtagctgacaaacggactccactagacaccacgcgggccgcacacgtggaaacaacgcggctaccgagcgggcacactaacacggacaccacacacacaagcgaacgattaccaacaccagtacacgggtaccggcgtcgacaaccgcacaacgggtacggggcgacaccgaaaggacgaggacggggcagcgagaggagagatccttaccaccacgcgacgaggcgagggaacgacaacgacgaacgagcgcggcagagacggccgggaacgacggagacgaaaggcgaggggacgacttcggcggtgatccttggacgaaggcgagacgcggccggcgtaacgcttggcgatgcggaggcgaggacgaagacgacgacggggctgcagcggcacacttgacggacgcggacaacggacgagaacggcttgacggagggacgaacgccacgacgaccgggaacgacgagaggacgacgaccggaatcggcgaggaggcgacaagggcagccggcagcggctgcacggagacgaggacggcgtggaacgcgctgctgcgatgaggacgagggtggcggcgcagcgagacgacgtgccgggcgaccgacgggacgtcgacgttgaggacgaacggagacgacgacgacggacagcggaggggttcggatggaggggaggcgaggccgagggagaccttgccgctgcgaggccggaggagatgacgacgcgatcgaccggggaaattccggcgaggaggatggagaggtcggcgcggcacgacggtgttccggcgaaatacgggcgacgccgtggcctggccggggaagaggacggcgttccggtgccgggagaggcagcgacgacgaaagccgacgctccggcaatgcggcacaggcggctggaggtggtacagtggcggcaacgccactgtacaccagcgaggacgcgtctccgatggtccccgtgcgaaacggagggcaggccggcgtagaggggacacctgcgaggccgaggaaggtggtggcgacgtcagccgccgcacgggcgaggcggcacaggcggctggagggtggccggcgccgagggaagagaaggaggaggcggggagaggtggtgcggccacgggggagctcgggaaggggctaaaacgatagaacgcacggagggggttccattttataggtgaggggagggagccgggcatgggagagggcggaacggtgacgggaaacacggccggcggccatggaaggcggccgggaatggcgcggccgttccgggcgattgggagcgccattcaagggggaaaacgggggaaatcaaagaggaatcaatggggattaattccccctatttaattttggaatcccatgattaaatcgcacggatttgagggaggaaaggagctagggttcacgggagagggaggaggccgtgcgggaggaggaagacgaccggcgcgtgggccccacgcggtcagcgcgcgtgaggggtgggcggctcgggaggctggggcggctgggtggcgcggcttgtgccaggcggccggcccaggaggagaagagggagaggcggcctaggggagagagggaggaggagggagctgggccgaggggaaggagaggaggcccaagagaaggagggagaggaagagagggagagaaagagagggaggaagagaggactttggccgcgggccgagagagagagagaggggactttgggccagttggcccaaagggaggaaggagaattatttttagctttttctttttaataaactttgttaattgttgttgttgtttaataaatatttccggtgctctgaaaattcaagtaaaatttgagggctccttttagaccaaggagaatttaacaaaaaattctccgggctacattcgaaattttcttgtatgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcaagaagataggttgggcggtcttctcttcttgtctgacttcttccatcgcgtcttttataacaaacttgcctagcaaaacttctccactctggactgcttggctcgatctcctgttgcagatggaatcttctcttcacccgacttgtccctggttgcacctttaactgactcagactaggctacggtagttgaggatggggcttcagttccagaacttcttataattcatatctttggcgtcaacctcatacaagttacccacttcacgttatgcgtcgacatcagcttgtcattactaggataccatgcttgtcatcatgagaatatcatgtttgtcatttacttctaacttaccactgaatgctttggactatgatatcacgcttatccagcataccatgtttgacaacttgccactaactgcatcatattagctttcctggtctccgggtgctagatactattgctattcgatgcaagggtcgataacttttgcctttgaattacatttctcaatagaaccgacttatcccattggtcatgcttcgacgacttctcaaatgactttacagctggacttgtaattgtctggttgttatcctgccaaatctgaagattcgttgttagatgtgattttaatctgacctctgtagattatcttcgaacatatcacttggttcataactgggaatagctctcatgaacaagcagctcggattcactttctttacattcagtttacttcccactattatcttcaggttgtcattatttagcattcaacgtattcctttacaccttcgaccttgatgagttccttcccattggatcatctcccaagacatggcattgcctggtaatcggtgcctgcacttttcactccgtgtagcatctgataccgagttgaagatttcactcctcgccttcatggaaacacttttacctaggtcatcttgcttactcatgatttttttttacctcaatgacaaggtgattgttgcggggcaattactatcaggggtcttccttgagcgatgcagagcatgtttttgtttatcctttatcaatcacctttcggcctacttctttcctgctagagaacatctttgccaatctcttttatcaatcatctttcggcctatctctaacaggtggtactctttaatgtgggttgcggacgcttctggggaggatgaggtcctttggcctgctgcctttcagtgaaaccttgaagtggtttgtcaaaaattagactaacggttgttgcctttgatccgaagaagacacatctgaaactcttagtccaaacaaaagtcccttttggctttttaatccaacacagtttaattggttttcttttccatcaacaggttggttattaactcgaggttagaatatgattcctctgaaatgagaccctaggtctcctttgacagtaaacaattatacacataatgccatatcagcatcttccaaaagaatcctcatagaacttgtttttattacacatttctcccttattacatgaatacaaggccctaccttaaacaaaaagggaaggtgcttaacatcggtacattgcatcctcaacatgaatcatccataaacatagcaaactcactgtttataaacatgaatatatttatttattacatgattgttgcaaactcccgattacagtgataggtagcgaagtgaaaatcacaaacatggctactcattctgattttggagagatatagctggcattgttctagtgactgcatcatccttgattggttccgtgatgatgtgataggactgcatattgctatcattcacaggagaagcttccttctgattgctggttgaagcggataacggtcttctgcttggtatcgccctcctgaggttgattgccctttgctcggcctggagtaggtcggggagagacacaacttcttccatcgacgacaattctttgctgaggctgtcggtgcagagaatggttggtgctgaaggtattattgctatgatttattgcagagtcaggtggagcaggaggagcattggtgctgtggatgatattgtcaatgttgctgttggagctgactagctgatgagacaatcgtagggttgttcgttggatttctgcggtcttggtcaacaacacactgagttggcaatccttgggcacatggtttgtaccttcgcatagaaaacatgtgaccttacaggtgggacattcccctggtggatggtcttcttcacaatgagggcagagtgtgagacacatgctagcaacgtgtccaatttctccacaacgggtgcatgcttttgattccatctcttcctcgccgagatgtcggggaggctcatcttcatcatccgaggagacttgatctgacccttcactatcagatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgagtcttactcttcttgcctttggcttgcttagtacgtgaccccacgtggtacgaaaggctaggaggaaagcattttctaggattcaatggattgtctccattgggctctccactttgcacactaggctgcaaacttgacttggtgcaaggtggctggtttagcgatgtctgccctgctgaaccaaaggaagtggcttctttggcatatacccatgggcaattcagggcatagtgtccttgttctctacaatcatgacaaaaggggacatcctcttctggcattggaagctcattgacctggggggcaaatgcttgatcaaacacatactgattttggttttgacttcgaatcaatggtagctgtgaactcagcagcatgcttggaatggaccaagggtgtgcccttgttaactctcttgaggctagtggtggattgagttgaaaacttgagttactggaggcatacccgctgagagggaggaggagggagctgggccgaggggaaggagaggaggcccaagagaaggagggagaggaggagagggagagaaagagagggaggaagagaggactttggccgcgggctgagagagagagagagagagaggactttgggccagttggcccaaagggaggaaggagaattatttttagctttttctttttaataaactttgttaattgttgttgttgtttaataaatatttccggtgctctgaaaattcaagtaaaatttgagggctccttttagaccaaggagaatttaacaaaaattctccgggctacattcgaaattttcttgtacgtattttagtgtttgccaatttcttttcgaattttaattaattctattattccttttagaaaatgatttttatttcgggatgaatttatcaggacgtgacacacccccgacattagctcggaggccacaaaggcagaacgcgccgttgccgatatcgagacccagacgactggcgcatcccactaatcaaattcatcaacagcgaggagctgcccgaggatgatacagaggccgagaaaataacccgtaaagcaaaaatctactgtatggttggcgacgatctatacaagaaagcgccaaacggggtacttctcaaatgcgtctcgtccaacgatggcagacacctcctccttgatatacatgaaggcatttgtgggtcacacgccgctggtcggacattggtcaggaaagcttttcgacaagggtttttctggccaaccgcccttaaagatgcatgtgacatggtccagcgatgtgaagcctgttaattccacagtaaacacacaaagctacccgcgcaagcgctccagactatccctcttacttggccgttctcgtgctgggggctagatatactcgggccattcccacgaggacagagcggctacaggttcctattcgtggcgatcgacaaattcaccaaatggatcgaagcagtacccacgggggaaatcaaggccgacaacgccatcaaattcattaaggggatattttgcagatacggactaccgcaccgcatcataaccgacaacggctcccagttcatcagcgctgatttccaggattattgcatcgggctgggagtcaagatatgcttcgcctcggtctcccaccctcaaagcaacggacaagtcgagagggcaaacggtatagtactacaagggatcaaaacccgcgtctacgacaggctcatgtcacatgacaaaaaatgggtcgaagaactcccatcagtactatgggccatatgcaccacaccgacaacgtccaaccaggaaacacccttcttcctcgtgtacggctcagaggccatgctccccagcgagctacgacatcagagtacacgagtacagaagcattccgatgaggaccaggaggagcagcgaaacatcgatgtaaatctactggaggaacatcgcgaacgagttgccattcgagcagccagctatcaataggccctccgccgttaccacgagaagcgcatccgagcacgcatactttcgatcggcgactacgtcctccgatgggttcaaagccaagcatggcgaaacaaactctcacccaaatgggaaggaccttacacgatcacacaagtcttgcggccaggcgcattcaaaattgtagacggcgagggtcgcgagttagcaaattcttggaacattgaccaactacgtaaattctgtgtatgagtcaataccatccgtacttgtaagacaccttacagtatcaataaagcctattcttaggcccatattacaatcaaagtgtccccgcccgatgatctcttaccctgatgacacctagcgttaaaacctatcctcatgtccctttacgccgtcttgacaaggcctccgaggaacctaagggatcttcggctggggacgcccagagccgataaggccttgttagatcctgtagagacgaaagacaatgtaagatctggtcgtgtaagagttctcgccgtgcgtattaaccaagccgcgaaatcggaaattaactttccaacttcacggctgggagctaggatcagagcttattcaaccaaggcaggtcaaaggtccaagagccttatcctccgagaaaattcctccgacgacaaggctgggggctagggagagtgtacgactcaaacgactgactaaagtcgtgaactgagaacacactcttacacacgacatccggagtaagaaagatctgttaaagatagatttcttttctatttcacaaaatacttcttacagtttttacacaaatccaaagctatattacacctttttcctgagatatctatcacagggtacgaagactaccaagaaggccaacgccaatccatagactggaatatcttctccgccaacggcgccatcgacctcgccaggtggtgtatctccgccggagtcctccgagaacgagcaaaaccctcacggaggaaatcgagatccaggcgcgggcgatgatctcgtagacaagccaacacgtgccctccggcatatcggctcgatcgacgacattcctgcttcaaggcctcgtcgatacgcttgccgacgctatcaagttgagcacaagctccgttcagccacgagatgtacccggccgcggactcctcgggatccccacgaggtactcgaagctctctacaaaccttggctatggatgtgcagcaactcttcaagtacgagttgaactacacctcgcaacctcggagcgtttccacagcctgctttttcttcactgcaagcatagttctcttgagttccgctacttcaaattttgtcttccaatattggatacgacgatcttggccagcaagagcgctctcgagatctgcttagtatgggaatgactaagtcaggctataggcctcttccgagaacataggtgatctagtcgaaggtgcaaaaagggatgaatggatcactaacctaaggaagtggtcgccatgtccgtccccgtggcaagggtttggtctacattgtcgggcgacgcatgtggttcaaacgtgagagccggaataatcgccggtgactcgggttgcccgcgctgctggacatcctcgtcatcaatatctctacaagggacaaaaaactttcaagatcaacatgcaagagtaagctagaataataactgctcgcacaaaggcggttaagatccagttttacacagcatatctagggagtacaagaggccctactcttcaaaaagggagagaacagattcccccaggtcaccgacttcttccatcacctccttacgcgtgttgctagctgccccctgatccaagatctcgcgcagatcgagttcaagatgcgccagctttacacacgcaaggacgtggcacgccccggtgtagatcccgttcgatgtctcctccccgatcctggccacatgcttggaggggatctcctccatcgccgacgccagctccgcaagagaagatgtcagcgagaactcgttgggattcgccgggatagtagacttaatgccacactccctggcgagctggtgcagaccagtataggtgacccgcaacgagccacggatttccgacatattgttcccgagctccgacatgcggtgctcgagcccctggtgttgtcgctcattgccagccaccaactccctcatcttcttgaggtcctcacgagcctccgacatctcgtgtgctagccggtcagcccgctcgtttgccgacgacgccgccgacctcgcctccgcaatctcgcgaccgatgccgcgagcaccagcctcgaggaggcgccccatctcgacctggagctcctcccaggtgaggacggtagccggtggaccacggccagccgcgggatcgctgactgggccgcttggtgtcacctcgcggcccccgggtgcgagcacgacattcgacgaggccgcagcgggcgacgcgccagaggtccctccggactcgttttgcgcagccttcacccgcgccgccctgtgagacggccatggttcagacaacactcgaataaaatcacgaaaacttaagttcgtctacttacttttcgccaaccgtcacaaggcgttgtcgtcgtggaggccggggagatgtgtccgaggcctgaaaaacggtcgatgcgaagtaaggcgaaattcttctggctgtacgatctgacgacaggatagcttaccgagggggttgatgccttgcgatgatgtccgctcacagaggagaacttcctcccctttgtcggaacattgccaccacttgtagtagcagcagcagcatcagacgcctccttggcgaccttctctttcagagacgccgccacctgatggtccgcgagcggcccgatgatgtcagtcagaggaagggcctacgcttaatcaagtcacaatgtgatatcgaaaggaaaatgcagaatgcctttggagtacacttacattgatggcaacatcacgttcggccgcccctttctcacaaaggggaacggggatggtactcgccgttgtcggaccactgatcatcacctggccaacacgacgttccacggcttcgctgttcagacctgtgaatcgagaccaaattttgataaatcaagaggaacgcgaacatgagcatgtcaggataaatgcgagaaagataccccgaggagaaacccgagtcgcgtcctacggtctggaataatcaaaggctggatgggcccgagcctggagcggctggatccgcctaccaacgaagtctgcagcgacttcataccccgacaagcctcgtactcggagatcgtcgataatgtcgataaacgactagagagagggggtcaaagggggctttgcggtccaagacgaaatcttgtccggttgttctttgggaacaacgaagacagggtccgaatctttgatctgaaggtagaaccacctagtccgccatttgctgcgagaagaagggcactggaaggggatataacgcgacttcaggccatctcgaagtcggaacccgacgcaaccagacaccctgttggactccatccaacgcagctcgtagtagaaccgaaagagatcaataaagggctctaccccaatgtaggcctcacaaagatgagaaaagatgctaagaaaggcgatagagttggggttcaaatggaaaagagaaagaccgtagaagttcaaaaccaagagaagaaattcagaaggcggggggagaaaaccgcagagaatatagtcttcgatcgcaaccatgcgacctaagatgggctggggattagtacctcctgcttccctttccatggttccgcgaccgggaagggcgctgtcttcctgaagcttcttcagcgacgcactggtggaggatgatttgccgagatccatcgctgatcagagatcgccggagaaagggctcagatcgatgaactagggtttcttgtggcaacggagaagacgaagagcgcttacaggtgggatgttttcttcacaataggcggacttcaaaatggatccccaaaattcctttaaatagacgcacttacgactgtgcgaattccaaggaaaggggagagatgcccgccggagatttctgggtccgttacgtgcggcagttttttggacttcagtttaaattcactcgtgaccgttgggcttcacacggtgttctcgactacgtcctgtctctatggtcctcacaccgggaatgacaacagtctcgacacgacaagtcgcgaatggttacacgagttcatttaagcagaagtcgggggctactgtcagggttacgggttaggcataccctttacccttcgatatacgttacatatcggtatggcatacccacgcgcatacggatactttccgcgtacactaaggaaatccttcacgaagtctacagatgggaagagtcttactcggacaagactgtgtcatcaatgtatcgtatagggtctgctatctccgagttctacttggaaaccgcctgacttgcgatataaaagggaccccccgaggaggacctgaggcatcgaatctcagagccaacacaaccctcacagcctacgaagtcggagcttgcaaggagccaaatcgccggggatctagtcgaaccaactcgaccacgatctcgccggatccgtcaagttccattgttccctttgtaacctgtgttttccaccatataatcccacatcaactggattagggctattacctaccaaggggcctgaaccagtataatcctcgtcttttgtctgtttgtgtcgtattacgtagatccttgtaccaacgtaccccaataccctctatatctggtctacgggtaccactcgtcgacacaatcgactaatggttatgcaataaaacaatagtaatatccagtagaaaccaatcagctaacagtaatatgatagaataagcactgatccagatccgcggaggagcagcagtgctcatcaacatccagatccgcgaccatctcttccgcgcaccacctccttcgctagggtagcttgtagaaggtggaaatgagggagaggaggagctggcgggggcgcgctatcatcttcctccttcttggccgctccatgttgaagcgcgctgcgcgtggccgctctgactcgagcccacgtcgtcgacgctctgccttgggccacaccggtggctagctcctagcccgccgaagccgtctaccgccgcctcccctcatcccgctcaagcttgtcgtcttcgttgccgtgcgcccgtctgcctagtgcattggataagttggagcggagaggggagtaataaaaaagaaatagtatgcgacactaacgtgcaagtccacactatatgactcagcaggttgcaccacgtcagcgaaatcggccttcaaaaccgttgagagagtcaaattgctctagttttaatagctgaggggtgaagctatagttgagggagtcaaagtggacttattcccattagcaaacaccaaatcgagcccaccaccaccgcgctagctgtagccctgccaccgcgccacctgccccggccaccgcaccaccccaccgtacgcctcgccccgcgcaaaaagagggaaatccaccgtaagccgcgcgccccgcctcctccctcgctcgcgggcgcggctgccatggccatcgcggcatcgccctccggccgccacggtagccgacgcccccgcgaccgcccgcgcgttaaagccggtgtaatttccgcctctctcgcgcgagcgtccatccatcctcccccacccgcccatccgccccccgcgcgcgtcgcgcccagccgcccgccggcttaaccatgcccacgcctcctatttcgcgatgccatcaccaccaccaccaataccccaacctcgccccttctctcctccggccgcctcgccgtctcgccaccaccgcaaccctcgcctcgtgccgtacgggcgcgccgcgggagccaccaccccacgtccgtcgcgtcgcgtcgcgcggcacgcctcgccgagagagcgggtggtggtggtagtagtagtagcagtagaaggagggggggtcgggcggtcgcggcgcggcgcggcgtgaccccggccggctatgcttcagcgcgcggcgagcaacgcctactcctggtggtgggcgtcgcacatccgcaccacccagtccaagtggctcgacaccaccctccacggtactcgtctcgttcaccccccgcatgttcggcgaaatgcgcgtttgcagaatcttccggtcatgttggtgacggtgccgtgtttgggttaatttgtttctctctgtgtgtgtgtatgcagagatggaggacagggtgaaggccatgctcaacctcatcggagcggacggcgactcgttcggcaagaaggcggagctctacttcaagagccggcccgagctcatcaaccacgtcgaggagatgttcaggtcctaccaggcgctggctgaccgctatgaccggatatccagcgagctgcacaaggccaaccacaccattgccacagcgttcccggaccagatccaattctccatgcaagatgccgatggggaaggattccagaaggcgatatccgggatcgatctcagcaacttcaaatttcctgcgctggaaggtttgccaatggggtcacgcggcgctagccggggaaccagcccggtcccgaagaggacccagatgcaccggaggatcacctcccacatgaacaaggaaaatgcacaggaggagatcgacaagctgcaaaagcaaatcctggtgctgcagactgagaaggagttcttgaagacctcttatgacagcgcgctgggcaggtatctggacattgagaagcaggtggtggagttgcaggatgaagtttgcagcttgcaggatgcttttagcactggcgcggccattgaagacaatgaagcccgggcattgatggctgcacgagccattgtgtcttgcgaggatacattggttaatttacaggaccagcaacgtagatcatctgaagaggcaagaactgagtttaaacgattcattgaagcaaagaagaagcttgataccttcaaagctgagtgtgggcagcctcatacgcaaaatgatgaacctgataacagtgacaaagaatacatccatgcaatgccatctggggatgttgatgattctgttcagaatgagatcaggtttgacctgcaggaagtatgccaaaaggtcaaagaactaattgaattgcacccaggggtatcggtcactgatttagcagataaggttgaccgacttgtggagaaggtaatcgacctagagcttgctaccacttcacagaatgctcagatcaatagaatgaagactgagatagacgaccttcacaagtgcctgcaagccttggaggaagagaagtcggctttggttgctgattccagtaagctggtagacagattgaagcaagttgaagaggttttgcaagcagtccaacatcttggaaactccatacaaaatgggacacagaatattcataaagaaatgaatgcagcctgcagtgaacttgctgaatttgtagaaaaattacatgaacctgagccccaaaacagtggtttcatgaattcatcccaagagtcaagttgtcaagaagaagattcagaggtaacaagtcagtatgccaagaaacaaacatccgactcaatagatggttcaaagaatgaagtggagaaacaagataaaggctccgagggtcctttggtgcagcaacatcctgacacaaatggatctgatggtgaggacaagattttattagaggggtatgcatctgtccttcagagctacaagggtacagagcaaaagctgtcagaaattgagaagacaaatcaagagtaccattcaaggtcaatgtcagagctgaaggatctgaagagtgccaatgcaatgaaagatgaggagattcactctcttcggcgcatgctaagttctttgcagagaaagatgaatgcccctgctcctgagaatgtggacaagtctgaagaaacttccaaaataagcaccactcctgtcaccgaagacaaagagattgcagaaatagaggagtacatgaagcaatgccaagttgaagagcaacttgcttcgtcaatttccgaggaaaaatttagagcagagattgacagggtgttggagaataacttggggttttggttgaggtttagcacatcatatcatcaaatacggaatttccaaacatcatttgacaagctaaaaactgagatggataaattgattgatgcacaggcacagtgtggtgcagatggagttcctatcagttatcaggtagcaaagctggagtcagctgttctagaaaaaaaattccgggatttgaacacagatcttcaagtttggatagaaaaaaatgtgctattaaaaggagaactagagaacaggttctcatcactctgtggcatacaagaggagatatcaaagatcgcaactctggataaaagcgatgaagttcacttcacccctttccaagctgcaaaactccaaggagaggtgcttaatatgaaacaagagaataacaaagtcgctaaagagctagaagctgggctggaccatgtaagaggtctccaagtggaggttggcagggtgctcttgaagctccgagaaaatcttgaattatctatagcaagaagcaaccgagctcagcaaaacttccgtaacctgtcaacgaaagctggagttccccttagaactttcctgttcggcacgaagccaaagaaaccatcactcttttcatgcatgggtcctggggtgcataagcatcacagtggctcaagggctggtcgtagatgagaatggttggatcatcaactttcttttgtcaattaatacagaacagagctcagtgtacctgtcaattgatttgtggtatatgcagtttctcatagaccttaaatgtaaagaaccctgcatctcttaatataaatttggttcaccctgtccgctcatttctgcattgttagcttgcttatctgaccttactgccagaaccaaacctgatggaaatgtatcatgttaaattcattataattctcctgttactgggagaacctgtgcttattctagtgccttcaattgccaaattgaggtcaagttgataatgcctatataaaatagtggtacaactattttgctatatcccaagtgtatcatatcatgagttaatgacattgttaatcttctagccatgtttaggaaactatgaaattagtctgtgtattgtgggcatgtggcaaatgaatggaaattcagatcaaatgaaatttcttgctgtgcacaaacttgtagaacttagaattgctgatatgcacaatatccttccaatttaagaaaacataggtaagtgcaatctcaaacatgtgtgaattggaaaatactattgcatgtgagaatgaaacgagggcttgcatgtgaaaatgatgtgtggtcccaggcccacacgcctttctcacatgtttttttttcttcgaactttatgattttttgcatggtaccaagcaaaatggttcatttgtcaaatcttgggtagcaattcctttcttgcatgcatgattcaactagtggcaggttgcctgacaatagtgtccattgacttattgtatttgacagtatggttcatgtcatgattcaatataaatttcatattttgacatgttaacatcacaaaaaggaaactgtaagtttcttgtgctactgaaattctatttagtttcttctgtagcaccttttttttcatggaataatggtggacgctgtttgtttcattagatgctcttgtctcttaatagttttactgcaagtcttaggtctttggtcttaccttgggtggatttgatcaggtatgtctgatattaatgatacaaaatgcattgtatgaagttaaaactaccttggccgttcacttgtctatgaacagtaagattttctaggaggagacaaatgggctgtcaattatcagatgtgaccaatccttttctatccacaatacactcactgtttctagttccatgcatagtgtgctactttgctttatgggggaactgtttagttttccagtctgctcaccagctttctcaaagctcttctgatccttggagtggtattgtggtaagttcctgtttcttactttcttatagtcaaatatctaattatggatagttctacagatatctgaaaatgacaccaaccttagatggaactcttgcaaattgctgcaatagtgatgctttcatgttggctacagaaccaggatctcattgtacagaatcaaagataggactgctgggaaacctctagactctgtttaaggattaaaattgaaacctttggaagttgagaaaggcgggcttgagtttccttgtagcaagcagtatacggatatcaactacagtatgtcttctacacctttctatcccttctccatatgttagttgctagtcctgttgccttggtgattctcgtggaccaaagtatatgtgagctgtgcatttatatttgaaacctgttgcttgttactgtcccaaattctgttcataattggctcactgaactcttttatttttttaaaaaaatatgtgcagtgcaatacataaataaaataattgaagtccactgtttcctagttcttgaaaatgtgctatggaattctttaagtaggtttcttagaaaaaggtaggagcttcttatttctcatgtgtatcagggagggacaagttcaggctgtgactgctgtgagcttgtgatttgattgaagatttcaaaactaccattcctggtaagatcaccggtatatacatgctcgcggtaggtccacgtacaaaaatagcagtagcagatggttttctgtaccttcgttcatctcttaatacagaaggattgatggcaccttttccttttcttaatacatgtatggttggagcatattccttagctatgggtctgacacctgttcattcttcaactcttaaattcagcatgcttcttagtcttttatcaaagcagctagattttgaacatcttttgctttgttggaaaatattctcgtttccaatgtcctttttttcaactacatttccaatgtcttagctatatagaaagggggacaactttgccttgccatacagctcaacagtagatgagcaaacatgatagtgattctcaatggcaaatttgattatcaaataggcctgatattgtttacttggagcacacagtaacacatacatattttattttagagtaaattgcgtccacggtatataaacttggtaggtgggtgcgatctagtgtaacaactttgaaaaatgatcatttttcaatttatcagatgcatgaataaaagattatcatatctaaatagaagatataccatcttaatacaaagatatgcaagtcttatgcgtactccccccaaaaaagatcatttagacatgagtacaattgcatctaaatgatcatttaggtgtacacctaaatgatcattttaggtgtacatgacatggtatatcttctatttagacatgatgatcttttattcatgcatctgataatccttttgacttgatgattgttggctgttattagcttagagctgtaatgttaggaattttatgcccttgttaaaatgagtggccctactgcctttggtgcatagtatacactgcacacacttaactttgtctttttataccaatccccttcacttgcaataagcctcccaacacatcaaagggatccacagttcaaaagccatgttccatccttcttcttcctcgtcgccaccaacctacagtgactcctccatgcaccatgcactgagcttctcttcggctctgcccacagctccaactgaaattcctggcagcggcggcggtttcgtcgacgacaagggcagcatgttctctcttcccaatgttgcgggctcggcgccgcctccctcctactactcttccctcccttccttctacatccacaggagcaccagctcgcactccctccttcaccaccggttgtctgacctcctcaacagtaatgccgcattctcttactcgtctgctccagcttgccaattgcagcccctcccacctgtttcttcctccacttcatcatcctccggcgatctcttggagttcagctccgggaccctgcgccgtgtcttcagcaccggcgacctgcaggtaatgtaaccccaacccaaatctcaagctggaattgtagccattaacaaacacttttggtaaattcactttcttaaccctatgctgatgcacaacaggcgatgaatgtaccgccatcgccaccgccaccgccgccgttttcaggtgacatctgcatccaggaggtcggcggcccgttttcgcagaaggtgggccgttacagcgccgaggaacgcaaggagaggatcgagaggtaccgcgtcaagcgccaacagaggaacttccacaagaagatcactgtactggcctacaaaaccgcatttccatttcccttgcaagcaattgaccatggcagctactgtagctcatcatcatcatcatcccctggccgtttccagtatgcctgcaggaagacgctggcagatagcaggccaagggtgcagggccgcttcgcgaggaacgccgaaaccgaggccgatgccgaggccgatgcggtggccggcctggacaccgaggtgtacggcaatggctatggatactgcgcctacagcggcctcaccaacagtatcagcagcaattgctacgacaaccagagccagagccagtggtggggaacgccagctggcgcggccaattggcagcaccagcagcagaagcagcagcttggtttcgacgtcgccgtcgacggcgacgacgaggactacgagctgtgctgtgggccagcatcgctgacatgtgctcagggacctgaccctgagctgatctgacctgtccggccacacacgccggcagcagctgattggcgctgccaggtgcaaggaaggcggggggaggcaaccgagcggcggctgccgtggacagtgcggtggtcggagtggcgtcgctgaccttcttgtcgccgtagtgtaacttcgccttaaattagttatagaagctaagaaaagagaagggtaaaaaaagggaaaagaaatagaccctctcgtgaaccaagccaagaaaaaccagcttgttgtttttgtgtggtcaggattagcaatttagtaggcatttagtactactttgatatctttctccgatagaagtttggccatggttttgctttgtcacacctgaaatttgaagaaagtcttgagtgctgcaacttttgtcttgctcccaatttgctcgttagtggcggctcatgttggtcgcccctgtggttagtgcgtggcatgcttgcttaatctcttctctctctgttttttttttcactgccaaagtggcaatggcaagtagctgaccccaggagctcactgagccaatcagccaaggggtgtgtgtacctgcctgccggaaatttcctgtcttgttacatatggcaaattgcctttcattggtactccatgttctcaaatataagcatttttaagacttaaatttttatccacaatgtaagcagttgtgaacacagaataggagtccaagcattttcaaccgatcaggagaatccaaacaatctaaaatttaaaaaaatttccaaacaattaaaaattaaaaatttaaccaatgagatgtctgaaaggggatatttccttatcattattcttttctaaacaagttacaaggtgccggtcaccgtctgactgtctctgatagcagtaacacaggcgaggcaggtagatatctttcttcttgcaagtgctatacgtccctaattctgaatttgtagacatctgtgattaccaataggagtgctttgacatggcaaccttggcttggctcaatcagtgtggcacctcatttttctgcagatttgccactatggttttctagggaggtttgatcttgtcgattgtcatcctggagatgggagatgcacctggccatctccatcttgagagtgctatatacttcctctgtctaaaaaaaacaaatccttgctacatcatgtttagatatatagcccgagtttgtctttatttagatggagggagtatgtcgtagattctgatatttaacttctcggtactttcacatggaccgtaaaatttattttttgaaaaacaaaggcagaagctgcctaacttcatttagaaaaataaaagtacaaacaccaaacccagagaaggggaacatcgaaaataacatccaccaaagtagatcctgaaattgtatatttattactatcttaatctaccaatacgaattcttcgaggaaaaagtaattctgtttttatttggtacgaatacggtcacacggccggtttggccatcggagatcttggtgcttacactgtctggaataacacggtttaagttacgtagatgcttatatctctttcaactgtcatagaatcaagatagtggaatagctttgctgccttgatgatgcgattggcaaaagcagcgacattttctctatatactatccatgtcttgcaaactatttcagtcatagaatcaacacactgatttcttgaacacggcactacggaagcctgaagctggcagctctaaacatcctactgctatcaagcaaaatttaaccaaatgaacagccagtgcagcattaaccgtgaggaataatcttgaccgatctttctgcaggcacatatcgattcctaagagcccaaatgcagccaatcttcagcagccttcctttttgaccatctgaaaccgttcaaatgcagcaaatgagtatcatcaagaataaagcaggagttgtcctagatatgtagcctataaagaaattttaaaaatggcatgaagagcacccaatgaagcagagttcagctctgcagtgcttgcttctttctgaagaacggcctgaattttgttggatttcggaatcttcagtgaagtaatggacgaccaagaactaccctccaaactgtttgcaactggcaaaggtgcagcaccagaggttgccatgatatcaaaagatcggtcaagagggaatccaagcattgtgactcaatgatgagaagagcaatgagtaagctttttacagtcggcccaatgttgcatgaatgaaaccgatgcctcttgcaactagcatacggctatctcgtctccctacagtcctaagatatttcttattgtcactagtcatgagattccatgaaaagttgcaatgcttctattgttgtatcagcaacttaaacttgtcatagaatgtaccatacgctaatgtatagaaaattttcagtacatgatgcaataaatatcgaaagctctgatgcatgtttgtaatgggtaaacaattcagatgtacctgaagacggactgcgagtctgcaataactctgtcagcacttgcagtggcggatccagaaaatcagtttgttggtgtcataacgtgtctgtcggtgtcatagtatgctaattatacttagaacatagtgttatagtatatggataagcagttttgttataggttttgccgaaagtcatcggtgtcgcttgacactgacgcttatactgtagatccgcccctgagcacttgacccttgcaggaatacaaaggtaagtaaatccaaagaacacaagattccaaaatcaatatagtaggaattagccgaatagattagcaacaaaactacaaaagtgtactacactacttcttactttagggcaaccaggagagccagtggtgagctaatcaaaatggtatgctcttgctgcctctctggaatttctgcttttccatcaaaaggctatgcatgagctgcattgtagagggagaatgaagggatacttgactgtcactcccctcccctagaggtggggagtgtggctggcggattctctgtcggccgctaatgccaagtacgatgcactgataagtgataactttgttaacttcactatgatgacaagtctaactagtagtactgtttagtacaagcttttgtgtagcctaagcctgcatatatataattctgatgaatgtgcctggtacaagattagttggctcctgtgctagtaaatttaactcccaacactgtttcatttatgtgatgtggaaaaaaaaaataaaacaagataatcaataatgctaggagcaaagcatgttgccggtaattaccagcacagtcagcaactcagcaagccggccgatttcaaattacaggaacaatttgctttctcaagtggagggagaagaaaggcatcatgtgaggtgtttcactcacaccttattccattacccagagaagaaatgaagcaagaaccgaagtgatggcaattctcccgtggacaaatcaatcataaggagattgtgagggaagaacacatggcatgaacaaaagtgcctgtggatgctaatgttgactctgataagaaaattaggagctggcctactaacccttcaccaattacaattattagttcttgattgtggacacgataaggatacacaatctttgtgcactcgacagatctctgtcggaaattggaaattcttcatttcaattggtccaattaaagcttaaacagggctgaatgaagttttatttgagaataaggtcagaaagtgttgcggtattcaacggaagtggagagaccatacgtaaaagatgcatggaatattcacctaaaattcaaatataataatgtgcatgatcagaacataaaaggggtccctgtgaccaaatggtaaatcatgcaaggcttgttcatgacacccaattcaggatcccccactgccaagtggctagtctcagataatttattctaggaagaatgttctgctggacaaaaatatatatttaagagtggatgtctttccaatatttgttgggacggtcaaacgaacttcacagtataagtactaggattagtgacttagtgttgtataagtgaagtgtagtgtaggtattgtgctctttctcctgatgccgtcaccatacgacagccaaacgtgcaaatcaaaaatcagaaagtgatttgtagattgtaatgtcagcattggtgcgcctcagagactatgcaatctgatataagctgatgaaaatctgaaatgttgtttgtcagtgccatcgatgtcattaccgtacaaatgctgctacagatttcagaactgtagtgtaatttagtgaatttttcggctcttagaggaaaggagatttcatgcagcaggtatacggtataccttttccccaccaaccggctgcctgcggcgcgcggtgcgccggcccgccggagaaggatgcggccgccggggttggcgcagcagacgtcgacgcccggtgccttccacggccgcagccatgttctcccgcctcccgcaacgcacagggcgtagtacttactgctgcgcgggggcgcctcgatcgacggctcagcggcgcgcttctcgccggcgttccgccgccgtcgccctcccccggcgccaccgcgcgggggccaacgcctccagcttcggcgaagtggtgcggcggcgacggagaagcacggcgatgcggtccccctcgccgccggccgatctggtcgcctgggcccacgaaagcccgcaaatcgattactgtacatggaaagtactcgctctacctacttttccaaaaccgaaaattttatttttgatagttttatttcaatccaacaacctatcatcttaatgattttctcaaatttaatgcatgactcttcattcttacacatatgattggctacatgggttttgagaaatgtaaatactccccccgtcccaaaataagtgcagccatgattttccacgttcaactttgaccattcgtcttatttgaaaattttctaaaaaaattgaaaaacacaagtcacgagtaaagtactactcatgttttatcatcttataacaacaaaaatgctaattatagaaaaatttcaaataagacggacgatcaaagttgggcgcggaaacttatggctgcacttattttgagacggaggtaatattaatgaatcgcttgtttacgatgaatgactagcagcatgcttaaatgaatgataagtaaaactacttatccttggtctgtgtgtcaagatgaaatatgactatcaaaagtacatggagggagtataccatatacgtatatacctatacatacgtaagtgtgtatatacgtatacatatacatacagtacatgagtagggtaagtagcttagtggttgtagtgatatgagtagcactgttaatgtcaaaaaaatttaagtcctagagtcatcagagttagtaagcgtggatttttcgtcaacacatccaaggtgttcaaatctccatagaaacaaattttagattggattatttgagggctatcttccctatttaatatgttaagtttctaatttaaaaaaagctacatatatcatgttagatgtagaggccgggtaaaaaatacccttccaaaaaatgagtatggttctgtacgattcaaaaccggggatcaagcagtaaatcgtacaatagtgcagggccttccatgcaaaataacctccacctctcgtagacgtagctctccatctaaggcgttcaatcctgatcggtcggctggtagttgtccattttggatcgctatcgttggtagcgatccgggatttgaggtcccaaacggtaggactattttagtatagggtcttccgtgcaaaaaatcctccgtttaaccgttactcgggccgactcgatcgatctgggccgcggaaacttgatcgtgtggctgagcctgatggccgccgtccaaacttccttctcgccgttcgcgtcagcggcgggcggccggccgcttctctccaccgccggcgaaggcggcggcatcaaaggtaaagccgtgagccttcctctacttcctctccattagccatcttcttcccttcccgcgcgctccatcatcgtacgatcaccctcttccgccgcggcgttcacataccgccatctgctcggcgaaatgccgcacaggcctcgcgcctctctctgtggctcggaaaagattgtgatagcctgagaggctacgacgagtcgacgattacctgatggatgggcaggcaggcctgagtttctggttgcttaggatgaaatggaaatccgatactttctgttattcccacggtcctacctggagaatgcaagagcaagacgtaagccttgcgaatgctggaattctttttcgttttttttttgtggaaatcgaacggccttatggagattcttgaactccagtagggcttaagtatttcaaaaacgcacaatattctaataaatctcattctctcgtttcttctaagaagcagtctcattgcttgcaaatctgtactatcgaaatctgtacaaatcagagggcaattagcgaggccacgtggcatgactggattcatgggtttggtccctcgcgcacagccgtcagatcacgcatctacggtgatatatcgtgcggtggatcttgttgtaaaatataatctttcgagggagtttaatgcaaaagagtagagtatccatactccagtaaatacttcgttcgtcacccgttcccatccgccgccaaggctccaatctccgctcgttccacaccgcggccgtcgcctcgctgtcaccgggcggctgccgatcccgagccaacagcccgccctgctgccggcacgcggtcgttgaatcgagggcgctgcctcgcccccatgattttctggtgcgtcgccgctctccacgtgttcctcatcagccgcaacgtccactttctccgccaccggcagccgaggcgccgcctccgcccacatcgcagcattgacttctccaggttggctcacctactccatcggctattccaggtcatccaccgtctcacccctctgaattgcaaactactatcccctgctgcactctgcctgttcgttgtaatgcttattagtggaaaatagttcaacaatgtcatctgccaacgattagtagaacctatgatgtgaatccatcatgttgtttgtctgtgaccactgagagtttaataatgcttattaatatgttgccatgcgaatgctcctagaccaaaatgtagtctctgtcagtttcttgggtttctttgtaaccatctgaatttaaatcggtaaattgcctatctgttgtatgtaatttcagaagtttaaaatagcaaacgtcaagatggggctatctcatgataaccttaagtggtaagatgaggttggggatacaattcatatcaagagttttttactgatttggaccaattatcatgtacaattttaaaatgacacaaataaaaaaaaatgacacaaataaaaattatgtagacatgaactgcaaaaacatatatggtgattagatacttagatgaatgagagagaatccttgcttacttggtgcaagattaaagattaaaagaaacggtaaagtttatctacggtaaagttcagctgcatatataagttacaatgtgcaacacgtaagaccaggcttctttgcaatcatttatctactaagaatctactggtacaagaggattaggaggcaccagcatattctgctcatgtttgaggtaaacgctataccaaattattaaacgaataatcaattcctcaggctctttgtgtaaactgaaatgcactcaaaacgtgatctttagagaataagaagtgaaagttattttaaaaaaaggatttccagagttcttatagacatctggagggataaaatgaagacaagtactttcattactttggttcattggactttagaatttgtgcgcacatattcgactttcaactgatgtcgatgaactcattgtcttgcagccttcaattgatctgaataaagcttattccagaaactatgtcatatctgagaacaattagatattagaattaaattaaattcatattacagagagcagaaattggtactagaactgttatgtcgttagcattattatgttactttatattacagattgtttctgcattttctcagcactcaagtggaaaataagctggaaattcatgcatcgttttgtaattttaataaatttgtaaactaataaatagcccatggagatctttctcatacattgtagtgctgtcgaaactcaagtatggttgaattagtaccatgattaatcgtagcttcatgcactttcttttattttggcaatggtctctttgcgtactcttctattcatgcaatgacatgatactgaatactgagcattgaattctaaaactgaactggcattattttgaagaaataaaaaaaaaccaatcatgttattaggcaacaagatcagtgatcatgctcaagttgataaggaaccatattattaaatgtttaattttgattattttcctagcctggtactgaagtactgtctaatttgacctctgaagtacttgacatttgaattttttctaccattgccatgaagattttgtaaggttgctttttattatacctgtacagttagatgcaatatttaaccaatcgaagtaggcgttttttgtgtattcttttaatatataatttttttcttttcaaaaatgcggaagaaaaacaaattggaattgcaaaatttaacgctgacaaagcatccattcaaggcattcctttcttttttgagagaatcccttatatgccactagaaattggttagttctcttatatgccactcaaaattggcttctcccttatacaccactagttcaagtttttctatccttttatgctactcccagcactatagcatttgttgactgttagtcaaatattagttttttttcataaatgaccaatatgccatctcaactaaaaaatgtgtaaacttcaaaaaaatcataactaattttttttaaatcctttttgagtgaacaaagttttgtcagaacaagtggaaaatgctctttgtaataaaaatattgttggaaagctgcatgtttcatacttgtattgaaaatttgtttgtgatagtgatggctaaaattgcatgtgattgaaaaacaaaatcaattttcatatgttgtatccagtagatatattagtactaaaatacctatcattggttatataccaactctcaatggtaaatgtgtctttttactatgaagttaacggtcaactgacggtggagtgacggcaatggcataaaagggaggacaaacttgaaccggtggcataaaaaggaagagacaatttgaaggggcatataaaggaaccggttaatttggagtgacacataagggattctcactcttttttcatgttagcaatggtgtaattaatactcacctgtcaaatacataaatcccctgccaatggttctactgagtcctttttcttgctcttgttcaagaacattttattttcctcttctgatctcaagtcccaacgtctattaatttatttctttaggtttttggttcaatatgttaagaaaaaaaaccattgatcctaaacaaggccactgacaaaatagattggcctaatctaaattgggcgcggcaaagccgcacgttgtttctagtacattctaagaaacaatcaaattgctcagaaaatacatgcctttctttttcctccatctataaacggcagcagcactaactaatgcccacgtacctttgtacaccaatgttccagttcttgatggaactttacacagaaagagttgctaaccgatgctaaaatttcttgttctatataagagcgcctgcgattattttggtgtttttttcctggtctggtcttagaagttctccttgtggaaatggaaccgagtcgttgtcgtctggctgaattctagtgaaagatccctcagcattttcgtaagtgttggagacccacagtagaaaacgcctgcagatttatgaaacatctcagcattgctatcctgtaaactaggaaccatcacttgagatttatcacatagaactgacctatacgagagttctggtgggcattggccagatctgagaatacctttctccagttcggccttgcaaaatgtgtccggatctgcataaagcgagaaatattgaatcaaattttgcacatgtgatttagtttttatttttatttttgcaggaggatagaagtgggaaaaaccttgctgccagagacgatatccacaccatttttggcatgttgaagtgattggaccatggcaatcagagctgatcttgcatctccttcttcatacacgcttgtcaggtaattgtgcatctctattacattctgtatagtgagtgattatgttagtatctatttattaatctgaaggagagaacatggaagttgcactgaagcagttagactgagtagtacatcatgatcactttcagcaacatcattcatcacgcctttaaaccattcaaaggaaccttgctctctggtgacccagtagaaataagctcttcctggcccattgctcttaaaggtgcagcctaactcagcatcatgcgtgctttgcacatcctgttgaatccaattcactttagatattatgcacttggtttactgtataagaaagaatttgctatagttaagcagtttactccattggattttatgttgttcaggagatccttcagtatgctgatgaaaggcgttgctccaattccaagcccgataagcaaaagaatgtcatatttcttgtaattttgagctggtgcgccgaaaggaccatctataaagactttgggaaagctaaatgaagagaaccaaagtcaggaagattagtgaaacaattgtatagaaattccttcaaaaagtagatgaatgtagaatatgaaacaaacagggcataattaccaagtctcctctttcagaccatctgctatgatagtggtttcaagtcgtgcaagtgtagccttcttggaacttacttgtgcctcacaagcctgcatgaattagcataaccctttagcaactttgttaatttagcatataaatactgcataagctcccattatgcctgaactattctccttttctttttgtttctgtttgctcaactgaccttcccaaataggtttctaagttctgttgtccagtcacctaatgtacggatatgaacactcaagtagtcatctccaggtgcagaagttatggagaagggatgcctggaagcattgaagaatctattaatccatagcctggataaacactgacatttggacagagacgatcagatggtaccattcaaaaggcgaaacatctgggcattttacaaacatatacatcccacttttgtacttgaaacttgatggtttattcatgtgaatagagagcacatttccagggtaaattgctgcctgcatggcacatttgatagtcaattaatggtattcttgtacacttagaagctagaataaattgaaaatactcatcgtgcaattcatgtgaaatatgttgcttaccttgatgacggtcaccccataactgctctcacgaactcttctgatagttctctcgcaggagtaaaagaggactggaactgccaagaacatccacgtctgtaaacacaagcgtcaatattatgcacaaccactgaattcacaaaagaaatagttgtgccaaacatatgccagagaaataccgttcgattgtaccactgcttggtgagaaatatgaagtaggagtgcagcaccaagaggatatatgcaatcaccagtaggtgatgggcgtaccaaaaggcattgaaaccagcaaggtggtgcagtggtgatggaagcttcacaacgctcctcctgaacgaatgtgtcgcaagtgtgaacgagaatgacattatcaagatcatgaggatgccagtccaccctggagtgcttgcaaccagcgatgagtatgttggttgaacatagttgaagtaaggccccagtgtggcctcgaacttgtcccttggacatgataccaatcttgggaagtcgcaggttacatgagcaagagtatgagtagccgctccaattgcaatcgtcagtgcgataacctgatatggtgatcagaacaaagaggtcaggctgtgtaatcctggaaatggcaaagagttccacacgtgtaccttgtggaagtttatgttatcatcaaatggtacgactttgctgagtgctgttgatcggagccttgttagtgtgtttcggcacaccgggaggagtataacggccatgttcagcttgagtgtttcggcagcaccctttgctatgcagacacagtagcccatcacctgaaatgcatcccgcctactgtactgcacaaacttgtacatgaataatgcaatattgaggatcgcccacaaggagagcacccatatcctcttccaattctcatggatgaagtcaacagtcttgttgaaacgcctctgcattggactccggtgactggaagggaccattgtccttgcaaggcttgctgaagccagcttcaccttctctggaggcccttgggctgtcaccataccacggagtagcgtctccagctgccaaatctgcattgagacaagcatatctgtatgctgctgtttgtcaaaaaaaagggagataatttcatgtcttggtacctcaatgtaaccgcgatgatcaggatccagctcttccatgatcagtgaggcgtaggttgcagcatggcttttcaacttggcaagtttgtttgctgcggcactcaacacaataacctgcatatggaaagagaaaggtaaattcttattgagatcatttccacaagctttgtggaaaaaaggtaaattcagagatgattgggaactgacctctttgacctcgtcctctgtaagctgcccatcaccattcttgtcacacctgattgcaaagcaatctcatcaaggggcaagtcataaggttttttccattgaagacaaggaaggtagacctttacatgtcaaagaatattcgtagtcgtgaatcaaagttctgatcagtcaactcctcccaaaattctttcagctgttcctttgttatcccatcttctggtttgatgctcctccttctcgccaatgccacaaacacctcgcttgcaaactccttagaatccgccatacctttaagttgcagaggcattctaagcttagagcttcaatttatatacagaggatggatttattgctattctgatgtcatttatttacctgactacacttcttttaaaagaaaatgtcgtaagcacgagtactccctccgtttcatattgtaagactttctagcattgcccatattcatatagatgttaatgaatctatacacatatatatatgtctagattcattaacatctatatgaatgtgggcaatgattgaaagtcttacattatgaaacggaggaagtatatcctattcttgctacgtggtaagtattgtctccgagttatatttgggggggccaaagtctgaactttgtgcaacccgtggtcgaccaattatatcctcttaaattttccaattttctttcctccgttttttgttaaaataaaattgtgaataggaatgattatgtatactttatcaaagaagtgctgcaaacatgtatgcatggatggcaggaggaggctggctgcttaaacagttgaaatggctgaaattttggacaaacaccatcgacatacgagctaggaatgatctgtaccaatttctcatctactaactgttcccctttttccatcacatgcacaaaagctttgacaacattttccccttttttttttgcagggaaaacaaagcttgtcaattttcgatgtgttcttgctaacaatgcaatttcaccgtctctcttttcatgctgtggtgaatcactaatcactttggaggatggagaacaccatgggggcatgtgcaggagcactcaccgatgcatttggcgaagctctcctggggcaggcgtccgtcggcgctcatctcgtcgaaccgcttctcgacgttcttccacccgtccttccccgccgacgtcttgtcgaggaagcgcaggccgcgcagcgccggctgcgcgctggagtgcgtccgcttcagcttcatcgtgtcgggcaccatggacgccagccgcttcatcccggacgccagccgcgacggctgcttcttcagcggcgccaccggcggcagcgtgctctgcccgccgccgcccagcggcacgtccacgtagtcccccgccatcctgatccgaactaggtagcccgctgctgctgctggtggtggtggtgggtgccctcaccgcaggaggagcgtggccccgggcgccatggcgtacgtggtcgtcgtcgttccaggccaatgaagaaatggcgcggtgtaaatttgggctactggctaagggaggaaaggcagaaggcgagaggacacgccgcgggatgcgggggggagggggagggagaggccgtgccaattttagattggtgctcgcgcgccgcgcggccgggaattctcccgtgggtgcgagtgcggccgtgcgggcgcgggtgggctagcttggctatagccatgggtgggcgcagaggcgcgcgtgctgcgtgcaggtgcaggtgcaggtgcagtgtagccgcgccgcgcgtggacaaggtgacgggtgacggggcgtgcagggggtcacaggtggcgcgaggcggaggtggatggaggcctggaggggatttgtcgggcggcgagccgctctttcgcctcttcctctgtttctgcagaggtttggtcggcgtggcttcgtgggcccgtggtctgcctgctttgaacaaggacaataccaacccacagtatctataagtagtatttatggtgccatgtcaataaaactttacgatagaaactacactctataacccatggttttttaaagtggtccattaataaattcatcatctctcttctctaccgattatatttattcttcatctattatgaagacactattatctcccaattaaaaacttgatagtgtctagtgcataagttctcgtgttgaaactgtgtcttgtatgagactcagtttcttcctctcttcactctctctctctcttaattaatatagtgccacataagctaaaagtcctacatagcaatgtagttaatgccataaacaccatcctaggtggagggttgggactgtcctaaggtcactttagagcaggtacagcaatagactataagctataaacatattttaaaaagataagagcaaatttaatagtataatccactactagctctaatttatctatagccgatctaatagccaatttatacaatagttgcttactatactattaatatatgttctcacatgtcatacatatattgcgttttgaaatccgtgctgcagctggctacagatctgtagcctgctacttttctctctcatcttttatcttattaaaatatgtttatagttggctaatagtctgccattgtacctgctctaaaagataagagagaagagcagcgggctatagatttgtagccagctgaagcacggacttcaagatacatgtgcgtatgacaagtgggactaggtattaattgtgtactatgttaggctattcccagctcaatgattaggatgatgtccatagcattaaataagctgccacctagaattaaaaaataatgtaacaagtgaataaagaaggaaagagaaggaaaccaagagtttgtacacaacatccaagacatcatgtgagataagtatcattaaatttaagtatggaatagtggtgtttgcattgaaagggtagtgtctggtactagtttcttgatgatgtagagtttatggaaactatatttagtgttttgggttgggactggccttataagtatctattatatgaattggctattaaggcagcgttcgagagggtgagagagtgaatttgtttgtttcgttttccgcacgtacgtttctcaaactactaaacggtgcattttttgcaaaaattttctataggaaagttgctttaaaaaatcatattaatccattttttaaatttaaaatagttaatacccaattaatcatgagctaatagctcacctcgttttgcgtatcttcccaatcttctcaatccccttatcctcaaacacaccctaaattgattatagatggtttggagcttgtagctggctatactattaaacttactcttaggtccctagattttttgactggtcaaaaattcatccctaaaccacaataccagatataataggactcacatgtagtgactaatttttacctcctcatctccccacttctctgccattgcggtatcaggatgtaaactgaactcaacgtcaagttgaaggacctaaagtgaacttattcctgccttcttaccttgtgtccttgtgcttcggctcgtgctgggtttgtttgggcctgaatttcccgcagtgtaatggatatgaaacgggacgcggtttgtttgagtttttgatagttcaaagcaaaaattattaaggagagaaaatgaccttaatatctctcactaaatgtgaatgattgagagtggatctgtagttaaggggggtaagaatggaaaaaaaataaatgggaggtaattggagaaaaagaattatactatgcgtacaaagcttatatgctgtaatggcactcatatggtacggagagagtagcctataatatagaaatctagaattgaatgtgacataacatagtacaagaggtatatttagatttatggtactatgttatatctaatctggttttagatctatattatatggggcggatggagtaacttctttcatataaactatagcatctctagtttctccagataatttaaatcctcatctaaattatatataaaaataattatagattacaaataaataactataagtcagaaatggaaaaaccccaacgttattctcacgaactcactagttgctttttttttaatcttgagctccccaaacataatcataagttggtgacgatagcacataagtgagttctagttacactaatttctagaagtattccaccaccccctccccttctctctccctttgaaatctcgagcatgggttttgcatgtagtggctaagggttcacaatactactatgtgagaaaactcgaggagttccacccatttcaatagggtttattgtttagttttaaaaaccattcgaagtcccctataaaccatgaaattttgtgaaaaccaatcgattttgttggaattgtaaattttggtggtggctacaccagcaccaaaaataaagatctacaccataaaactaccagcaagcatgctcgaaacatgaagtttacaatgaaatcccgttcacagccaatgttggaaatataaataaaatattttccccatgattttaatatgtttcaaaagggtcttgatatagcggatagtggatagcatgtaaagcgtgtcttgttctaaatatgtttagtaccgatagcgtgtgtttctagcaagcggacccatgaggatgagtcctctatatcacttacctatgtttttctgactttacgttctaggtgctccttactgtggaagaggcgaaggacatgaaccgcttgattggtttagtaggccaggtagtaatagggctagtcatgtactcgtttacatatgtaaacttctcctctcaaaacattattccgttgtagtctagctggttaggatactcggctctcacccgaaagacccgggttcgagtcccggcaacggaattttttttgtttgcaaaaggtagtcgttttttgtcggcaaaaggtagtgatgttttttttggtcttgagaaaacgatagcacatctaactgcttattgtattcttcatcctcttccatttgttttaaatatataaactggtataatcgttctctaaataattgctcccttattattttgtctcggtcattgtcaagtctcaaggatagtgtaaggggttgtttactctactactactattttcaaccatactattttttgacaaaattgtaaaaaaaaataatatctacgtttaatttgtggctaaatcttggtaaatacataagaaatcataccaaaattttggcaatattaccatcttgccaaaatctaaagtagcatatcgtcctctaaacatctgattgcttactattttgtctccgtcattgtccaggcttgattgttgcaagagtccagttccctgatagaccattacagacattatatgtgatcaaacgaaaaacaaaaactggatgagttcattactaactttgatagaaagaaaaaggaagaagtggtcaaaatagaagttaccaatctgccattcttggcatgcaatagcaacagggtttataaaaagcgatgaaaaccggtttgtatttcgtaaaatccggatttcccgaaccgaattgaaaacaccaaccacttgtttttttatcaagttcagaaatatttcaaactaagttttaattttttggcaagatttttcctggttttattggtatttttttcgattcatcaatggtttccgtaaaatccgaagataccgctcgtgagctgtttttatccggtatcagagttgtgaatattgaatatcagtactatgcatgcatttccccgctaacaatggccatgttcatacatggtacatccagctaattaatccaagattaaagagcggtttttatctgatatcagagttgtgaacactgaataatagtactatgcatgcatttccccgctaacaatggccatgttcatacatggtacatccagctaattaatccaacagcaaaaatattgcagatttcaacagcagctggaattagtatatcctgtatatccaaatatccaaatgttccaccctgtatagagcacaacatatggcaaaaccaaaatgcagaggaaaaatttgggaaacggcatgcatcgaggcctatatttattggctctcccctctgttcaccaagttaccccgctcagttggaggctctcacccccacattgcaaatgatttcattgaggtaaacgggaagcaaaagaggcggcaaaaattaatcgagttcatcctttcttggctcgtttcttcctcgtcccatctttttttctttcttgcgtgagtttaattcgctttgtttctccccaaaacctccatttgatttggaaccattttctgcaacaccatggattgcttcgatccaaatggcatcccagataccgattttctttgtttggaatgctggaattttctgcagattcctgcaagatttgaattgtttggtgtaaaattctgccatgccatggatgtgctaattaacttggacatggtttgattattatccccagggtctccaattgaggcgggcggtggcaggtcaaggtggcgattgacaaggcgggaggggatccatcggttggccggccggtcgtcgacgccatggcggtgagccagagcgcgcagctcggcatggccaccgcgttcttcggcgcgctgtccttcctcctcgcgatcctcggcgagctcaacaaggtaattaacgccggcgatgtcgccgccgcgcgcgccgatgctttccgttttttttcctccggcgaatacgcgagctgaaacgggaagctatgggcggtgcagccgccgcacgggacgccgatcaggggcaggggcgtggtggtgtgcaagttcccggcggacccgacggtggcgctgggcgcgctctcggcggtggccgccgcgtgcggcgccggcgtcggcgcgctcgccgtgttcttcccctacaacggcaagcccgtcccgaggaaggccctcttcgactacaccctcctctacgtcttcttccatctcgccatgtaattaatcaatcaagaaacgcgtgatcgatcaagaactccattaactctcgccgcgccgtacgtgttctgagctgagatcagcctcttctcgtgtggcagaggcatcacggtggcagggatagccacgacggcgtgggtgacggcgagcgaggccatgcaccgcgtccggaacgtgcacggcgtcgacccggagtatgcctgcccgacggccaagaccggggtgctcggcggagtggcgttcctcaacctcgacgcgtcactcttctggctcctctgcctcatgctcgccggcaacgtcaaggaggagtacttcgacgacggcggcggcggcggcgaggtcggcgacggcgtcgcggggctcgaggagaaatagccagttagccaccctggcttgtacatgactcgcgcggggaaatcgccaccgcagatttgcatcaagattcggacatatacaactcaggtggggaaaaacaacgtcacgagggagaaatacagcacgcatcacggaaacgatcgaacggcagatgggctaggtgcagaaaaaccgcgtcccatatgcgtgtgaatatgcatggcaacatgacatgtgtgtacatattatgcctggtcgttctaccgagactctcctttcgttgtacataaatttgtctgatccgtattggctgccgctgaagtgcattgttcagtactccctcagactcataatatggcaatctagaattagatgagatatttcaatgaatctgaatagaagggtgttcagacgttatactataaaatgacatatccgattctagattgctattattatgggatggagggagtatcttgtaaccgtgaaatgtgacacgtgtgtaacaccgcaacccgtttatcacctgtaggctaatagggattggtgaggttcgtgtgatctagaggtagagtaataggtggtttagtttcattctgaaaatatagacggatgaatgtggttagtttgacgatacaactcttatatctgagttaatcctttactcaaaagtgaagacgaaattataattaagtaggtatcgtgcatacgtagatccactctacgtgagagtgtactaatgtatattttagaggtagtgttatattcaccaatttacgaaattttagcataagagcagggttatatttggccactttagagattccaaccctaagccctaaaggtttgccggaataaaagggttaacccaattatacagtgtaagattaaaactgtataagtgtctagtgaggtggtatgtcggtcagctttaggtgagagcataccaatttggattttaaagggcagagtattacaatgtggtaccatgcattcaacaatttgtgggatttcaaattggatctttaaccttcaccgagatcccaaataaaatttagagattccatacaaaaattgaaagtttgataaaattggaacgatgtgacggaaaaattggaagtttgtgtgtgtaggaaagttcgatgtgatggaaaagttaaaagtttaaagaaaaaaagttgaaaacttggtgcagattggttcaggaggaggcacaatttagaagggaagtagtaccgactctctctagtggataggggtgatgagacaacaacgggtcactttgatcaatggtggattcatgatttttttagctaggaaaatctaataatagttaatgagtgcatgcaactctatagaccatctacatgaacgaaaaaaaaaagaagtaaacatcgagttgagatttatggaggaaaccaatgcaaaaattaaatcagtgtgtttatatttgtgcattgtcgatgacctacactacatatctacatatgactaatatagtgctctctcacttttttaaggtatattataaagtcaagaagtcaaaattagtgatttgaccatctcaaattatattgttttaacttttatattttttaatacactttattaaaacagagtgagtatataatacattagtatcttgagaaaaagaggtaattaagtggttccagtgaattgaacatgccgataccatttttagcttggaaactatatacggtatgcggccttgctttgctagcgaggctgtgttcgcatgcaccttttcccatcccctccctccttttctgcgcgcacgctttttaaactgctaaacggtgtgttttttttaaaaaagtttctatacgaaagttgcttaaaaaaattaaattaatttattttttttaaaaaatagctaatacttaattaaccacgtgttaatagatcgctccgttttccgcgcttaccgttcttgataggaacgagccactgcgaacacagccgacatgttcttcattagacgtatcagagcaactgaaaaatgtaagggaaaataaaaaaaaaagtaccactacaaagatactgacatgtaggtcgtagatccacatgtcaatgtgtcacgccccgaattagtaccgaccggaactagcccgtgacgctccaatttaacctgttaatcgataccagtcccaagacacagtgctggtatcacaggaagacagattatcacagcaacagatgtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagtcggcttgctcctggaagaactcctcatcagcaggatccgcttcgtcttcttcagcgactgggggggattatttatatagagcaagggtgagtacggggagtactcagcaagccaagggaaaataggtgtttaatgcaggcttcaaggaaaggctgttgtttttgcagttgattttatttgaactcctttttctaaaaacaactaagtgagtgcttctcaaacgacacggttgagacggtgcgtctcgtccggtcggagtatgtgcaatgtatcagtctttaaaatttaaaacaaggttggcacccggccaacagcttttcaaacggccacccgggccaacaactttcaaacggccacccaggcctagctgatcccatcagctgcagatttttcaaacagcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttcaaagccgatacaggtttaccatatgccgacgagaggggtcccagaccaacaacaggttaggtcccagaccatactatgccaggaagcccaggggtcctccccgacaccaccccgacgaatccacatgtctctcgacatcaaggctcccctgataagctagttactcagccaagggtgtcatattccacccatgtggtcgtacttgtcttatgtttggatgaaattcctaggaatcggtccttaagtgcgagagcgggaaaaccgtacacccggtacgttccccggtccacggttttggaaattcatttagttcacaagcaccgacccaagtgtcgggttttccaagtcttttgtaaaactcaagttttacccaagaagttgctcagattttaaatttgaaggcgcccttcggtactcgcacagattgcacgatttccgaggcgcaactgggtggttacaagggaatatggtataacaattaacaaaggaaggatcaaatgcaacaaactaggtagatccgccaatctgccttgctgacgggacagcagattaagtgcgatcctatcaatgcaaaatattttgcaagtaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaatattgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaagaaaagggaaagagggagggattatagacttctcctcgggcggctagggcgcggcccaagggaaaaggagcgaaccagccgagctaaatgggccggccggcccaaggcggcccaagtgcgcgcgcgcgggaggggaggagagagagggccggtggaccgggctcaccgtgcgcggtcccgggtgggacccgcttgtcagcggctcggctcaccgtgcggagggagcacgcggcgcacgcgcgcgggcgggggagggacgcggtgcacgcgcgcggtctgcggaggaacggaggcggcgggcccacgcgcagcctcacggctcgcggtggaacgcgcgcacgggaggggctgaccggggtcggcccgtcccgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtggttgcacgagacgaggggagacgagccaacggctcggattcgccggaggaagcttgacggtggcgaatcgcggcggcggcaaccggcggggagggaagagggaaacagcgacgaggtcacgaggggccgattcccggcggtgagagcatctacgcggccacgggaatccgatgctagcgtcggattgggcggagctacgccgagcgaggctggcgacgagcgggtgctacggagctcgagcggcgacggcggcgagcacacggcgggcgacggcaacggtcggggcggcgccggctagctacggggaggccactcgtgctaccaccgaaaactaaggggggggagatggagcgaggaggaagaacggagggaggcatcaccgaggtgaggaggggcgctgtgacgagaggccgacggcgcgggagggatctctccggcctcgggccggggaagaggaggaagacgagcgcccggagtccctttccgcgtcctagtgcgcaccggctcctccggcacacacgcgacggctgcggtcggcgagagggacggcaatggtgcgggcgagaaacagggaagaatgggagaaaagggaagggagggcgcctgggtttatagggggcggcaatgtcggtttggaaaccgactttggcggtcaaggcgcgagctggcgctctggctagcggccaaaacggtgacaggagggagggaggatgacgccggcgggaggaaaaggggaaaaaggagggagagaaaggggggctcgcccctttcttctttgggaaaagggggaggggagcgggggcgtcgcggcagagggaggagggctcggcctccgtcccttggcggcttgcgcgcggagtggcggggccgaggcgatgacgacggcgatgacggcggggcggtttggagcggcgcgacgacacgggtgacaggcgcgggctggcgcggcagagggtgacgcggcggcggcgaccagacggtcggccactcggcacgcgcgcgcggcttgcaacgggagggcgcggcggatggagaggcgcggctcgagcacgcgcgctggctgcggggccgagcggctgcaggcgcggcagggcagcggggccgggcggcgcaaacgcgacgcgggcgaggaccacgcgggcgcgcgcgcgaacgacgcgcggggagcggcagcgaaggggcggaaaggagggctcggctcggcgcgggcggctct

SEQ ID NO: 61744 - DNA, 121948 bp, Oryza sativa
  unsure (1)..(121948): unsure at all n locations
ggccaccgccgcgctcgcctcatctccgcgccaccgccgctacgagccgctgttgccgactagggtggaaaaaaatcttgggctcatgagctcagctcgggcttggctcgagctcgcttagctcagcttggcttgaatgccaaacgagccaagcccaagcttcattttcagctcggttctgaaacgagccgagcccgagctggctcgtgagccgcttgatttggctcgtgagccttagccatcatgtatttatatggatgattttattttctagtggagttattatttgtcaatatgtaatttatcatctatattttgatgaatttaatatataaagttattttaattttacatgttgataatttgttatcgcttttcttaatgattataaattatatagcttcaacggaaggctcgcaagccagctcgagctggcttgagccaggaaacgagccgagccaagctcatgtcttagctcgcttccctaaccgagccgagccaagccaagcctagcttgttgcaagccattacaagccgagccgagccaggcttggcttggctcgtttccacccctatcgccgatcgccggtccctacgctcgtcctcaccgtgcgcgctgcgcgagagagaaaagaaagagagagaatagagaaagagagagtaagaagtgtatgacatgcgggtcccacaattttttaattaaaaacgctgactggactgccacgtagaccaaaaccaccgtggattgggtcgaggggggtaattcgtccagtttgcatacttgggggtgtcagggttatggataccacatacctaatagtagttgactaaatctcggcaggacccaccacataccatgtcttatacggaaacaaccttcagatataggaggagttccgcataaggaaggatgaatagagttctacatggaaacgacaaggactacttggattgtatccatatttatttccctagttctacttggacaaggggacacctatgggtataaatataaggcctcctagaaggagaggggacacggaacaatagatcaagatacaagatcaacatacaagccaacatgcgccaagacaagacgccggatatcgacttcagagataagcatgactagtcccctacggtgtctacggatactgtcaggagagatatagcactgtctttgatctcgccggatgtggattcgaggaggaagggtaccctgttgtcgattacgagtcagcacttcggactgccaagtcgataacagttagataggctaccccaaatattgtactggtgtgattatggtgaataagagcaacgactggtttcgaccaactggagtaggattattacctgacaattcagggacccgaacctgtataaaaatcctcgtctccatcttttttactacaatctcgcaaatatcctagtaccaatgatccccatactatgcaaatatcagaatcgcgacatcaaacatcgacagtggcgcgcgcagttgggagattttggtgcttcagggtttcgatgaaatgggtttatgagatggattctccaacaacaagctactcgacaacttcagctatgaggagatctaacccgatcggagtatgtcgtccaacaagatcggaaccattgtcgtcaaatatttaatccggcgagatagaccaagcttgaagacattgccgtcgcggaagacgttagttcactaatgtcgaccgtgggattttggtccatgtcggctacttcggaaactaacatcgaccgccaaaaagttcgacgaattaccgccgggtatcgacgacatcagtgatcggtctgacgattagcgtgttcggagaattgacgaggtgtacgtatcctcatcggtttctgatatactccctccctccctaaatatttgacaccgttaatttttttaaacatatttgactgttcattttatttaaaacttttgtgatatgtgtaaaactatatgtatacataaaagtatatttaacaataaattaaatgatagaaaaagaattaacaattacttaaattttttaaataagacgaacggtcaaacatttttaaaaaagtcaacagcgtcaaacattttagtatggaggtagtattatattggcctacagcagaccagagtcaactacacgtcgttacccgccaatcaagcaactagccgactgcatctacacatgtattaagcatgcatgcggtgggacccatgtacagtaatgcatggtgtgtaccgaaggctattttagccataggtatgcttgtatacataggtaagccgtccacacgtgctaatcacggaggacaattcagattggctaaaaggtatttagtagattaattttttaaattaatatatactattttcgtagatatatctggcatatatctacacaggtacgcgatatttcataaaaaaattatcgtacttacttttctgatctatataatattgtcagatccatgatttattatgtttaactagagcatgttttttatataatatctattgtgcgagtgtttccgacgttaaaccaactatggtctaatgctacgggcttgctctattttcttatgataaatcatgcttgtttacggtttacataatccctgatatttaatctgcccgttatatcctgataatactagaagatccacgcagttttctgagtacatactcgatattatctactatatatcttgccttctagaaaatatttttcaggaatgactaagcactcgagtaggttgtgatcaagcacatgcattattgagaacgttctcgacaaatgcaaagttgtcacacccaacctaccaacgatgaccgacgacctatctcatagcactgaccatggctgggctgttcgagacaaggttgttaacggataatttctcgcgaacgttgtcagcttgatcacccaacatgattgcgaacggatatccggatatgctataagttggatatgtgagtcatgctggccacatgagatgcacatgtaacaaaccaactttagcgcccctatagacgatcgagaggcccctactcctggttctcgaaccagtatgacgaagcgatctctcgcgccttaacttccaacggtcgaggtacgacaacggcaatagcgtagcggtgcttgcaccacgacatcaaatggttgaggtacgactacggcaatagcgtagcggtcctcgcaccacgacttcagatggacgaggtacgactacgactggtctttgaccagcagcgtagcggtcctcgcacctcgacttcaatcggtaaggagataaggttgctcctggttctcgaagtagtaggccgtagctatctctcgtacctcgacctcaatcggtcgggagataaggctgctcctggttctcgaaccaataggccatagctatctctcgtacctcgacttcaatcggtcgagagataaggctactcctggttttcgaaccagtaggctgtagcgatctctcacacctttacttcaagtggtcgagttataactacccctggtttccaaccagaggcatagcgatcctcccactaccgttacttcaggtggtcgagttagggctacaactagttttcggccagaggtgtagcgattctcccactacctctacttcaataaagttgatatcaggtacacaatatcgccaagtgttttacccatagatcccttaccacgacgacacctagagttgaaaccaatcctacggtccctttacaccgccctagcaaggcctccaaggaacctatgggaacttcggctggggacgcccagagcggataaggccttgtcaggaaatgcatagacgaacgaccatgtaagatctggtcatgtaagagttctcaccgtgcgtattaaccaagccgtgtaatcggaaattgggtttccaacttcacggctgggggctagggtaagcgatttttcaaccaaggtaggtcaagggtccaagagccttatcctccgagaacgattctccgacgataaggctgggggctagggagagtgtatgactcaacaaactgactgatcgaagtcggtaaaagagaagacgctcatatacaaaaacattggtctgtaaatttaattcattttcagttttccatacatattataacatgtcaccttttaagcattcactcgggggctatttctatctaatattcttttctaagtattgatttcatgaaaattctattcgacattgttcttctcattctcttctctggaaaagtctatctgacctcccctcaacaactcccctcaacccagctcctcattctgttctctgcaaaaagtctatctgacctccctactcggcccatcttcttctcctctctctggccaagctggtaggcgataaagtccattccttctccctcttgccggcaggctcgccgtcccgtccccgcgccttgcctcgactccgcgcggccgcaatcgcgcaagccgcggcaaggaccctagccaaccggcgccggcttgcctgcgtcgtccgtcattacgaacaaaacgccggtgcgccgtcccattctcgccggccgtttcccgtggcgattaggtgggcacggtcgcccagcggcccgtgcggcggcggcgttgagcggcaacagccacttggagccccgcgacacccaatcctcggccgcaaaaataattctacctccatccctaaatatacgatgttggtgataaaaaaaaatcaaaggatgtgatgatttcttaagcataagcacctagtatttgttttgggagcagaaaggagcagggaagcgggaaccagcctagctagctagtatttctaacaactgaaactatcaggatatggattttcatccctgaggggatatctccccttgttgtttgcatgtcatctaaatagttgtaaaaaaaatttaaaaaaaattgacaacatagattagtatgaaatatatcagttcacaaagatgcaacaccaaatttcacttccgcaagttacaacaaaatgaacaaattaaaatgaaaatagttgtgtacattcgcatatatatttgttatttttgttgaaacttgtagaagttgaattttaacttgcatgtttgtggagtcatatatttcatattaatatatggcatatttgaattttaacttgcatgtttgccaaatttttttaaaaaaatttgatgactatatttaggtggcatgcatgaaacgaaggaatatcccctcgagggatgacatcactttcccaatctatcactctattatacactattgtattaatatagtaagcaagagcagtatacggaaaaacccacctattttcggcttctggcataatatatatagcaccctgggcaggcgttgtcggatttgctacagtacacaaacccatgaatgccttcttttggcatcaatcgctttgtcttccgtttcaaaaatcagtttgtcttctgtataaaataaattatcgtctcagtaggctaagttcctatcaagaacaaattatatatctaaccgaaaattatggaagggaaactgcatatctagcacgaaaaattggaacatctttttattccggccttccgagaggccgcattattatcagcagcatgaacacctacaagcaaaactcgctcgctgcaagaactcaaggaggtgaactcatcctcctggttctcaacaactacagattgctcactgctacctacccctacaacaatgctacccacagcttggccggaaatctgatcggcggctgccgctacatcgaattcttccgccgctacgacatcgggtgatgcaccgagaacatcgatccatccttgatcggagtcccagtccggcaccgatgacggcgagcacgccattgctctcacccacttggctggacactctgaagatacgttatctgctgctgttgctgtttctaatttatttgctatgctaatggagacgctgctgaggacatcgatccagccttggttgccggagtcccagtccggcaccgacgacggcgagcacgccattgatgtcaccctctgctctattgctgctgttttgtttgctacattaatggagacgctgccgaggacttcgatccagctgcagccatggtcgtcggagtcccagtccggcaatgtctggcaggagcatgccattgctctgatccggccggtagggctgttcgacgacatgtcgtcgacttcctcgccgtcggtcgacgacgactcggactcccataatgtcgcgtcgagcgcgctcgtcggcgacacccatgtcgccttgacggtttccttgttgttgagaccgcatgacttggagatgaacgggtgctgtagcagctgcgcccccgtgggacggtcgccggcgcgccgttgcaggcatccgcgcaagaagtccttcgcctccggtgacagccaccgtggcaggtccggcacggcgtccgtgtacccgatcttgtggagcgcggggaggacgttgtccatgtcgctccacggggcgcggccggtggccatctcgatgacggtgcagcccagcgcccagacgtcggcggccagcccttgctcctcgccacgcgccacctcgggcgccatgaacgccggcgtgccgccgagcaccggctgcttcgaaccaccgggcattgccaccctcgcgcacccgaagtcggtgagcttggcgcggccatcggcgccgacgagcacattactccccttgacgtcgccgtgcacgacgagcttcccgtggaggtagtcgagccctctaagcacgtcggccgcgtacgtcctgacggcgccctcgtcgaggcgacccccgtttctcgccaccacgtcggcgagcgatccgccgggcgcgtactccaggaacagctggtgctcgccgccgccgcagccgccggaggcctggacaaagccaaggcacttgagcacgtgcggcgaggacagcccggacatgacgctccactctcgccggagctgctgcctcgcggcgccctcgccggccgacttgatgacgaagagctccccggagacgtcgttcgctgccagcgacaccacggcgccggaagcgccccggccaacgctgcggaggcgcgtccatccgccgccgccgatgatcgccgcggccattggggaatcggaggcgagagctgggttgagttgttggtgtttccggattagggttgcgaatgctgctgctcgagtcgatcgaggagagtatttatttaatgcgtgaggctggcatgtgggacccgtagcgccgcgcattgcagtgtgaactgtgaaatgcactagagaagcgagggggccgacaagattattgctatagctggaaatttaccagtgtgctctgttaaggaaaggtgtgtttattatcctcttttttatttttaatccatgtggattaagaaggaaacgagaggtaaaaacaaaaggatagacgtgtttagtgtatttctttctatttttttccctgtgtaaaccatggggtggaaaacgtggagtgagaaatagtacgcttgtgagcaaattttgcgtttttgcatgatccattgtaaaaaaatgaaatgttaaaataaattattaagaactactctctctctcgtcgttatatatggaaattttgtgggtccaagactagtcaatgtggtcatcgagctaagaaattaagatctatggtgcaaaatgtgcctcatatctttagaagtgattaaatggttgattaatcatcatccagtaaagtccctgaaacatgcaataagggacggttaaaggtatgtttgtgctactttatattccattcactactacagaaccaagataaccggtcaaagtgatccgtctcagataacatgagctctaacatgtaaaaaaaaaataccattcgagatatgacaaaagggaactacctgtatatgatgtcatctatgatgagtcaaaattataaaccgtcaaagatcatatatgatgaccccacatatatggcaggtccaatcatatggcccaccagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctctttctaacatatatactctaactcccaaggactcgagccagttgttgcctccttgatccgtcctcgaactccagccatcatcgcctctggccccgaaaacgagccgccaccaccatcttcaccccctaaccccaagcaccggccaccaccttagagatgccagatccaacctccctgatatcggaggacactgaatatgctctccttaacatcatataggtggctagatccaatgcaagccaccatcccctaagccccgagtgctagtgagcctctggacatggtagtgagatgtgcccgcttgtatctcggtggcctagtagtatgacgggcacaaagatgggcttcggaggtgtgtagctatatgggcatggcatccggatctggccacccccatcttggtgaccttggtggcgcagtaccgctggggtctggcaacgatgacaaggaccatgatgacgagcacaacaacaacaatgggcttcggagggggcatgcgatatatagtgacaccttcgaatgggcatagggcataaatgaccaacatgtataggcatcgactggcttgtcgagatcgtcaagaagtacaagatcatctccaaaacgctcagcctggcctcaaccaccaattcctatatcccttccttctcctgaaccgttgggccagagccaaacaaaaccccttccccctccccttcctcctcctcctcccactctcacgccccttcctcacctcgcctgagctgacaaacaatagtagcagcttccctacaaacaaagatggggtatatacgcacacgccaacgtactactcaggcctatagaacaatatcacgcccttttgcaagtctattttgctcatcataggcttcagggtcagccgctgtatcacccccaactatagatggtcatgtgggccacccggcacggcacggcccaagcccggccgtgcctgggccgaggcttgtcgggccggcacggcccgaccgatgcaccaggctgtactgtgccagctcacgggcggcatacacggcccaggcacggcccaatactactcgagccgtgccaggccggcccgaaggcacgatgggctatcgtgcttcctcacagaaaatgtctaattttggtccctcaactctgtgtactgtgtttaaatggctggagaataagtctattttgtatactcctcacataaaagtctatgtttggtccctcaactctatgggctgtgtttaaatggctggaaaataaatctattttgtatacctcttgtcttgggccttgccttatacgattatttaagtctatttttcatctctatattttttatttgaccgggccatgctgtgccggcccaacgtgctgaaggtgtggcccaagcatggcccggctgtcgggtcgggccgacatgggcacgacctcagtcgggccgtgccatgctttgggccgggccacgggccacgggccatatggccatctatacccccgaccaggctgagggaccatgcggcgcgctcaagtgcagcaggactcgttctaactcatccttcacctctccacgctggactgcgactctgcgaggcactgttccggcctccgacatcaacaccttccatgccaataaagctcactacccttgctctgtcaaaaaaatataccaagctagtacttgattagacgtcacgtagttctatgatgactatgaacaggggatctgctctgcctagattaatagtcctaggaggcttctaatcgagtaacaagtcaatatttcggagcgaaggggactacattcgaattatcgatctgtatgaagattagggagagaaaaaggttatgagcacatcgactggggatcgagggacgaggatcatgagaacattcttttattccggcctttcgagaggccgcattattatcagcagcatgaacagctacaagcaaaattctctcgctgcaataactcaaggagatgaactcatcctcctggttctcaacaactacagattgttcactacctactcctacaacaatgctacccacagcttcgccgaaaatctgatcggcggctgccactacatcgaattcttcaggcgcattcccttcaccgccattgtcgtcggccggtgacgcgctgaggacatcgatccaaccatggttgtcggagtcccagtccggcaccgacgacggcgagcacgccattgctctcaccctcttggccggagactctgaagcttcgtaatcttctgctgctgctgtttttttttttgctatgttaatggagacggtgccgagtacttcgatccagccatggtcgtcggagtcccagtccggcaatgtctggccgccggaggatgccattgctatgatccggccggtggggctgttcgacatgtcgtcagcttcctcatcgtctgtcgatgacgacgtctcggactcccacaacgccgccgctgcgtcgagcgcgctcgtcggagacacccatgtcgccttcacgacttctttcttgagaccgcatgactttgagacgaacgggtgctgtagcagctgcgccgccgtgggccggtcgccggcgcgccgttgcatgcaccggcgcaagaagtccttcgcctccggtgacagccatggcggcaggtccggcacggcgtccgtgtacccgatcatccggagagcggcgagcacgtcgtccatgtcgctccacggggcgcggccggtggccatctcgatgacggtgcagcccagcgcccacacgtcggcagccgggccttgctcctcgccgcgcgccacctcgggcgccatgaacgccggcgtgccgccgagcaccggctgcttcgaaccaccgggcatcaccaccctcgcgcacccgaagtcggcgagcttggcgcggccatcggcgccgacgagcacattactccccttgacgtcgccgtgcacgacgagcttctcgtggaggtaatcaagccccctgagcacgtccgccgcgtacgccctgaaggcgctctcgtcgaggcgatccccgtttctcgccaccacgtcggcgagcgatccgccgggcgcgtactcgaggagcagctggtgctcgccgccggcgccggcggcggcctggacaaagccaaggcacctgagcacgtgcggcgaggagagcccggacatgacgctccactctcgccggagctgctgcctcgccgtggcggcgaccgcatcaccggccgacttcacgacgaagagctcgccggaggcgtcgtccgccgcgagagacactgtggcgccggacgcgccgtgcccgatgctgcggaggcgcgtccatccgccgccgccgacgccgatgatcgccgcggccattggggaattaattggaggcgaattgggttgagttcttgatgtttccggattagggttgtgaatttgttgcggatgctgctgctcgtgccgaggagggtatttattgcgtgaggctggcatgtggggcccacccttgcatgcagtccgaaacgcacaggggaatcgagagtggcgtgtggtaatctgactgacatgtggggccgatagggtcaattgctagctggaaatttacctgtgtgtggaactctgtaagtaaggaaaggcgtgcttgttaacctctttttatttttataatccgtgtggattaagaaggaaacgaggattaaaagtaaaaatgaccggcgtgtttagtgtatatctttctattttatcctgtgtgaacaactgagaggaaaatgcggagtgaaaaaaatagtacgtttgtgtgaaaattaaacgaggagcacaagttttgtgttttgtgttgatttagcatgatccattgttaaaattttggatatttctagctcagtgcagctacgaaagagctgcaaaatgcacctcacaattttagtagcgatcaaatggctaattaatcatcatctagtaaagttaccgaacaatgagggacagttacagtcttacagatatttgtccatgtacattgtatagcgtcaactataccgacaagttagatgcaaacactagctactgcactactacgaaaactatttttctgtacaaagatccatttagattgcatacggaacataactggtcgtagtggcggagccaggataaaattatagtggggactcctcagccttttgggccttctaacaatctcagacaaagtctattttaacacccttgcgatagatatatggatttaaattttagggggtcttaatgggggctctaatgattcattagagggtagggggggggtntaaagaccccccagccctcacgctgcctccgccactgactggtcgcgtctacgaaaatcatcctccatttttgtgtgcggttccttaagaaaaccgtacgcaaaaatcaattttcacaggcgggcatcttaacagtcctgcacggaaaaatactcaattttcacagacgggcctaataatcgacctgcacaaaaaaatgagatatttaaccatttgtcacatttagatggggcaattaactttttcccactagacccacatgtcatagacacatgtggacccacgtgtcattgagataggggtggcaaatagttatttgccaaatctaaaagtggcaaatagttaaaaatcccccgaaaaaatacccattccctctcaacctattcaaaaaattcgagtttcccttctctctccctcttatcttctctctctaccccttatcttcacctcactttcctctcctcctcttaatgttctcctcacttcagctgagctagaaccgcgtggccgcgtcgagctcgagccccgcgggccacgccgccggcaccggcgccggcctcttcgcctcctcctccggctccgacggcggtgggcgcgggagtggcgggctcagcgacgtgtgcacggcggtgggcaaccgggagcggcgggctcgcggcagtgtgcacgcgatggcgaacgaccaccccctcccccatccaaatccggcggaggcgactgctcccccccgaatctggcagcgatggccgtccctcgcccggatccagtggcggtggtggcgggcaggcgggttcggacggtggggaggcggcggatccggctaccgcgacggcgacggcgatgacggagtccgtgaggagggcggcggcggcggctgcttttgggttagggttttgcttttttggattttatttttttttagttttttatttttgcgtgtgggcgacataaccaccccgcacacgaaaaatcagattttcgtgtgcgggtgcgccatccgtatataaaaatagcgatttttgtaaatactttgttacatacggttggaagatccacacgtgaaaattgctttcgaccgtacggaataatcgttattgcaccagtgacaagagcacatctgtgctggtttgacaaaacctagcaccgataagggttttcccaccatgaacctcgagctcgtctatgcagagaatatacccggcactgatgagaccacctcttgttgaccggattatgtcattaaatggatatacagactattacatacataagttaaatattttgataaatagagtcaacaaatatcttaaaacaagtgatcaagaagtacaatggaagatatattttttaaaagaagaacatattaaaaacatgcagcaagtcatcatgataataacgtgatgaagcgactgaaatgaagactagtttagctggtgtaaacagtgtgctgcatgtggagagaatatatggcgccttttcgagggagcttcttgctgcggtagcttctcccagaatcagaagttttctcaaacagttcagtttttatccagaatctaaaaattatagaatctaaaagatgaactttaagccaaaagatgaaaaacccagtattttcagtttgtcagaagctgactaccaacagctgtttcgtagaatcttaaacttctccaaacagacccaaacaggcccatgatctgtaactgaaaatgaacggttattaggctaaactggtgctcttggctcacttgatctgacttaattaatcgctcttcctttttctatcattgccacgtggatttggaatagacacacgggcccagacctcctgatctctgggctgataaagaaataaagaaaaaagttagaatactgctaattgcaggcccactaatcaggtcttttcgacaaattcctttgacctgatggcgttcatagtatcacatttttaatctgtatgacttattatctctgtcccaaaatattactatttctaactataataatttattctaaaatgaagttatttattcacctgctatcttctctcaactaataaacaattctctttacctatttttcttttgactatcaatcataattctcctccaattatttgtacctactttcttaatttcttaatgtctgtatatctacataaaaaatgtgtatgtttccttgcgtgtaacggtcctctcacgtgagaaacagaaaaaaaaaagagaagttcgttaagaaaaattatgtgctcctttttacatcaacaatcaattcatttctaataatatagatacatcgtaatgtacgggtatatttcttgacgaccaattcacattggctggtttttaattcccatgtctctattactccctccgttttacaatgtaagtcattcaagtattttccacattcatattgatattaatgaatctaaacatatactcccttcattccaaatcgatctacatatttcataggtataccaagaccaagaaaaactaataactctctcatactatatttattctagcaacaaactcaatgcatgcaccatccccactatttcctagccaataacaaatgaagatattgtatgtgggttataaatacatgtgtgcatggatgcatgcatcaatgtttatttactccaatgcacaaataacgaatagacctaataaatgaacacaacaatgtagatcatttagaaataaacttaaaaaaaactatatgtagatcaatttggaatggagggagtatatctatatagattcattaacattattatgaatgtggaaaatgccagaatgacttatagtgtgaaacggaggaagtattttcttaatggaataaaaccatatatctagtgtaggttaaagacaacctggacagtgtcagacttaattaaacacaagttgcagatagattagtggcagtgaccatactgtttcttgtttcatttttttttaaaaagttgcttctactcgaattaaccacgaatttcacacgaaactgcaaccttgcaaaatatataatccttcccagcaaggacgcattcattttgtcgccatggccaagcccaagacctctcctctccaccgtgtcatcggcgccgcccgctgggacgccgagcgccccctcggccgcctcctcatcctcgcccacgccgccttcctcgacgccggcttcgtgcccgccgccgccgccgccgacgacaactccatccggcttccgaggaaggtgggcaggacggcctcctcgctcccgctccggtacgccgcgccgcagctgctgcactggccggacgacgccgccgccgtccagctgaggctgtgcgcgcacgggcgccacctcgtcttgtacgtgtccatggctagatgctccatgttcagggagtggttggacacgtactgggtgtgcctcgacgcgctcgccgccgcggcgctcctcggcggcgcgctggacgacacggcgcgcgcgctgcggcgcgacgcgcgcctggccgcgctctggggcgcgctcgccgacaggctgtgccggcgcgtcctcgtcgacgtgtgcgccaggaacggcgtgacgctggagcccaccttcatgtcgctccccgacgacgtcaaggcggccatcctggcgaggctccccgacggcgacgacctcgcgagggccgagtgcacctgcgccgggctccggcgcctcgtcgcggaccgcgaccgcgacgccgcgctctggaagccgaggtacgagaagctgcctttcctgctgcagctcatcggaggcggcgacgacgacgacggcgagccgacgacggaggtgagctggaagaagaagtatgtggcggcgaggctgtggcctttcggagagctctttgcgtccatgagagagacacggaggctaccgatttatgcaccattgttggacttggacttcgattcattcacacgcttttgggtgttcgatgataagccgtcgccgttgccggaggagatcactgtccctcgtcatcgtcgccgccgtcggaggtggagagcgatgccaagggacgccggccatggccttgcggcgcggggacatggcggcgacaagaagccgcggcatggcgccggcgcggttcactcgccgtcttcccggttccgatggaagcaccggtgatcgccggcgatcgacgtgctttggtttcgctgttgcagagcctttttggcttagttgtttatggatttcttttcgtttgctttgtaaatgtgctgagaatgagatcatcgtctgaaactgaaaatggttaagcctaatcacaaatgtgaatgccttgttgctactttggatctttgatccactggtgttagaacttagaactctcctgaccaagtattaagtatgaggttagtaattaaattagagaccttatccttatttccttagtaatctttttcaatagtgggtatctggtctttgcttcaattgaaactacacgcataataatttacagcttataaaactgctaatatgaaaaagcaaagaaccacacacactccacccaccgtgtacaatgacttctagattcatgtagctagtgatttctttgtagcagtaaactatgctaagtggaatccaattaagatttttcttctgttacaaatgctgacacttacgaatgctcatttaacacacagtcaaagggaaaaaattcagcaacaaatctctagactcattaaaaaatccacggaaagcttacccagtactatgtatttatgggcacaatgatttaaagtctatgagtgaaattatatactcacgactctttattttaaaccaagcacccacgacgtactccataatcacactagctaactatacattttcaattttatattttcaccatatcgaaacaaaagtataaactcaattaatggtaaaactagcttctttcgatgttagcatagatttacagtttctggatcaaacaaaaccaatggctctaactaaaaaggtatattcaccacaaaagttgcttaatatatgttcttgacaaaatgaatgttagattactgtttcttcttcctagctaaccggtggtgttccttgtcatgctgactatggctgagaacattggccatatatcatatcaaaggcataaaacagtcagatatgtccaaccatgcatggaaaggcttatatcggcaaacgatatgattatgctgcaaggcgcaatatggttcctttttaaaaagaacaatctggttttgttgttaatttctctacttttgttttgtttatggaaatttctctacgtttttttttacgaaatatttactccagctggagaaacaattttagaggatataactacaccctagaaaatgtccaatagaattatttacctcatattttggagcgaatcagggcatgtacaacatatgaacatgcccacaaattaaacctcagatatgaggtaataaataattctactggaaccatattattatgaggtaaataattctactggaacatattcttctccacagagtaaaatctattggaaccatattctactccacggagtaaatgttccaggtatgaggtaaataattatactgtaacgattgaacatgcaactaattcgtggagaaatgtcaccaactaataaatcaaaccccaggttttttttatgcaacatcacattcttacacttttttgttattaaaacaaacttgacagggtgcaggcaagcatgtataggcataaataaatacacccaaggcccatttttgcacttctctcctaggatgattaaataattagtaaaagcacagttttgtcagaaaagaaccttgtcacgaaattcagacgtaactccactatggctgtatttagatccaaactttcaactttttccaccacattaacatgtcatacacacacaacttttcagtcacatcgtaccaattacaatccaaactttcaattttggaaggaaataaaaaaagcctatacaactgcatccattccctgcaaacgtcgacactcgacacattgatgatcacttagtcgccatggccgacacctctccactccaccggatcatcggcgccgccatgtgggacgccgagcccctgctcggccgcctcgtaatcctcgcccacgccgccttcctcgacgcgggtttcgtgtccaccggcgccgccaatgacgacggcgcccaaagctccgtccgacttccgaggcaggtgggcgcgacggcctccgcgctctcgctccggtacaccgcgccgcagctgctgcaccggcaccggcaagacgccgccgcggcggcggcggcgacggttgcgctgagggtgtgcgcgcacgggcggcgccacgtcgtgttctacgtgtgcgtcaggttcgccaacccgtggctggacacgtactggatctgcctcgacgcgcccgccgccgcggcgctcctcgccggcgggctggacgacacggcgcgcgcgctggcgaggcgcgagcgcggcgcgcgcctcgccgcgctctggagcgcgctcgccgacaggctgtgccggcgcgtcctcgtcgacctgtgcgccaagaacggcgtgccggtggagcccgagcacgagctcatgtcgctccccgacgacgtcaaggtcgccatcctcgccaggctcgccgccggcgaggacctcgcgagggtggagtgcacgtgcgtcgggcttaacctcctcgtcgcggagcacgactccacgctctggaagcccatgtacacgaagctgcgttcccagctgcggcggcggctgcggtttctcggagtcagctatggcgagccgacggcggtgagctggaaggctaggtacgtggcggtgaggcggcggcgtgttccggcggcgcatgacgtgttcatgggagaaatactactgccggtgatgacagagtggatgagagttccatggatacgtaggtatccatttgtgccgcctccgccgccggagtcgccggaggaggaggagacggtcgtacctcgtcggaggaggaggcggagagcaatgccaagggacgccggccatggccgtgcggcgccgggacatggcggcgacaagaagcagtggcgtggcgccggcgcggttcattcgccgtcttccgggttccgatggaaacaccggtgaccgcccgccggcgatgaactttgcttaatttcgccgttacagattttacttagtttatttattttctgtggatgtttttctttgtttgctatggacattttctgagtgtttttgagattatcatctgaaactaaaaatggttagtactaaccacaaatatgtacgaacaatcgagaagtagatatgaggttaaatacttaataattaattagaaatttaatcgtgaaaaattagagatctaataaactgaacatgtctttaaccaaccagaaggcccgtgaaagaacataggagtattgtttaagctagtgccgataagacttctctaatttatcaaatttgtagaaagacatcgcaacattctaaagcatactatcaaaaatatattcaatatattcaatgtttatatttaatgaaactaatttaatttaatgttatacgagttactatatttctccataaacttgcttatataagtttatcttagaaaaaatcaaaacgatttatgaagtatgtattataagtagattaaaaatcaatgtttaaaataatagactatgataaaacggttttaaaattaatattttggctatggccgataaggcagtgagctgtgagcagatgatcatgttggtctttttcttctctttttcgatgacttcaaccagatgtgtctaaccatgcatcgaaaagcttacgacgataaattcaagatgatgcagctcgcaatctgattcgatccattactatttttttcaaaaaaaatatttgacgaaacaacctaagcaatttgttcttacatggcattctccagattgctttgacattatggctgtcatattaaatctccataccggtcgaaacttagtggtcacacgtcaatcgactatatcttcctctgtctagttcgtgatgcctatctaatactacctatgttttttaatacttcaccgtcccaaaatataaatatttttaaccctgacacggtcatcgagatgctattttgaccaacaatatttataaaagtaagatgttttaaataaaaagagttgcatactatgatagtttgtttaataataaatctagtaaacttcaattttacatgattgattttttttattttttctgctattaatggtcaacgtaaacaatgtttgacttgtcattatgctaaaaatgcttatatttaagacggagggagtatatgatggcattgattttttaacaaacatttatcactcgtcttattcaaaatttttatgtaaatataaaaatatttaagtcatatttaaagaacatttgatgataaatcaagtcatgataaaataaataataattaaatatttttttaataaaataaatggttaaacgtatttttaaaaattaacgatgtcatatattaaaaagctgagggaataccttttttgggaaatcgatcgatggcgtgttgttctagagtgccgaggttttttagttattattgttgttggaggtacaccacgaggtcgttcggccggatctgccgaaaccaacaacttaggcgacgggtttggactggaggcaagcggcgaaggttgaaaagggaaccgtatgggcgaaagccgtggcttggaaatacgcgggctttgtcaggcaaggaccttgtcggcgggccgcatggccgaaggcgataaggcgaaggctttggcacagaggcacgggcttcgccaagtactgaactctgccaagatgaggcccagcgggctgttacgctctcagggggtttcgtcaaatacataggccgagcccttttggcccagtagaggcccatgcatgcaaaggacaatgtgtacccctgataatgtctctatcataagggtagccatgtaaattcccctgtaaaacctaaaccccaaaggaggaacttgtaatagagctataaatagccccctaaagctatgtaataggggcaaccaaaaagtttttactaagcaatacaattatctttcttttccaatcactgttgagagaatcacgcctttcgacgtgacacggttgtctattcgacaacaattgttaactatgtgatccaaggtcatatattatactgacaatgacagacttaattaaacatatattacgtgtgggatggattagaggaaccgaccattgcttttatttaattagttaaccatcttcgttggagacaagagattcacatttcaccctcacaatatgctgttgtcttttccttttagtaaaccacgcgattgttatatacttgacttcatctaaaatggaggaattttagagttcgaaatttgttgctggttttcgcctatttataggcgtattaggagcatatgcgcagagatgtgaatgttgtgttccgtgtgttctgtgtagtgatgtgtgtgcgtgtgtacttgtgtctgccatataatggaaaaaatagaggaattttaaaagattgaactacataatataaaaaaaaaatcccgcataatgtttttgagcattaattgatcacaaattaattatctcaggtattagattcattgcaacaactcaggatagccctcagcacctcaccgtctcaccctcgtccccaatgtttgccatcttaaaaaaaataaataaataaaagtggactagaggcaaaccgtgtcatgcataaataaattcatctcgaatttgttttttaagaaaaggccaaagacccgcttttatagaaagccatgaccgcatgagctgggaacaccggcttgctatgtaagttcggtacatatgacatccacacaccgcaggccacattccagacagtacaaccgaaagagttacaagacagaagcgaaaccggaccagcaactctaagaactccaacaaaaggaccttacagactaagaacatgaggccagaccacgtaagatcaaatcacaagaactaaaccaaccagagggggtgaatggttggtataccaaaaaccgaaaacttttagcggaaataaaagttactctcaaattcgacggatcgcggtctgaccgaaggtattgcgccagtttgaccgcctgatgaacgtcggtctgaccgatgtagatcgatcggtcgaaccgccgaagtcgcctgccgccgccggtctgaccgccgcgatgctgccggtctgaccgccggtgtgtcgccggttagaccgtcgaaacccggtgaaacacaaatcgaagaacttttaaagtagatgataattttattgattctctctgtgtttacaaagtgcatcaatagcagtccttacaaaaatttcgactaaactcgaaaccctaactcaaaactcaactcaattgctctcaaaagcaataccggaaagcctcacgctccccctctatttatacccgaggtaggcagcctaaagccacgaaccaaactcatactagaagtcctaaacaccttaggaaaccctttagtacaagaaacaaactttacataaccaatcataccaaatttggactccttccaaattcgactccgcatcccatacgcacacaatacctccatcgtatgccatatggaatcttcacaaaccatgtgcatcaactctagcctaagtatcccgcatgatctctgaccacctcggatgtcgtcttatccctaagccgactcccggtccatcatcgcaaatactctcccgaggcatcgagtcacctacacataaaataaacaaagaaaccatattccgagaccaagctatctccaacttgactcattagtagcaaacaacagtattacatatgtatagtatccatccagaagccataatcatgaaacaatcacggatatccaaacaaacaacccgaaactaaaactgacacaacgtcggccggtcagaccgcgggctgcgccggtctgaccacgcatatacctccggtctgaccggcataccctacccggtttgaccggtcccgacaaacagcagtccctgtcaatcacctgtaaattccaatcatctataaaaccacttcgcaaataaattccaaataacaaaaccaataatctccgatgccaattgttcatcacagaataataatcaaaaacacctttaattttacaatctccctcttgatgaacacattggcaaacccatcaaaatgttttggtgtttggaaaaataaaaacaaaagtggtaaaaagcacacttcgtacaaatgttacacatcgtgctcaaaaattcaaaagaaaacttctctctcttttgaaaaaaaagaaatttcccaatcgacaagctcttctcaaatcatttgtttctccaaaaatttcacattacttctcccccttttgacaatgatttcatcaagcatagaaattatgttcattaatgtataagagcttatcatacatatagcatatcatatcatgtgttgcaataaaaagaagatgaacccatctataatatagcaaacatgcattaaagtataaacatgaaccaaagattttacaattaagcttgaatcaacaatcaaaattcatgatttcatacgatttataatacaacatctttacaagcacataggttgaagaataaacactaaacgcatatacctaatgcatttatcattctttctcaaataacctttggcacaaaacaaccaagagaatttttttttaactttttcttttcttgagcctttttgctcatatttttctcttttattccaggtacgtccctgtcgtcaagactatttccagggattcgacacccattattttgctcacatcgaatacgtcagtgtcgtcaagactgtttccaaggattcggtattctttttttatatttttattctctttttcacaatgagcaattaaagctatttgaggaataacaattcaataaagcatatatgtagagcatttataaaacaaaccatatgctcgcatcaacattgcacatttgctttattcaagtatagaatttaagtgtcatgcatcatctcccttaaaaacaaaatctaaatatcatgaaaagactagaatacatataagctatgctagagacaaataaaccttcaaggtattgctagaatgcacaagaaaatactatatgtatagaacaaagctctcttttctcaatttttctcattgtcatatttttgcttgataaaaccatgaggtacaaactccccctcaaaccatgccaaaaggatgaattattcccaattcaccacgaagaaaagcaaaatgattagaatccaaaggtttgttgaaaatatcagcaagttgcaacattttgtccaaaaactgcaattcgacatctcccttctcaacatgatccctcaaaaagtgaaaacaaatattaatgtgctttgtgcgtgagtgttgaacaggattcttagcaatgttaatagcactagtattatcacaaaagagaggtactttctcaaaagtaagactataatatttcaaagtagataaaagccaaagaatctgtgaacaacagctagcagcagcaacatattcagattcagaagttgattgagcaacactagattgtttcctagaagaccatgcaatcaatgatgtaccaagaaaatgacatattccactagtacttttcctatcaattctacaacccccaaaatcagtatcggaatatccacttaagcatatagaagatgaagtagaataccaaattccaaactcaagtgtatgattcaaatacctcattattcgcttgatcgcttgacgatgtgaagcacgaggagaagctggaaagcgtgtatacaaacacatagcaagttgtatgtctagcctagaagcaattagatacaacaaagatccaatcatacttctatactccttttgatcaacagcttcaccatcttcatcaggatccaacacagctgtaaaaccaattggtgttgaaattggcttgcaattttccatcttgaaccgtctcaaaagatccttcgtatacttcatttgatgcacaaaagtaccttgaggtgtttgcttaatttgcaatcccaaaaagtacgataactcacccatcatgctcatctcaaattccctgcgcatagtctcagcaaactccacaaccaaggcgtgagttgaacaaccaaaaatgatatcatccacataaatctgaacaaaaagttgattatcaccatgcttaagaacaaaaagcgttttgtcaacctttcccattgaaaaacctttcgcaagcaaaaagttcttaaacctatcataccatgccctaggagcttgtttcaaaccatacaaagctttagacaatttaaaaacatggttaggaaactcaggattttcaaaacctggtggttgtttgacataaacttcctcctgtataaaaccattaagaaaatcacttttcacatccatttgatacaatttaaaaccttttgaaatagcaaaagccaacaaaagtctaattgcctcaactctagcaacatgagcaaaagtttcatcaaaatccaaaccctccacttgggtaaaaccttgagcaacaagtctagttttatttctcacaatcaaaccatcctcattttgtttatttttgaaaacccacttggttccaaaaatattatgttcagaaggtggttcaacaaaagtccaaactttgtttctctcaaaattttcaagttcttcatgcatggcattaatccacgattaatcagttaatgcatgtgacacatctttgggttcaaaagaagcaacaaatgcataatttgcacaaacatcatgagtcgttaccttagaccttgtagtccgctcacctatattaccaatgatttattccgacagatgtcgtcgttgaatgtgcaaaggagtagcgacttctgaagttgatccacgttctgtatcagtactggtcaaagttatagtctccggaggtccatctcgatcagcatcaacagtaccggaacccgacgagcctggccggtctaactgctcttcttgaggcggtctgaccggcggcgtgccggtggtctaaccggccgagccgacctcgtcgttgttgtcgtcttcactctcgtcttcaaaaatacgaccatcctccccctgaacctgtgacaatgtacctgcaatatcgggtctagtacctggactagcctcatcaaaagaaacttcgcaagtctcaatgattttgttagtctccaaaataagtacacgatagccacgactatgtgcggggtaaccaagaaacaatccatcggtagaacgtgcctcaaacttatccaaatttccagatttcaagacaaagcacttgcaactcaaaacacgcaaatgtgaaactttaggttgacgtccaaatcgaagttcataagaagtttttccaagttttgatctcaagaaaactcgatttgaaatataacacgcagtattaatcgcctcagcccaaaattttttaggagttttatattcatccaacatcattctagccatctcaaccaaaacacgatatttcctttcaacaacaccgttttgttgcggtacacgaggagaagaaaattcatgttcaagaccttttttgttgcaaaattgttcaaaagaagcatttttaaacttaccaccattatcacttcgaattcttttcaaagaaccaggaaattcaagatccaatcgaagaaacaaaccacgaaagtgttgaaaagcttcgtccttagttgccataaagaaaagccaagaatatcaagaaaaatcgtcaacaataaccaacacataccactttcctccaacagattgcactctagctggaccaacagtgtccatatgtaatagctgtcccggtgcatccgtcatcacagaaacaataggagcatgtgaacaagcaaccatcttagcatgacgacacggtgtgcaaaccaaatcaatatttttcttaagtttaggcaaaccacgaacaagatccaaaccacttaacctagtgagatgatcaaaaccaacatgtccaagtctacgatgccaaaacatcacatctttatcaaacttagcagccaaacatgttatcacaggtgaaacaggattttcaaaatcagctttaaacactcttccatagcgagaaataatcaacacagaatcaccacaagaatcaaaaactttacttccagttttcttacagtgaacctcaaaattttcatcaaaaatttgtgaaactgaaagcaaattgtactttaagtcctcaactaaagcttcatcttcaattcaaatttttcatataccttaaccaaacctgtagcgagaacgacacttgtagaagcatcaccaaagataatcgattcagtcttggatgcctttttgagggaggagaaccaatttttatcaccggtcatgtgccgcgaataaccggaatccacgatccacacgttctccttccttgccaccaaagcctacacacaagcataagtcgaagcctcagtactggggttagatgataataaaaatttaggaatccagtactgagacacacgaccagaagatccaataggcatatatccacgtgtaaaaatagtttgagaattttcagaaaaattcctctgaggccggtctgaccgaggtgttactgccggtctgaccgggggccggtctgatcgccgctgcaccgccggtctgaccggtgttcggtctgaccgaggcactgcagccggtctgaccggtcgccggtccgaccatgggacccactgcggtctaaccggttccctcgaggaaaaatcagatttttgccactttgattttgcaaaagcaatctctctctcgtttttctgtttatgagttaatctgaaacaaaaaccaacaatatgtccatctttaccataaaaagaacaagtatatttttcacgatgattagacacattggtagaattagaagacttagcaacacaaccaacaacaggagatttgtgcactcaattgttccacaaagttgaatatataaacgtacgaacaaggcagatgaagaggaagatataaggcccatttggtagccagcttctgagaatatggaaaagctaggtttcccagcttctggcttctagtttattttttggattctacaactacagcttctcagaatttggaccaaaagctggactgtttagagaagcttctgattctgaaagaagctgcagcagatagatgctcccccagtcgattgacgtgtgatcaccaattcaccatgttaccactgttagggaatccacaatgtggtgtaaaagtagtccataagcaatagaatattccattcagctacctattactattgtgcaactagtccatatagaaaaaatagcaaaagatacccatatgcatatggactacccatatggaataaattatattatctatctctactcctctcttctcctaatgataccttgtaggacattgccatagggataaactatttatgtgggtcccatctatatggatcactttgccatatacatcggtgatgcccttatacatattgagatttaattaatatggaaactgtaaggtcaaagcaagttggagaacgccagctggtaagagcaaaattgtttatgcgcgccctttcgtctaataattcaggaaaaacagtatggaatcagattgcgtgttgcatcatcttcaatttttcgttataagattttccatgcatgtggttagaaatatctggctgaagttataaaaaaagaaaatctaaagtgtaaaaaaagaaaatctaattagcatagtttaattactagagtctgtcaccatcctactgaattatattataaacgattactcatactctcaacgtctgtccattaacttatcaaccataggcaaaatataaattttaaaatttaactttagagtttattttaaagttgttttatcgtagtccattttcaagcattgacttttaaaccgctaataacacatatataaaagtttgtaggaattgtattcaaggtaaaaaaaaatttggtaggtgtgtgcattttaatgcaagaacttgaaaactgagcaaattggtacacctacttggttagatagtgtgcttttggtcaaagtgaatgccacatggatgttttttccaggttagcaagaaacgttatttttgttacatgtttctgctgcatccttggaacaatagatagactgaaggcccatttcagcaaatatatatcaaatcagaagcactacaagtctagatttagaattgatacaggacaccgtgatttattgatcaatttatgaaccaattcactgtaaaaaggcaaataggtgtcgccactataggtgccggcacagctaaaaacgacacctataatgcctttcctgcccatgcacccacccccacgcgccaaatattcaaaaccggcacctttatgtcgaaataggtgccggtttttaaataaaactgatacctaaaacctgtgtcagagaaagctgacggttttaaacccaccggcaccttttaatcttccccctcccacactagctgttggtgggccccacacgtaggttcggttttaagactagggtgttggttctcgtcataaagccgacacctttattccaatagtgcttttcatgcccgatggtaggccctacaaaaaggtgccctttttttgtatgacaagataaaggtgccggtttttggtctagaaccggcacctttgttccaatagtgcttttcatgcctggtggtgggcccaacaaaaaggtgccggttttttgtacgacaagacaaaggtgtcggtttttgtctagaaccggcacctttgttccaatagtgcttttcatgcccgatggtgggccctacacatatgtgctggtttttttgtatgacaagacaaaggtgccgatttttggtctagaactgacacctatgttccaaagtgcttgtagtagccattggtgagccctacacataggtgccggttgggaagacaaaggtgttggttttgggtctagaaccggcacctttgttctgacaatagtacatatatatatataatccatcccttgccactcgaactgattgagcaagaagagagtggcgcctctcgttcttgccccgagcagctagaggagggcaggaggttttactccattttttttgtggtgtttggttaaaggttgaagcctaaatgtaaaaatcaattatttctcgctccgtttaactcttggttgttgatttgaattgccatgtgctatatgcatgcatgtaaaatacactatgggtgttgtttttagggataattctttttatctttttttgtgtctattgttgcatgaaatgctaaatttgcgttaatgttttcttccatccttcgtcacggccgttagtcaaattaatgctagtcaaactatgttaaggccatggaaatgtccattgatagcttgatttatctcaaatttatgttacgggtgcccatcgatccactagaggagatggaaatggttttgctcgatttttcttgggttttggttgaagattgaagcctacaaagtaaatattcattatttctcacccagattcacacctgctcgttgaattgaattgccgtgtggtaatacatgtaaaatgcactagtcatttgtatggatccatcagtcatttgtagatatgttcttagatgtcatgctaaattttaattaatgttttattccatctacgccatcgtcgttaatgtttcacattagccaaatattttttttgcattgacgaaaaatagaattttttttatcttttcattagccatgaatatctaattaaggtgatgtgggcgtgcgcaaaaatctcaattttatcgtagggtaaaatgggcattactctttgtttttattctaatgtgcttgtacattatgaaatcctcattgtttttttccttcacgattggtaataaacgataattattgcaggtacccattggatataatggatctagaatggataactatagcggatcgtgactctgtggagtatttcaggggagtaacggctcttgttgatgcaccggaatatatttggtgtccatgccatgaatgcaagaaagacagacaacttccggctcacgggtaaattcacatctccttacaatgggttttagggacaacttccttggcgaggaggtgcacgtgaggaaagtgccggcaactgtcacgggcatgatgcggatgttggctgcgaggaggataaccaaacatgtgtcgatcacggtgaacctaatctagatcagatgctacacgacggggagagatttgacactgatgatagggaatatcgcaagttcacaaccatggtgaaggactccaaaactccagtttacaatggatgtaaggtggagcacaataagcttcaagtggtcctattgctgcttcacctaaaggcgagcaacggatggtccgataagagcttcactgagttgctagagctcttgaaagaaattctcctatggacaacatctagccagaatcgacatacaagccaaaaaagttatatgtcccctttggtcttgacatacagaaaattcatgcttgtctaattgattgcattctttaccggtatgcaaggcttctagctataagtggggagacggggatgatgagggtggaaataagaaaagagtgccggtgaaggtcgttcggtattttccaatcatctcctgtttggaacgtatgtatgcaaacaaaaagcatgccaagctgatgcgttggcaccacaaagagtgtaaaaaagatggaatgatacgacatccagctgatgggtctcagtgaagaaagatagacaagaagtaccaaagttttctcacgacatcagaaatgtgaggattgcactaagcactgatggcatgaacccatcttgtaacatgagcagtcgtcatagcacatggccagtggttgttattatctacaacctcccttctgggctctgtttgaagcataagtacatcatgatgctacttctgattcaagggcctaaacaacctggcaacgatatcgatgtgtacttcaagccgctggtagaggatcttcatacactatggacggaaggcgtgcagatgtgggatacgtacaaacaagaacacttcacatgtcgggctattttgttagggacaataacagactacccagcacttggaaacacgtcgggccaaatggtgaagggcatgaaagcatgtgtatggtgcatggcccaaacaggaggcaagtgactgaatcatagtcggaaaaccgtgtacatgcgtcatgggaggttcctcaggcgggatcacccacaccaccaaaataaaaaagcttttgatgggacggtggaaatagatggacgtccaatttttagaaccggaagtgagatcttggcggaggtgaagatccacatcgagcggtgagacccctctattcaaaaagaagtctatcttttgggacttgccgtattggaaagacttggatattcgtcatgcgatcaatgtgatgcacgtggagaagaacgtgtgtgaaggcgtgctcggggtattgttgaacacacctggcaagatgaaggacactttgcaagcacggaaagatcttggaagacatggacatcaggaaagagctgcatcctcaagacagaggaaatggctgctactacctacctccggcatgctacactcttagtgctacagaaaaaacgagtatgtgggaatgcctgcggggtgtaaaagtcccatccggttactgtgcgaacattaagagacttgttagcatgaaagataagaggttggttggaatgttcttaagcttcacatgactgccatgttcttatgtcgcagctgctaccggtcgcaattagaggtatccttctagaaaagatccgagacccaatcatcaagttatgccagtttttcaaagcgataaaccaaaaggttatcgatccggcttcattgggcatgcttcaggaggacacgattctcaatctttgtcagctagatatgttgttccctctctctttcttcgatatcatggtgcatctgattgttcatcttgtggaacaagtaaagatcttaggtacagcatatctggatagcatgtgggctttcgagaggtttatgggtatcataaagaaatatgtcaggaacagatcgatacccgaaggcagcatcatcgagggttatgcaacagaggaggtggtcgaattctgtatagattacatggatctacaacctatcggtgttcccgtgccccgtcacgagggcaggatgcttggaaagggaatattaggtcataggagaattgtcgcccccaatcgacaaaccataagacatgcccattttgcagtgttacgacaatcagctttggtggctccgtacatggacatgcacttggatgttctccgtagagacaatcccaggaaaggcgcagcatggctcgcgaagatgcataaacttcaatttgggaaatggttgatggagtacctaacaactgcagacatcgatggtgcccatttttctttatctcggtggccatccaacacaatccacatgtaccagggctatgatatgaatgggtataccttttataccaagtcccaggacaacaagagtataaatcaaaacagtggtgtgcgcatcgacgcctacgatgatggtggcaacaagcagacttaatacggtttcatagagtcaatatgggagttagattacggagccctcaaagtccctctattccaatgcaagtgggtcaaaattccaagggggttgaagattgacaagcatggaacgatcatcgttgacctcaatgatgttggctacgaagatgaaccattcgtgctcgcaaaatccgttaagcagatattctatgtcaaggacccatcactcatgaagccacatcatgttgtactcgaagacaagcaaagtattgtcggaatggagatatcatcgacgaagatgactacgatcaacccgatgagccaccgacacccacaactgatgtcgagactgaaaacgaggcaagcgctaaagagaatgaccaaggcttgtatgtatgatccgatcatgcgaaagggatagtagttagggtgtgaattaatttctaacttcattgtatggatttgtatggcaacttcattgtacggatttgtatggcaactgtttgatttaaatcaacaaaatttggaaatatattatgtgcactctaatatttaatttctattttggtcctttatactcttttttggaacatattaagtaataggcctattttctagtgaaacataaatttatgaaagaaattataatttataattaatacatataaagttacatttatataacatgcttatctctactattataaaaattagaacctattatagtcaaaggttccggatttagtgttagaaccaacacctatctcctttacttaaataccctcacttatccctttactctctcacccttatccattcactctctccttctcaccctcggcggtggcagtggcgggggctgtggcggcgaacctcaccctcggcggcgcggcgccctccaggtacggcggcgaggaggcagtgggtgtggtgcggcggtgtgtggcggcggcaatacagtggcgaggagggctcgacggagcgcggcggtgcggcggctcgacgcggcgatgaggagggctgaacggcgtgcggcagcgaggaggaggtgagcggcggcggtggcatatccatcccaacggtacctgcatcctcctccttctcttcttcttcttcctcgtcgttgtcttgccgcaaccacgcctccacgccctcctcttgctgctactgctactcctgttgtcgtcgttgtcttgtcgtttcttgcggttgttgggggaggggatgcgagggaagggagggggcggacgctagaggagaggagaaaggcgacgaggaggaagaggagggttcttgcggtggagatgaccggcgagaggaggccagcagcggtgggtgccctggaaaaggatatataagggagagcggacggtgtattggtatgagaaggaaggatatggagagattgcagcgggggaggcggctgacggcgaggagtggctaggaggaggaggtcgcgctggcggtggcggtagatgaagcagagagagaaaaggaggggaacttgaagtacctggaggtgtggcgctgcaagttcagcgataagctcttcatgctgtaaccgccgctagccagcgtctcgctgccagtgacccacgtaggatggcgcggcggcggaggcggcggcggcgccagccatggcatgcatgcatgtcgatcagtagcatagttttgacttttgaaaggggtatagtagtgtaaaagaggggtagaaagtaattaattaaagttaatggttattttgtgatgattataactatttaattaatcaactaggtcgatcttaatcttaagatggtgtactgagttgatgatgctggtaatgtctgtaaatgtggaatttaagatctggattttaccgtgtatgttcttcttttgatttatctgctttccctttttcgactagttcttttgcttaggtaaattttcattttgcattcttcagttgtagcggttgactaatggctgagatgcgactttatttcattttcatcagattttacatggtttcttaataaaaaaattgcttgacgaaactcagctctactccaaagaaatatgcaaaattttcacatgatttatggtcggatcgagtattcaagttcagcttatttgtataatgttcttgcagcggcagcagtgaagaggggcagcggtgtgcggcggcaaggcggaggtggaggcagcaacgatggcccaatgccgaggtacacccctcctccccccatccatcctcttcttcttcttccctcctccacttaggaaaatttgctcatgtgtgtgatggatttgtcccttactgtcatgggtgacggatgtgtgaatgtgtgtgatggatttgtgaaatatgttttgttaatggagtagtatagatttaagcttcacataaatatatttgtaaaatgccattgtatcattgataataatgctctattggtaatcacagtaaagtatccacattgtgcttgtcatcataattcgtcactagcatgctaggatatatagaaaaatggcaagtctagcatggtaaaccaagtggcatctgtggacggctattaagtacaaaattctcgctgtcaatacctgcataaaaccataaaagtaaaacatccaatatagtggtaggatttatttctaaccatttccacgagtgttagtgtatatttgtatgcaggatgcaacccaccaaagttgagatgaaatgtacatgaaggatgagaatataacttccatatccaagccatagagttttgagcccacaaacccaataagatacatttatcttgagccaaacttcagtagaacatatagtgggacccacatgtcagaacaccagagaaggagctaggctggatgggccagccagggttcggctgaaccagcagctagcccaaccagcacaatattttaccaactgatagttatcctcatcctatgacggttaggagcgttaatactggtggaaaccgtcatcaagaggacacatggcaaaaggagaagttaagaagatgctcttaggattctatgttgaatatttcacagtatctccactctctcaactcacctccacactataaatacccctgtcctctccctcattcacacacacttgaagcatgagctgaattacaagaggctctagtgtactttattgtatattagaatagagagagagtaatgtagaagaagttgtcgatgcaaattaattctcttcttaccttttttatcttgttaattactctgcattaattgaatatcattataagtaattaaaatttactctgtgagaattatctcttggttagttcctaattagcgtgcgggatcatcgttcactatagtctattataatatagattactttagtgagttataaacactacagtagctattaattgcttagatgcggtgtctaagtagttgatttatggtgtttgctccgtatcccacagtaggtgtaaggtgggtgtagaggtgggtgtaagtcctccctgtccgggtacgtaatagagcgatatctgggagcagcaagctggccagtgcccgaagtatcgcgttaggattaagttaagctttccgtagacattgtttctcaccggtgaatcctctctatcctttgcctatcattagcttcgtgtccttggacaaacctggtaaagagctgacacacacgttccctgtggaaatcaatacctgagaatactcctggctgaagtgctacatcagtattttccgtgcgcttgcggattttatttgtaaagttaagaaataccaacagcatccaagataaatggtaaatgcaactgttagcactatcctgatcctaatttcttatatactttaatcgaaaataaaatttctgaacacccataacttgctgcactggacctaggcttcaagatcacctctacagggtatttatgttgctcattaagtaactaattatatatttttagtgtctaataacaccgaaccagctgtttggattacccagttgtataaaccatgattacccatacatgtgaacattttacaactatagaatatggaagttgtatgaggatgtaattatgtgtgtgaatgtatgatggatttgtgcatgtgtgtgatggatttgtcccttactgtcatgggtgatggatttagacatgccacaatgtgttggaaaatctgcagtatggcactaagacacattggcacatatatggcacactaagaccaaatatgtgcttgttgcacttgttactccatttccaatgtctaaggacatttcagtcatgttactgtatattttgtgctgctactgctgctgctgctaaaatatattttgtgttgctgctgctgctgatatatttggtactttcctatatcagtttatttccacaatccatcattgggttgaaatgtacttttctactttcctgctgctgttgatatatttatgcattgcccatgtgaatataacttgttgctcgatgatgaaattcatatggtgggagattatgtgtggaagtatttcatttatttgtgtgatttgtgaattgtgctgggttagggtataaaaccggcacctatctcctactacttaattactcggcctgccacctacccactggccacttcaccctctctctcttatccacacactctccctcactctcttttggtcactatttttgaattgccctttattctcgtctctgtttatactgccacacataatcgatgacgacctagtacaccatggcatggaggccattaagttggcaacctgccatctgagagcaaatatgttcctgttttgtgcttgtaacagttctgagagcacaaaatatcttacacctttagaccatgttatttttcaacattagtaatgttattatgcttgatgatgactagacggaacacaaagaatttgccagctccagatctgagggtgaacatcatgccagccctagcacgttcttaaacttaaatcaagagcattccgaaggcggagaggtgatttcgacgtatatttcacgcaatagtgcattagcaaattccgactctaatggaccattcgaactaatcaaatttgcaatttccaaggaggttgacacttccactggcagttcaggccagaattcaactgtctcatctagcctaggggtcctagcttgatgccggatggtcactacgttgtgacagtgctcatgaaactgggtggccacacgtaccatcgacggtgatgaccccctatggtagggcgtgtggatgtatcgtcaaggatttcattcccatcaagtacagacattggaatgaaatgatgtaacacaactcgactggatggtacctgaaggaagaatgctggcgaaagttgaagttgtcattcacctttccagaaggccaagaagagctagcaaagaagggagccctatcaaagatgggcacattatttagagagtggtggactgacttgaacgtggacttcgtccaatgcaaccgaaccccggattttgagaaacccatgtatcaaaagttggcagattattgggatgagtttgtgagctagaaaacatctgaggaggcaagagaagtgagcgccctaaacaaggacaacttcatgttgaacacgtatccacaccgacttggcccgagcggatatgctaagaatatccccaaatgggaagagaaggtggaacaactacatcaagcaggtatagttctcgagacagatgcatgggggacccggacaaagcactacatgtacgccaggaaggctcaactatcggatcaggagagttggttgctctgggacctcatcagcaagagctaaaagaaaagatcactgaggccatttccctggcaagacagggtaaatttgtgccagtaagagagaaagatgagatcacagtggcactggggacgaaagagcaccctggacgcatgagaggcgttggttccgttccatggaaggaagggttcccggatgatacacacatgtatcgggcccgttcaagaagacccacgagagaagaggaggccggacgtatgagattagaggtggcctatcaggtaaaggcacaacatgcagtgttgtttcccgatggggtactaggacgacaggggcaagttggtgaccaactggttagcccgggtgggaaacggagcagttgcgcatccgcggataatccccctccagaacagcacaccacgcattacgttgtttttttaggggaacacatgttacgttgtggacgacataacaacacatactccgtgcgtgctccatgtccctcttcagagcaacattactcaggagattgcacgcaatgtggcacatccaatatgtgcagggcaaacaatacacggtgttccattgcctgcagaccactcaagggttgaagtggaagacgtgccaagccagtatagatgttatgtgctacaatttcctctagaggaaggggttgacactctgagcgctgctcttcacaacctgatcgtatggcccaaacgctacatcgttatcacaaacgatggggcaggggatccaagcgccgatgattccagcctttcaaacggacgaggtcattcttcgcctcgacagaggtcccctagtctacctcctcgtcagaagaccccaaatcaaccacaaccttcgcagaagtctccgagtacaggcccaattaggaaaaagaccccaacaccaagtgcgtcgcaaatgtctggttcatcaagcatggagcgactcccacattccaagtcgaaattagtgccaaatccgacaacttcgctaccgaaaaaggtgagcggtagcatcacttcgcttcttggccccaagaagcctgaggaacgaaagattccaattcctaagaaagtgatcgagcatttcatcaaatgcgcacagccaaggctacctccaaaacctatatcggacttccgtagaacacttgagaaaagtgaaatgcagtctcgatctagggagttgttccttgacaagaaagcgtctgatgaggctgctttctgtaagtcagtcgatttgaaaagcctagacgatattgataaccttgacaaggctgaggtggtactcagttccaacatggatgacccatggtgctcgactcagaaattgaatggttaggaactcaagcgcattggctgcatcaatggtatttggaggaggccgcaaagggtcatgaaatgatcggtgcctactacaccgacattgattttcaccatgaccccaatatatgttatgtataatttaaggagctcttcaacttgtaccataaaaaggaactcgatatcagcctcctccaaatgtggtcattgtgagtcctttgatatcttctccttaatctggcaccttggacgtactctaagtagttttcaactattttctccttttgcaggcgctgctcttatcaatgtagaagtcttgaccgtaagattgcatttctagatccagcggttgtgaacttcaacaatcagttgtccaaagaaaaagaaattgacgactatctcttcaatgccctcgttaagcaaaatggttatgaccatattctcctgccttacctatctcagtaagtcactatcatcgatttctagttccatttgctctccacgcgtatcatattattgatacattgtcctatgtgcagccatcattggatcctcttcgtaatcaatatcgacgacagtaagatttgtgtatatgatagcttgaggaaagggacagacaattaccaaactattatgaatgcactaaatagggcatatgtgaagtaccgtaggtccaaaagaacgtatgggagatgtgcgatcgatgcaacatcattccggatctttgaaaatcaatatatttatagacaaccagcgcttaccaacctctgcgggatgtacgtcatgtggtacatgctatgttttgtagagtctgggcaccttcttccccgtaatgctgaggtatgacatgtttcagggacttacgtaataaattagactattctattgaagtacgaaagtaaatttctatgccttccacccttgtgttgcagaagttgggtcttgaaacaagcgaaatgctgccacacgtcttcacagctctcaccgactagttttgcgggcctgtccatactcatgtcatagatccaaatggcacttacaatgtcaacaagctcccacaacaaagtgcaatcctctgctcctacccctcaggaccaaaaagtgaagaaatcaactactaagaagagaaaaaccaggtaggtagatttgtgtgaaaaattgtagttacttagtgcttatgcatgaattatggatgtgacacgtcctagtacaatgaatctggacagaccgtgtgtccagattcattatactaggatttgttacatccacccaaaatcccttatgttatgggacagagggagtatgtacaaatgttttggatttggacttacaatatatatgtaaatgtttagagcatctgagatgttgtagagctctagcgatttagtcaagtttcctgggatgtgtaacacatctggtcgccaccttcgtgtggtttgatgagcacatctcaggctgaagttgactggcacgctgagtcccaacaatatctcatttgctctttactcgaggatatgaatgtgaattatatgcaaatgtctagaatttacacttataattttctggacttacgaattttagacttgtgaatttctgacctaaggatatatgtgcaaatgttcataatttagacttaggaatttttggacttaaaaattttaaactaggaatattttgagttaggatatatatgcaaatgtttaagatttaaagataggaacttttggacctacggatttttagacttggcaaattttaacttaggcttgtaggtttttatttgttgtgatgaatgtgaaagtgaatgaatgtgctgtatggatctggggctgtagggatggatttgggtttgtatggaattggggttgtatggatgaatttactgcaatatttttattacccaacaaataggtgccggattttaggtttgaaccggcacctattaggaccatataggtgccggttttaacctaaaaaccgacacctattaagaccatataggtgccggttaagacctattagcggcactattacctaatatgtgctggttctaaaaccaacactgatggcaagtattatcagtgctcctttgtgccggttgggaaaaccggcacctattatggttttcaaaccggcaccttttacccttcctgtagtagtgtcctaattatacagtcaattgaacaatgcagctagatggtgtctaagaaaagcagcgtgatgtatgttcacaagctttacagtcgaccaaaagcaatagatcaacctgggagtcacgagttcctgataaattgaaggaagccgacattaaatatacatcatgcgggacagatagaacataaaaggtgtagatagtttgtttcaaatttattagaatgcgagagaagcgatcttgtgcacctgatgtgcaatcaacaacaatgtcctatgctgatgtgacaaaagaataataatgtggtatcactttgcctaaagtgcaccatatagctaagctaatacacttatatatatatgctcaaattttaagttcctgtactagaacgcaaccactcgacactaagtgcaatttattccaaacgaaaacacatccatagagtaataaaactgtaacggcgaaagcaaaagtacgttgttggcggtcaccggtgcttccatcggaaccgggaagacaacgagtgaaccgcgctggcgccattccgtggcttcttgtcgccgccatgtcccacagccgcatagccatggccggcgtcccttggcattgttctccaccttcgacgacggcgacggtgagggccagtagtgatctttatatatgtcttcttcttcctccagtccgagccaagcttcaaaattcttcagaggggaggtcttgccaaattttattgtgaatttattttggtgatcatatacaaattggaggtgtctaaaaggttagcaacttcatcctccaatattttttttgttgtcatattacatttgaagctatgtttggtacacattattgtctctaaaactttgttggaagttgatgagagagaaaatttgtgtagggaagaagaatgtatagaaattttgtttatttacaatttataaaaagtttttataaaatagttgagaatgaaaatatattgaaaattaatctaaaataatagaaaacaaactaaattgaaaattaaaagaagtacaacacattaaatattagtttaaaaacttcaaaaataattacaaaaagaataatttgtgggattattttataattattgtatgtataatgatatgtcattattgtatgactgtttagtgggtttcactttcgttgaatatttttacggtttttttgcatttcatgtagatggatcggcaatggatgtacgcggactagcagtcgaaagagtttattgatgacgtgcattattttttgagagtggccgatgctaacaagcataagggttatatttgtcgtccatgcaataagtgcaagaaccagaaggagtattatgcacttaggattattcatttccacttgtttgagtcggggttcatgcctagctataattgttggacatcgcacggagagctaggggtttaaatggaagaagatgacgtgtaagacgagaacattcccgactgagtttagtacgctggatttgaaggaaatagaacgggcgatgtggatggggatgttgacgataacgacgctgtggatgatcttggttaaatgttgcaggacgccaaggaggactacgaaagtgaaaaggaggcccataaattggagcgtatgttagaggaccactgaacatcgttggaccaggttgtggataggggcacaaaagttggataccactctggaattctagcaatggaagacaaaaaatggtgttagtgacaagtcatttggtgatttattaaaactcgttaagaacattcttccggaggaaaacaaattgtccgagacaacgtacgaggctaaaaaaatagtctgccctctaggcgccgagcactttcaaaggtgaggttgacggtgagggtcggagaagctacgtggcgaggcattccggtgaacatcgtgtccatgatcagcaacactggaacgccatcgattctcgactcgtgggtgaatccatggctacccgcttttttggataatgatctatctaaggatttgtttgtcccatttcgtctgccgttcaacgactcgccggaggagacggtagtccctcgtcggagatggagagccttgggtttgtttcaaactcttttacatgataaagtttgaaatgttttatcaaatctaattttgaacgtgaaatatgctcgtgtcgtgttcgtgtaaggcagttataataacgtcataatagaaggatgtacatgcaaaatcatcatatgaaactgaaaatggaccctggcccacatgtcggtaacacaagcaggggcaaatcctaaagatacatcctatgtggggataaatttgtttttgtctccttttagaggttgccaatttagcgggactgcataaaaaggccatttattattgatagatctaactaattaaactaatgctggatgtatgtttcttcctggtttccagtataaagaagatgtctgccggcctctaaccagtgattctgattacactctggtacagttttgcaaattttgattgacataaaaatgtaaacagtttaggtttctgattctaattataggcgattctaattctagcagaaatggaaatgaaatccatttcaattaaaaactttttatttgaacagggcaccattgctttgtttgagaaatttgataattcgaccctttatattcgttgccaatttgctttaattgacgctggtggaaatgatatgtgggaccatatgagtgaatgagtaaatcaaccacgtttggcacacacacaatgacacaaactcgttcattactgattgatatagtttggcaaaattttacaaattctccatgctttttcaagtgacgcggcatgaagcaggcaggagatctgctgctgtttttcatagatgaagagaagcacacagaaacactacaatatacaaactgaactgcgcctcatcgatatgtcttgcagtatgagaggctaaaattgttgatgatccagagaaaattttgcaagaaaacaatagaattaatatgcgagcttcttcttattgcgctttcccgttttgccttgtttggattctctgcatgaaaatctattagtccactcttgggctggcgatggtgacgtagctagcgtcacatccttcttgaatgcatcgttgaggaaatccgaggtaatttctagttttgctccgctttgacacctaaggagggccatcgggaattcggagctgctgcgtttgaggcattcgacacgcttggcaacaatgacctgtatccttgcttggtttcgggaggggtttgctgttgtcctcttgggaagtcgaagctgctacgtgtttgcgagctcggcaatgatgactcatgtaagacttcgtcttttgcgttacgctctagtgtggggttttaagcttttcgatctgcacggtttgtcagtctggctcgcccttgtctcaatgagtctagtggtcgtgaagtcggagctgcggtgttgacggggcgcgacgtgtagcaacgatgacatgagcctagttgagttgtgctttggcgtggtttagactgttgccctaaccctggtgtttcctggtgaagtcggagtcgcccaatcggtgttggtgtgatgacgataacaccatggctgtgtcaatgtgtgggggccgtatgtttgtctagcttgtgccttgttagcggctttggttgggtgttgagttctgctgtcctgttctcgttgtcgtggtagcttagattagttggtggtgttgtgtgacagttgcggtttcgtctagttttccttaattaaccgtgcattgtaaggtttggtcctgttttctctttaaaatggggcaccttcttctttatataaaacgtcggcaaaggcctgaccgttcgaaaaaaaaaatgcgagcttctcgcttccagcatgagtacatcatctttgatctcggccagtagaaataactcgtagtgccttggattttgctcatcttgatctgttgaccaaacagtaaccatgcttgatttctgctcttcatttttctgaaactgatactattaccagcagcaggcaggaggtagcagattaccaccagaccaactgcatgaattaccatcaaaagaaagactgactatgcctgtgcttcgcaagaagtaggtgtaaatattcagacaagataaatacacaatactatcacatggatacaggagtacttgttcagacaagattgcaagttcgaatattttctgctgaaatctgagatcctcaagctgcttcaattagtcataacatgaaaaatcccaaacaaactagaaaaaaatatatcagagattcctttcaagaggacatattgattatacttggagccacctattgataaagcaatgcataatcagaaaaccaatttttcagattacacaacaggttggatcagtcaagatgaaaacaatcagttccacaaacatgtaccgtctcctgatttctccaaatttaggtcatcaccgaagtgcgctggctcaccgacagccaggaatagcatatttccaagattttggatcccataatgtcgggcgtttatgctctgtacccaaggaaaaatgaataacacctgtacatcatatccatgaatgatgtcaactttcaccaaactatatacgagattatcataaaactacagatagtcaccattttgttacatgagcatgtatgtaataacaattcagaggcattgcaaaggtatacacatacttatcaatgatcagtcaaaaagccagaaagttcatcgattttagtggaatgacacttcgtgtcatcaaataagcctcattgcaaaagggaaaaggttggagtagagttagtgtactagttttcaatgggcttcctactaattgaaagcaaaccagtccttaacaaagaaacagtggagggaaataatgctcatgcatctgaaaacagaagaagaaaacatttaaccatggctcctgtgtttgttgaaacataaggaaattctgttgacaaccttgtaattgtattattgactataaaacagagggggaggtgattgaaatttttaagtgcatactctgcaacatatggatatgcaatactagtatgtagggaaaaaaaaacaaaaaggaaggaataagcaatggaaaggtacctccataaggacattttgcatgggcatgtgacaaatctctttccttaagaatatccaaccgtggcctaaggcgttcatatagcggcttcatattcatggctgggcaatatcgaatagcaatagttgaaagagatgagtagctctctggaccacatgctaaggatgctagacgtttgcagctcacaagacaaagtctttctaatgatggcaggtctcccaaacaattcagtgactccagtttattgcagcacctaatatccaaaaacttcagggcatgcagctgccctgatagagactgaagcttcggacaagaatgaaattctagtgacgtgagggacggtggtaggttctgaagttctaccattttatcattgaaagagatatgtatcatttctaggcatggcagaggatgattcactgctgatgatgattgctctggtacacttctgtactcaaggtcattgcagtgctccgatgatgtaaatgtgtcatggtgttctacatgtacattctccgactctatatcccccttaccccatatgaactcaaaattgcgacatccagaaacatgaatgtgggtgacagatgggggtagaacgaatagctctctcaagttatcacaacagcaaattgataatgacgttagacatggcaggaactgatctgttgcacaacgagttggctcacctttcaccagcgtggtacggcctattagattaacacaaccaaaaatggccaacatcttcaaggacaccaagcataggaactcttcctccggccagtagatgagcacatcactggacttgatttccaaatacacaagttgtcgaaaccatttccaaatcccaattattggttctgatgggattgtggagaagaaaaagttgcagtgccttaactccatatttgagagagatgattcgtgaatttgatcaagctgcaatatagcttctttgtcaagcacgtccaattttaacttggacaattgggacatgtatctggatttaagcaatggcaatgacagctctgccttgttttcatttagctttaaaaccttcagctttggtgcttcgggtagactagacaactttggacagttactgatttcaacctcctcaagcagaggaaatgttggtttgttttcttgttttccttcagtttccacccaactctcaaacctttccaaatcaattaacttgacttcctttaatgctggaaatatttgtacttttccatctcttgcttcctcgcagcataagctttgcaatttatctagttttatcaaatagagaacttgaagaaacttgaaatgtatgaattgaggaaattcttcacacattgtacagccctctagatggagctccgtcaagttctcaagaacactaagatctgtcatccatgttggaaaattagtgcctttataggaaactaccttaagcatatggagaccatgatgaggtttaagagcatcaagaaccttctcagggtaatctggttcttcagcatggtattcgccactccattcaagagataagtgtgtaagtttctctttccttccaagattggctgcttttgcttgttcttgagatacattttctaggccacgtaactctagttcgccagaaaggtttaagctatgcacttccctaagggtactgcaactagcgctagcacccacaataaaatatgttaatgtctgtaaggaagttaactgtccaaggtctggaggcatgcacttcaattttgagcatccatttgtataaaggtgtcgtaggcttgtcatatacttcatatcttttgggagtctaacaagattatagcaatcagaaaggtttaatgtctgtagattgtacattgtgcttatgtctgcaggaagttcatggatattactgttgtctgagagatttagatatcttagatgttgtaggtgtcttggcctgattggtaattcttcccttcttgggagctctaatgctcttagctgtagagaattgtacttaaataaatgtgatgttgagacattaccataataccctcgaaacaataaagttcggagagctggagcttcatttcccataaagtcatctggaagagcaatgctggtgtatggtatgagaacgtgatataaaggatgttctcgcatcagatttttcaaattagacgaaccaattatactgagacattctttccccataacagattgagaaatgtcatgcataagatcatgtatcttgcacgttgttctgtcacggagctgactcctatacacattctcctcccgctgagaaattttattcacatcttgaaaaaatgacctccaaactagttccttgaaaatattctgggctactgtttccagatggtcttcctcctgcagtggtatgaagtcatgtgccaaccataattggatcaatgtctccacatcaatctcataatcttttgggaatatagcacagaaagcaaagcactgcttcatgtgtgatggcagatcatcatagctcagccgaagtataggaaaaattttatcctccccttcattgcaaatgttgcttttagttaatacatcattccattcttgcatagtagtcctggtacttaacatagaaccaaaggcttttgcacctaaaggcgagccatgacatctgtgcacaatcttacaaagaattccaaaatgttcatcattgtttggcagagttaatgctctcctcaggattatttccttcatgtaaatttctcctagattttcaagattatgcacttcaacttcacccgtgaccataattctagcaacttctgcatctcgagttgttgttagtactgcactacccataccacccttcttaaggcaggtctttagctttccccacttatcataatcccgttcccatacgtcatccaacacaatgagatacttctttccacctacttctttctgcaggtcctgcaaagccttttcacgatctctctctgtgctcatacatatgttgtttgcaatagtgacaacatcaaacacatccgacacacaacaccacctgcggagcgggaaatgcttctcaatttcagggtcattgtaaatgagttgcgcaaaggtagtcttgcccagcccacccattccaacaataggaaggacagtgaggtccgtgttattagctttatcaagcaatatcctgataatcttcttcttctcctcatctctagatctgataacaatatccttgtcaaaatcaaccatgatggaatcagttttcctccactgcttgggtgtttcctgctggtgtacgagtccgaaggagttcatctccgagacaagttccttgattttctccacgatctttcgcagtttcttgcccatcctatatcggaagacaataggattacgagaagggaagaggcttacagagtccatgccaagcatagtgtggttgcggtgccctttcttcttggcctcacgccagagcgactcgtacttgaactcgtcgaagacgtcaattgcctcgtaggacaccttcttgagtgatttgagccaagcgcaaactagaccggatcgatgatttttcttctcctccgcatcttggatgacatcgaggatggctggaagcaagcgctccagagtctcacgctggtcctccatgccatccatcaccttgtacatgtctacaagaaagctggaagccttctccagcaccttggagagcagtggcccaaccaaatattcagccatcgttgctctctcaactctcaggagcaggagcacacggcaagaacccaaggcaagggcaacggcggctgttgctgatatgtagttctattggagagtgattaatggggtattaattccaggctgaacaaaggcaaagacaattgcaaagaattgcagtgcgctgcgcactgcatttcagtgttgactgacgcgtcttgctttccactaatttccaagagtcagttttgcttttatctctcattttcacgcacgccgatgttgactgacgcgcgccttagcagagtggtgagtggtgactgaccttgtggagacgcgaggggacctggtactctggcagccggccggtgagggcagcaagatttcgctcactcttgcttgcttttgccgaagaggtgttgacaaccgttgcttgcttttgccggccgagacggcgtacgtgttgtcctcgcagccattccgtcgaacaccagccgggcactgactgccatagcaagcccctacctctcctgccaccctgcactggacgctgtaggagcggagcggccggcgtccttgcaagcgaacggcggtgggcaggacagaagaagaaggcggccggaactcttcaaaggctcgccggcggcgtggcgcatggcaggcagacggagagcaaatgagcaattgcgcgccattcggttccctcctgtatattcgtcagaaatgacgatcgatttttgttcgcgattggattcgaaggcccaattggattttgagcgcttcatgggccgtcgcaaaacatgcaagcctggcccaacttggtacagtaatagttaatcatagtttacaacttcaatcgctctgcttttgcttaatttcgtcagaccttgtagataaaataaattattcaatgagatgagcatgtaattttcctatcttgaaaaaaagcatttgcagttcaactaatgaaatccctgaaatgtactgtatcaattcattcggcgatcattttattctcttctctcttttttttcttctatatttgaggtatcatcaagcaagcagatctgctgttttgatacagattaaatcctacagctgatgagctgacagcaatccaaaaaatatttttgtgggtaaaagtttttatatatgtgtccttagagatttaaataagctattatgaaaagaaacctccaaaaattcaattttggcagctgcctaggaacagatcaatgtgcgcaccgaaacacttgcaaaaagcgaccagcggcatgtccatgagcaaacatgttgataatcgagcgaaattcgacagagggacaaacaaatttctgttggacaaaaactcactacgcttcttctgacgacggcaaaattaactaagtgaccgctttgcaaatccctaaggaaaggaactgatccagagaataatcgccctggaacaagccttgtgaattggcaaaacagtatgcaggccaaaagttttaggaggattggaaattttcaagagctttaagattaagatggccttggataaaatggaaagatgaccaaagaccgtggacctcgatggatctacattgcaacaaaacagatatacaccttttccaagcttgcacgaaaatcacaattggcaatggcgagaagacaacattttggaaagacaattggctaaatggcctttgtctaaaacaacaattgccaaaccttttcacgttggcatggcgaaaaatcagaaatgtacaaactgagccatacagtttcaggagttagccaaatacgaactgattcagggccgccggaatttctgcattttcatttccagcgactacattcttctgacactgagtcactgactgtactgacagcaggtcggagctactgcccgttgtggcttatacacggaactggacataacaatttacaacataagtgcaaagcagaagattaccacgaactgcatccactgtcagagaaacatcgaaacgatgagcaatacagcgtgccagtgcttgtgcattacaataagtatgggggtgtctattatgtttagataagataaacacacaatactaaaacatagatacaggagtactaattcagtcaagatttcaagttggaatttgttctgcttcactagaacagaacatacaaaaccaagacaaaatagaacaacgttgtagtggagattccccatcaagaagatattgttgattacactcagagccacccattgattgttggtatgaatggtaccaatcctgcagggaagccaagcataatcatcagaaaaaaaaaggaatcttaaatcacaataaacaacctctcatcttgcacaacttgttggattccagtagaaaacgatcagtttcacttttttttttgttgaaaagagggcaaaagctttgccttgtatatattgatagagcagggtgatcagtttcacatacctctgtggtctcctgacatcactaaattcaggaaatcaatgatgtgcttcggctcatatcagccaggaatggcatatttccatgattacgggtctattactgtagggctttgaatccctggtggaaaacaatgtcagaatttcttgatggaaattaaccatgccataggaaaaacagcaaaactgtaaaaaaaaacgattcagaattggctacaactaccagactgaaattttgtacacactaaaattctgcaagacattcaagacataatttgatacttagggatgtgtttgtacggaattaatctattcttccaactattcaggttgttaatcaagtttcttgttttgttcattcactagtggaacagcggtagtaaatgaatttaagcttggcagtgccacttctggaaaaatattttacgttgcaaatttattcagataatggaattctgaaacatcctaaggccatgcaagtaaagcaaggaaatgaatgaagagccttataatctaaacacaaaatgagttaggatatcagaagaaggatctcaccgtcggaaaccagcacactcatcgcagtcatctcgtcaatgcagtttccagttgaagccaatgtttgtgctttttacctgcttccaacacgagtaaaccatgatctcaagattctcaagcaagtatcatacgctgcaaatgttctgatatcagagggtagaaaaacttttagggtcatattgatctattcaccaaatgggtaattttaccatccttgaaaaagtatcgggatgtaccacactttctagtataaaatttggaaacaccatgcttgatttcttcacttcatttctgccagagtaccagactgccattcatgcagacaacaattgttgaaaatatatgcaaaaacagtgcgaaagggcatgtagcctagtggttgcagtgacctgagtagcaccccaaggtcctgagttcaaatctccataggagcacatatatccagttggatgtagagtccgggtaaatatacccttctctaaaaaaaaaatgcaaaaacagcacactaccaccaaaccgcatttcattgacacggatgcctgagtagcatcgagatagtgagcacttcagcaaaacccagtaagtaactatgccatacaataataactctgtagtgaagattcctgttaagaagccaaattattgattatactcgccagtccttcagagaaaccacgccacaaacatcagaagaaagaagctcgaactaaagccaactttcatcttgcacaactgttggattcaagtctgagatgaaaacaatcagttccacgaacctgtcaggaacccattgagctacacatgggctgactcaattgctaatccatgccaaggcccaaacaaacaaaggagatgaatacaaaagggagcagcaggagaacttcaagcaacgaacagattcatcggcggcttcggccacggcggcggcggcggcggcttggttcggttgaacctcgtcgatctctatctttttcttactctctcgtgttcctcttcactgccacttctagaagcttcctctacttcttctcactcaattcctcttctattttctgagattgtatttgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccggcaagatcgcgcatgtaacagactcttttgtggaggtgaataaaaggaagaaaaaccccagaaaagctgcgaagtttttcagcaccaaaactctgtttttgctctgtttttctatgttgtcgtattttcgtcagatactgttcatcgttctgaactactcagacaagctaggatagccacaatctcgcgtgtgttcagagtgttctagctaacaattggtatcagagcagtactggaacgatccggcgatgtcatacacaccgcctggccgtcgtggtggcggtggcggcggggggagcggcaacggccgcggcggcgcaagcggcagcggcggggggaatggagcagacggcgcattacttccgctcgtgtctcaggggagagacgcatcgcacaccgctcgcctcccagtcctctcgaggacaaactacccggattgggcgctcctgatgcgcgtcaacctgcaggcgcaggggctgtggacggcgatcgatcccggctacgcggagtttcgtgaagatcgggcggctctctcggcaatccttcaggcggtgccgcgtgagatgttgcgcgggctggcaaagcatgacacggcgaaggcggcgtgggacgccatcaagaccatgcgggtcggcgttgaccgtgtgcgtgaggcgaaggagaagggcttccgtcgtcaatttgagtcgatgcgattcaaggagagggagacgccggaggagtttgcgatgcggctcactgccgtcgtcgcggacattcgcgacatgggtggagtcatggaagatgaacacgtcaacaagaagctgctgcgcgttgttcccaagaagtataagccggtggctatctctctcgagcagctgctcgatgtgaagaccatggcgctggaggagctagttgggcggctgtcaacagtggattcttacagcgatgatgaggagggaagcgatggcggaaaattgtacctcacggaggaacaatggcaggcacgtgtgaagcagcgggagcaggagggctccggcaacagcggcaataagggccgcggcgcgcccggcacgcagaatcaccgaggcaagcccggtgggtcgccaaagggcaaagaggcggccactggtgcgaacagcagccgcgacatctcgagggtaaagtgcttcaattgtgatgaatttggtcactatgcaaggcagtgccgcaagccacgacgccaacgccggggagaggcgaacctggtgcaagccgccgaggaagaaccgacgttgcttatggcacatgtcgtaggggtgtcacttgctggcgaggcgacactcggacgaacacctggtggacaggaggtacacctcacggagaagaaggtgatcctggaccacgaggatggtggtgaggaggaggtgacaagagattggtttctggataccggcgccaccaaccacatgactggagtgcgttcggcgttcgccgagctcgacaccggcgttgttgggacggtgaagtttggcgacggctctgtgattgaaatccaggggcgcgggaccgtggtgttccgatgcaagaatagtgatcatcggtctctcgacacggtgtactacatcccgaagctgcgcaagaacatcatcagtgtcggccgtctcgacgcgcgcggctacgacgcacatatctggggcggggtctgcacactccgtgatcccgatggtcttctcctcgcaaaggtaaaacgagacataaattatctctatatactcaagctgcatattgcaaatccagtctgcatggcggcgagcggtggcgacatggcatggcggtggcatgcgcgtttcggacacttgaacttccagtcgctccggaggctggcccaggggaacatggtccgcgggcttccgatcattgatcacactgatcaactgtgcgacggttgtctcgcgggcaagcaacgacgactcccgttcccggaggaggccaagtttagagcacaggaggcgctcgaactggtgcacggcgacttgtgtgggccgatcacgcctgcgaccccaggcggcaggaagtatttcctgctcctcgtcgacgatatgagccggcatatgtggatacggctcctctccggcaagcatgaagcggcgacggcgatcaagcagttccaagtcggcgttgagctggagtccgggcgaaagctgcgggctctgaggacagatcgtgggggggaatttacctccgtggagttcatggactactgcgccgatcatgggatgaggcgagagctcactgctccttactcccctcagcagaacggagtcgtggagcggcggaatcagaccgtggttgcggcggcgcgctccatgcttaaggcggctgggatgccggcgtgcttctggggggaggcggttgtggcggcggtgtatgtgctgaaccggtcgccgacgaaggcattgaatggcgtgaccccccatgaggcgtggcatgggcgacgtccctcggtcgaacacttgagggtgtttggctgtgtaggctacgtcaagacggtgaagccgaacctgcgcaagctcgacgatcgaggtacgaggatggtgtttattggctatgaacaggggtcgaaggcgtatcgcatgtatgaccctgtggcgcggcgcgtttgcgtgtcgcgtgatgtcgtcttcgacgaggcggcgacatgggcgtggcgtgatcctgagacagaggcgactgaagaggaggaattcacggtggatttctttgtgaatcccgtggactctgttgttgccgacttgggcgaacaggctagcacgcctgtgcagggaggcacgtacccggcgtcgacggccactccgccctcaccaccggaagtgccggcgggggtggagttttgctcaccaccaaactctgtcacgccagggacaaatgaaggccctatcaggtatcgccgagtgcaggatatcctatctgctactgaacctgtccttgattttgattatagcgaccaatgcttgctggcaagtgaggaaccaatgagtcttgcagaagctgaacaacagttgtgttggaggcaggcaatgcaagaggagctaaagtccattgaagacaatcagacttggagctttgctgagctccctgttggacataaagcaattgggttaaagtgggtctataaggtgaaaaaggatccatcaggagttgtggtgaaacacaaagcaaggttggtagcaaagggatatgtgcaacaacaaggaattgattttgaggaagtgtttgccccagtggctagaatggaaactgtgaggctcctgattgcagtagctgcaaacaaaggatgggagattcatcacatggatgtgaagtctgctttcctgaatggtgatttggaagaggaagtttatgttgtgcagccacctggttttattgagaaaggaaaagaaggccaggtgttgaggctcaagaaagctttgtatgggctaaagcaggctccccgagcatggaatgcaaaactgcacaacactttgatttctctgaatttcatcaagtctgaaactgagagtgcagtgtatgtgagaggaacaggaagctcaaggttgatagtgggagtgtatgtggatgatctgattatcagtggggctcaagcaagtgaaattgattttttcaaggaggagatgaagaagaaatttcgcatgagtgacttaggtctgctgagttactatctgggaatggaggttgtccaaaaggatgatggagtgtttctgtcacaaactgcttatgcagcaaaaatcctagaaaagacaggaatggaaggctgcaattctactcaagttcccatggaagctaggttgaaactgaagagggagagtggaggggaaggagttgattcaaccatgtatagaagcactgtgggaagtctcaggtatttggtgaacacaaggccagatcttgcttactctgtcgggtatgtgagcagatttatggagaaaccaacttctgaacattgggcagcagtgaagcatattctgagatacattgcaggtactcttgatgttggctgctggtttgggagaagggaaaagggtgaactcagattgattgggttcagtgacagtgatatggctggggatttggatgataggaagagcaccacaggtgtactgtatatgctgggagacagtttgatcagctggcaatctcagaaacaaaaggtggtagctttgtcgtcatgtgaagctgagtatattgctgctactactggtgcttgtcaagggatttggctcaataggctattggcagaattacttggagaggaccctggccaaactgtgatgaaagttgataacaaatcagcaatcaatctctgcaagaatccggtactccatgatcgaagtaagcacattgacactcgatttcattttatcagggagtgtgtggagaagaagcaaatcgctgtggagtatgtgcgaacagaagatcagcttgcagatatactgactaagcctgttggacgagttcggtttcttgaactccggaagaagatgggtttggagcaggcacatcaagattaggggggaaattgatagctttatccaaataatcttgtgtgcgaaagctagttttttcagttgcatttttttaacttagccattgcattttgtaatagcattggattcctggttgcatgcgctggctgaagattagcaaactcggttagtgttagttatcgtttttccgttttttcggtagtagaagagatcgagcagggatcggatcgtgggatggcacggtcagtcgttgatccggcaagatcgcgcatgtaacagactcttttgtggaggtgaataaaaggaagaaaaaccccagaaaagctgcgaagtttttcagcaccaaaactctgtttttgctctgtttttctatgttgtcgtattttcgtcagatactgttcatcgttctgaactactcagacaagctaggatagccacaatctcgcgtgtgttcagagtgttctagctaacagtattgaactctattgttcttgagaattctgagtttggaggaagagggttgttaacaatctggtatcagagctgttcggttcgctggggattcttgtcatggaggtgttggggaggcagccatgcaagagggaggaggaattcggttggggaattgttcatccgagtagcgcccaccaactgttcgatgaaatgtcgagcccattcgaagtgtacgaggaagatactatccttgtcatgaaggaggagaaagtatccagggatgaagcactaaggttgttacttgaggaatggatggatgccaagcgtaaattagaggagaagctcaaccgggtcttggagaagtttgaagagatggaagctcacaatggcgcagaagatgcaactgtcatcatcaaggcagccacaaccgacctcagggaggcatcatctccaacacccaagacatcgctatctccagtgtgcttcaatgaaaacagcatgcatgcggcaacgagctcaagccacaacatcgagctgactgccttgacggttgccaagtgcttgaaggggtgctctaatcatggagttggagctggtagcttgatgcccacaaggtgcccgacgaattgctcaagtcccggcgtcatacccgaccacaccatggctacggtggttgcatgtgccaccacttctatggcgttcatggagttggttgttggagaggaggcaacctgtgacacctataccgggaccactaattgtcctgaggtgacacacaccaagtgttcgacattgggccttgacgtcaagggtgacaccgaccaagtcatggtcgcattcctggcccagccttgtgtgttccttctcaacatggacaacacaggtaccaaactagtaaacatggtagaggtgactagtctacagacttgggcacctccctgtcgagtcatatgcaagggttccctggttaagaagcatccagcaacttggttagagtttgagtggaaacaacatgatgtgcaacagatacaaccatggccaccgccacagtggctagaaacttggttattccttagttgtttttcagatgtagcgccacatgattcagtgagcccattcatcattgacataataccttatgcactagatgatagggaagaaatgctcaggagatcaattgagctgaggccctgtacacatccacagtatttggggaaggggaaatattgggcaggaacagctatgtcctatggaggcaatcacctgttagcagtcaaaaggttattggcaaggttcaaggaagatttctctatggttcctagttggatgagctggaattatgtgagaagaatattgtggtctccgggctgttctctgctttctgctagagaactttggaagtgtttacagttattttgtggtaaaggagaattgttggatggtgagagttttatgcagcgaaggagatcgaacatgacatcctatgaggtttgctgggaaaggaaatttatatcaaaaacatatagtgattcttctcagaattggttcgagttgtatacttcgctctcatcggaattatggcataagcccactggctataaactgatgcaatcagaagctacttctggtgcaacatatttaattagtgcggattggactataacagagagctgcaaattatcatacaaaataacacttgaagatggtgaagtagatgtgtactggttgaatactaaggaccaagaattctcgtatgaacaattgatattccacaaagaggagcttgctacagtttgggtttatcaaagtactagttttatcaaaagtaagggcagtggcagggttgtcaccattgcagcaagtacctcatttaccaactctataccagtgccactagctagtcatgtttggaaggaattttcttggacactacattattggaatgatgggtctgtgtggaaattatggttctgttatatggtctttctgatcagtgtcaaacaagctgcggtgcctatggatatcttggatggaaacttggaagaatctgatccagcaagattaaagatgtggcctgatcatccaaaatatgttcagaggccgtgtgtaaatcaaagggatgaattgcgtcttagtgcacctgatctacaaatatcatgggatcctggtggtttatgtttactcaagtttctagctatctcttctcttggacaagtcacatttcagtcagtcaaattctcatttcaagacagttcttctctctttcacatgcgaagtgccaggatttgcttgagctgttcttttgagacgcaagttttctgttggcaagctgaaaacaaattggacattgatgaagcttttggaacgatgcaagaatactggagaaatcaaagtggaggtttgccatttctgcaatttacttgtcatcgacttgtggacaagtcgaatttcaaggagaggagattgtcaggaacccattgagctacacatgggctgactcaattgctaatccatgccaaggcccaaacaaacaaaggagatgaatacaaaaggcagtagcaggagaacttcaagcaacgaacagattcatcgacggcttcggccacggcggcggcggcggcggcttggttcggttgaacctcgtcgatctctatctttttcttactctctcgtgttcctcttcactgccacttctagaagcttcctctacttcttctcactcaattcctcttctattttctgagattgtattgaactctattgttcttgagaattctgagtttggaggaagagggttgttaacagaacctttatggtcggctggcattgctggctcactgacagccaggaattgcatatttccatgatttggggtcccttagcgtaggatgtttaggctctgcaataggaaaataataccttagtttcacaatcgaaattaactgtacccaggggaaaaaaaaggaaattctgtcctattcaattttaaacagaggggctggtgattgaattttcgagtgcgtacactgcaacatatagatctgtaatatgtagggaaaagcaaaaacgaaaaagaagaaaaaagcaatggagaggtaccttcatcaggatctcttgcacgagcatctcacaggtctcttctcacaaggctatccaaccgtggccgaatgtgtttatatagcggcttcgtattcaaagctgggcaatatcggattgtgatactcgaaagagatgagtaactccccagaccacatggtaaggatgctagacgtttgcagctcacaagattgagggtttctactgatggcagatctcccaaacgattcagtgactccagtttattgcagctgtcaatggatatatactcgagtgcatgtatacagctgccgttagacggaatgaagctcgggacatgaataaatgtttagcctcttgagagatgatggtaggttctcaagtgctaccattttaggacatacccagacatctagtctttctaggcatggcagaggatggtctgctgctgatggcgattgctctggcaggcttgtgcacgcacgataattgcaatgctttgatgatgtaaatgtgttgtgatgatctacctgtacactctcggacactatatcccccttcccccatatgaactcaagtttagagcaaggtgtgcttctatgctccttagaaaaaagttgcacgaaaaccaaagctcatcaatggctgagattaaaagcgaattaacagtgtaatcatcattagtgagggggtatttttgtccatataatttggagcccagtctaactccaccgtaaccacgcgcaccgcccgcttttcactcgcgtcgccgccactgctccgccctcttcctcccccgcaccgccgcctagacccagcacccatggatacgtgcggcgcgggggaaccagagtaggcggtcggccggcgccgttgtggggaacgggtgatgccgatgccgatggagcactgccgcctcgctccatctaatccggttagccccgcccctgatgacctcccggccgtcgccactatttgcgcaacaagattcgccttgagcgcgaggagccgaggactacggtaacgtggacgtcgagcacgccgccgtgccagcagctgtcaagcggccctagcaacagctgaagcagcagctttttcggcgccatgatttacccctcatccaaggccaagttgccattccagcttgtgccttttggcttgtttgatctctgtctgcactgcaatcgccagtttgctgcaagtttgatgtgatcatgtgaattgtgatcgtggatatattggtggtgactggtgagctgtataaatgaatgggggaggcagaatggcacgcagatgcttgtttatgagtatgttcccaatagaagcgcctatacacatttacatggcgattcctcatgtgttctcataacattcttttcatggaagaagaggacggagaggcggcactgcttgcaggaggaagccgggtggcgctagactgagcggcgccggggccgggaagcggtgaggcgaggggaaaaaaaggcggagcgccggggccgggaagtgacgaggcgaggggaagaagagggcggcgctgcttaccggacggcgtggcgatggaagcgctggcatgcttccgcggctgaggagcggcgctgcccgaggagagagcgtcacggtcgcggagtaaccggcctagtggtggggatcgcttcaaagttaatcctatggacaaaaatacccctcgctaataaggattaagtgttaatcatgttttaatctcagccaccggtgaactttgattttcgtgcgcttttttatttaggagcatagaagcacatctctgattataaacatatgtgagagatggggggagaacgaagagctctctcaagctatcacaattggaaatttcaagtgaggttagacgtggcaggagctgatcccttgcacagcaaggtggctctcctttcaccagcgtgggacgccctattagcttatcacatccctcaatgcccaatgtcttcaaggatactaagcacaggaactcttcctctggccagtagatgagcacaccacagaaccagatttccaaacacacaagttgtctaaggcatttccaaaacatgattattggttgtgatgggctcgtggggaagaaaaagttgcagtgctttaagtccagttctgagagagatgattcgtgaatctgatcaagctgcactcttccttctttgtcatccacgtccagtattagcttggatttttttagataatggaagcttttattaaactcagtcaattacatcaaggtgatacaattatcctgagaacacttccggcctctgcataactaagatgcacaccgccgaacaaacaaaacgacactcgaaaggaaaaaagaatgacatggagtattgaggaccatcaatctaacgactaaattgccactcatgaacaactccttggccatctcctccaaaagcacagagttttaaggaccaccaattctaagactagatcaccacccatatccctgggtaaaaaactccttgaccaccttctccaaatgttgacatgccgcaactaccatatcccgcgaatcaggcttctgtaggatagcccatatacgaagccaatggataagagaatatataacctgcaaatgtgaagatatgacttttttatcaaaaaccacattattcctgtatagccaaagcgaccaacaagtagcagctgctcctaacagaacatgtgatttcaaattattatgaattccatcaagccagctcccaaacatatgcgctacacaatgtggtggaggaagtccagatgctgcttggatgatggaccaaacagaaagggcaaaacggcattcgaagaaaagatgtctaattgtctcgtcattgcaacaaaaacaacaattcttattgccttgccatttcctttttatcaaattgtccttcgttaacaccactccacggcttggataatgaggacatgtaactggcttggataatgaggacatgtaactggattgaagtaaaaacaaggacagttcggccttgttttcatttagactgaaaatcttgagctttggtgcttcgggtagactcctcagttttggacagttcctgatgtcagccttttcaagcagaggaaatgttgattcgttttccactagtctctctaagccctctaaatcatataacttgattttctttaatgctggaaatggtgtgaaagccatttcacagcatagtgtttgcagttttggacatttctctatttcaaccttctcaagcagaggaaacactggttcattttcttgtcttcctcctgttgctacccatctctctaaagcttccaaatcgtgcaacttaatcttctttaatgaaggaaatgttacggatgccatgtcagggattagtgttagaaactttggacagctcttgataacaacgttctgaagaagatgaaatgtttgttcttttccttgtctaacttccttgcaacatagggtttgcaatttatcaagtctgatcaaacagagaacttgaagagacttaaattgaatgaattgaggaaattcttcgcacattgtacaaccctctaatttgagctccaccaagttttgcagtatacttagatctgtcatccatgctggaaaaatgagtgcttttataggaaattacgttgagcatcagcagcccatgatgtggtttaagagcatcaagaaccttcccattgcaatttggttcttcaacacagcattcactattccacacaagagataggcgtgcaagtttctctttgtttctaagattggctgcttttgcatcttcttgagatacattttctaagccacgtaactctagttcaccacagaggtttaagctgtgcagttctctaagggtgctgcaaccagagctagcaccaaccacaaaatatgttagtgtccggatggaagttaattgcccaagctctggaggcatgcacttcaatcttaagcatccatttgtatagaggtgacgtagacttgtcatatacttcatatcctttgggagaccaacaagaattttgcaatcagaaaggatcaaagtctgcagattgtacagtgtgcatatatcttcaggaagtactttgacatgatagtttctggagatatcgagatatcttaggtgcagaaggtgccttggcctgattggtaatgattctgtattgagatatctcagccttagtgctcgtagagaactgctcttggataaaagtgatgttgagatgtgaatatagtctctgtcaaacaataaagtccggagtgttgaagattgttttctcataaagtcatctaagagaatagtattgtcatcgtctaatgagtagaagtgatacctaggatgctctaatgacttacttctataatcagatctgccaactatgctgacacattcttctcccatagcagattgagcaatgtcatgcataagatcatgtatcttgcatgtagtttgtagaggaaatttctgcacatcttgaaaaaatgacctccaaactagctcgttgaagatatgtttggccaccatttctatattgtcatcctcttgtaatggtatcaagtcatgtgctaaccataagttaatcaaagtctccatatcaatctcaaaatcttttgggaatatagcacagaaggcaaaacaccgctttatatgtaacggtaggtcatcatagctcagacgaagtataggaaaaattatgtcctccccctcattgcaaatgttgctcttggctaatatatccttccattcttgcagagtagtcctgttaaataacaccgagccaaaggattgggcagctaaaggagagccatcgcatctctgcacaatcttacgaagaacttcaaaatgctcgtcacttttttttgacaaactaaatgctttactctggattatttccatcaaataagcttctccgagcttttcaagattatgcactggaacttctccaataaccataattctagcaacttctgcatttcgagttgttgttagtactacactacccatgccacccttcttaaagcaggtctttagctttccccacttatcagaatctcgattccatacatgatccaacacaatgagatacttctttccacctacttctttctgcaagtcctgcaaagccttctcacgatctctctctgtgctcatacatatgctgtttgcaatggtgacaacatcaaacacatctgacacacaacaccacctacgaagcgggaaatacttctcaatttcagggtcattgtaaatgagttgtgcaaatgtagtctttcctagcccacccattccgacaataggaagaactatgaggtccttgcctcttgcttcatcaagcaacatcttgataatcttcttctgctcctcatctctagatcggctaataatacccttctcagtatcaaccatgatggaatcagtttgcctccactgctttggtgtttcctgctgctgttttatgagtccagagtagtccatctctgatatacaatcttttgcaatttcttacccatcctataacgaaacacaattgggttacgatgagggaagaggcttacaatgcctttgccaagggtagcgtcgtgccccttcttcttggcttcacgtcggagcgcctcatacttgaactcgtcaaagacatcgattgcctcgtaggacaccttcttgagttcatcgagccaagcgcttagttcgggtttcttacttctcttctcctccgtatcttggatgacgctaaggataagtggaagcatgcgctccagagccttacgctgctgctccatgccttccatcaccttgtactggtatacaaggtagctggaagctttgttcgtcaccgcggagagcagtggcctaaccaaaaactcagccatcgttggttccctctaacactgtagacctgaagattgtggaatgaagaagatgaaggcaaatacaactaaaatgatatgcaggaagatgaagccagatctcctaacctcgtcgaccaagatgtttgtggatcggagcagcgcagtcgccggtgcggcacaggggaggcgctggatgagtcacgaaggttgggtggtgttctccttctctcggtatgtagctcgcattggactgacagacgatggaggatggtggattgctgctgcacactgagagacgacttatggttgtgtggctgggtagtgctggagaaagagatgatatgtgagagatcactttgctgggttgttttaggcaaggaaaaaggtactaatgcacaattgaaatgatatggttgtgtgcactgcattaattgtgtcttcatctggttggtgaggatgacatctcgataactaatttttggtcaccaaggttttcacatgcatgcgtcctggtatttttgcttcattcatgtgccatctactttttgcacattgtttgtgacagtcagttattttacgctgggggtgaaattgtggtgaatggttttcagttgctgaaatgtttttttctttatggacctctattactttttcagctatttgtttatttaaaatttaaataaactaggcgattgtcccctgtaaatcgtgcggtcctagattttaggcccgatttagtcctcaaaattttttcccaaatacatcatatcgaatctttggacatatgtatggagcattaaatatagataaaaataaaaactatttacgcagttaggggagaattgcgagacgaatcttttaagcctaattagtccatgaatagccataagtgctatagtaacccacatgtactaatggcggattaattaggctcaaaagattcatcttgcggtttccaggcgagttataaaattagttttttcattcatgtccgaaaactccttccgacatcagtcatacgtccgatgtgacacccaaaaattttttttcacgaactaaacaagggctgagtttagatccaaagtttttttccaacttccaacttttccatcacatcaaaactttcctacacacataaacttccaatttttccgtcacatcgtcccaatttcaaccaaacttccaattttggtgtgaactaaacacacccaaggccttaaaagtaaaactagtctatatacaacacttcaattataagagcttgtttagttggtgaaatgataatttttggatgttacatcggatgtttgaccgaatgttggaaggggttttcggacaagaatgaaaaaactaatttcaccgctcgcctggaaaccgcgtgacgaatcttttgagactaattaattcatcattagcacatgtgggttactgtagcacttatggctaatcatggactaattaggctcaaaagattcgtctcgcgatttccgtcataactgtgcaattagtttttttcatctatatttaatgctctatgcatgtgtccaaatattcaatgtgatgtttttgagaaaaaaaatttgggaactaaaccgggcctaaacttgaatgtttgattggagacagcaatgtaaatgtcagtcgtgtccattaattggagtagagtgatggcagagtttagggcaagcaccattcaaccagtactcagaatactctctccgtcccataaaaaatcaacctaggtgagaatgggacatcatctaaaataacgaatctggataggaggttgattttttatgggacgaagggagtgttaggatacgataggcaaataaacgatgaagaacaatagatcaatcacagaagacacgaggttttaacatggaaaaccctcctaagatatgatagaaaaaaaaaacacgagcgccagccagcaaaactgcactatatcagatgaggttacaaaacgcccaacggctgcttcgctctggcccaagcctctagcgatgggcctccacttcgctcagtccgaaattggcctttatatatatgtgtgtgcaaatgaatttggatcacaaataaacagggagtacttgccaacttaggccatttacagtgcaaggacgtgacgtgtggcaatgtagagccacgtaggcaaatcgcttgcgtggaggagagaggggagtggggaccattcccaacctagcttcgcgtgaccaagtttggccacacgaacctcagcaacttttgtcaaaaaaaaaaagcacctccacgagaaataagaaagcgagagagggagagaaaggaggctcgccggagtaggcgcacttggggcgtggggctcggcggaggcttgccgaagtaggggtgcttggggagctcgccgtcactgcgtggggctcagggaagccaccgctgcgtggggctcgccggagtagggccgctcgaggagcctcccgagatccaccgccgtctttcgggtggagctcccgaagctcgccaccccctcgcgcgccggtggcgttggcggggtccgcgtgcggctgcgcagctccagtgctgcgcctccaccgtcgacgacggtgtcgtctccgccgccgtcttccgccgcaccgctggacgccgccggagctgctgcttgttgccgcgtgggctgctccacctggttggaggaagagaggtggcgtcgcgcttgggccggcccgccgccgagctttgctgcgccggtcggagcacaccgccatggcctccctagagaagacacgagaggattaggtgggggtgggggaggggtgagattttttatattatctgtgggtcctattataaagtttctaaaccacactagcttgccacacttgaattgtggatgtagtgtcttttggagttcccagacctacgtggcagttgtggcatagcaatatgctaggacgcattgctactgcccttagagcaggtacaatagcagagtataagcaagctgcaaacatattttaagagataaatgaggagagagaagggcagcgggctacagatttgtagccagctgtagtacggactccaaggcagtgtgtgtatgacaggtgggaccagatattaatagcatagtatgtaactattgtatgaataagctattagattggctatagatgaattgtagctagtagttggctatactattaaacttgctcttagagtaccttgttgtatgtaaggtggcgcggcctccgatgctgaattattgcaaaccagaagttcaccagcaaagcgacatggagcgctgacccaccaagcccagcaaacagcagcatgcaaatggctgatgcacaggaatgcacgctgatggcagagaagttagaaatccgatggagctctggttcttaatctacttcctctatcccatataaagaagcaactcctaacattctaatataaaattaaaggagagaataaaagaccaaaatatcccatcgtcctattctaagatgctgaagccgatagtgattttaagccgatgatgactatagggcttaccgaattttgatgttaacaggtgtgcagatggctgatccgcgcacccacttataaatcaagataaacaagtttgcagctttagcttataagttaattttatggattagctccttacacccttaaatacagtagagccgatgtgagtctggatcctgcaagtggaagggaaggcggggcgagtcgccgggcgttgtgtttggctggccgtacgtccccttcgactgagcttggcaggctgcctggctgtcctgcccggttggggtggttgtctttgcatgactggccggctgggtccccggccttcttagctggttgagcacttgagctacggctagggttgggcccactaaaaacaatcactaactgcctgccaacttggagccatgctgtgatccaacttgttgtacagaacctcatgcattattgcaggtggtggcctcctgcattattgcagacggaacacatcatcacgacatctcactcaatttctagtgatattttttcagtcatttatttccagaccaccaagaacaaactaaagcacacatcgatcagtagccatggatatcgtggtgagcgtctcacatggggcactgggaccactgctgggcaagctcaataccttgctcgtagacgagtgcgcacgcctgaaaggtgtccaccgtgagatacgctctcttagatcggagttgagcaacatgcatgcggcgctccacaagtacacatcactcgaggatcctgacatccaggtgaagacctggacaagcgagttgagggagcttgcctatgacatcgaggactgcatagacaagttcatgcaccaacttggtgccaacgacgaccagcaccacactagtaatggcgtcaaggacttcttcgggaagagtgcaaaacgtctcaaaactcttggctcaaggcataatattgctgccgagattgaagaactgaagatgcgagttatctcggtgagagatcaaaagaacaactacaagcttgatgatattttttgtagtagctctagcaacactaatgcttttgttgatccacggttggctgctctcttcgcggaagagaaccatcttgtcggtatagatagtccaagggatgaacttgtcaattggttggatgcagacagcaggttgataaagcatcgcaaggttgataaagcaggtcaattgtggggtttggaggtcttggaaagacaactctagcaaatgaggtatatcgtagggttaaaatccattttgattgccctgcttttacgtcggtatcacaaaagcctgatatgaagaaaatcttcaaggatattatataccatatgcctacaaaagatgcattcctcaaagatattgacacatggaatgaaaagaaatttattgaaaagctaagagaactacttgtggataagaggtaattctctagctcctttttcttttccacttcgagaaattctttatacctacattcgtgatataatagagtggttttttcctacacaaacttatattgtttataaacttcaactaggtatcttgttataattgatgatgtctggtctatttcggcatggaaagctatcagtgttgttttcccggagaatggttctagtataattatagttactacacgcatttccgatgttggacggtcatgctgcttaaatggaattgaccgcaattttgagatggaacctctaagtgaaattcactctagaagactattttgccagagaattttcagcacagatgaggatggctgcccagatattttacaagaagtttcaacagatatcttgaagaaatgtgggggtattccattagcaattattagtatatctggtttgttatcaaacagaccaattatcaaggaagagtgggagaaagtgaaagaatcgattggttttgtattggacaagaaccaaaatctagaaggaatgaaaagcatactctcccttagctacaatgaccttccaaactattttaaggcatgtttgatatatttgtgcatatttccagaggattatattattgaaacaaacatgctattacggcgatggatagctgaaggctttgtctctgaggattgtggaatgaacttggaagatgttgcagagagctacttttgtgagctggtcaacagaagcctggtccaacctgtggacattcgctttgacagtaaggcccgtgcatgccgcgtccatgatataatgcttgaacttatcacttcaaaggcgacagaagaaaactttattacattgttacgtggccaaacaaggaaaacaaatttgcatggctacgttcgtcgattatccatccaggacactgataatgatttgtcaagtctgttagtaaacaaagatttaagccatgttcgatctctaacctgctttggtgggaacatgaatcttttgccacagcttgcccgatttgaggctatacgagtgttggagtttgaaggctctatgaatttggagcagtatgatttggaaaatacagacaagctattccaactcaagtacttaagccttcgtggttcagacatatcacacataccaagacaaattgcaaagctccaaaatttgctgacattggacataagtgaaacattcgtagaagagctgcccaccgaattatgcctgttgaaaaagttactacatctattcggaaattccttgaagctaccagatgggattgggaatatgaggaatctacaggtgctgacaggcattaatataagtaatagctcagcaagtacagtgcccgagcttggtgaactaaccagtttgagggacctcaaaataagtttgtctgataaactcagcaagtgcaagacaaaagaagagatgttactcgcctcactttgtaaactaagcagctacaaactccaatcgttgcatattatatataacagttccgatgatctcttagaacgttggttccctatcccttgtttcctccgattgtttcgcatgagcactaatcactttctcccacaacttccaaagtggattaaaccgagtctcaccaaaatggcatacctgaacatcaatttacgtgagataaaggaggaagatatggaaacacttggagacctgccagccttactctgtctagaaatatggctagaacctaacccaaaaaaacagcttacagtccaaagcacaggattcccatgtctcaaggagtttctccttgtttgcggcgatcacgatggtggagcgtacctaacatttgggaaaggggctatgccaaagctggagaagcttgagattccatttcacgtattaatggcaaaatcccatggtttctattttggcatcaacaatctcctgcgtctgaaagaagttttttgaaaattcaccgggggggagagcttccccacctgaatatattacttcgaaccatcttatatagaagagatacatgagagtttccaagcacaggagcccttgaggataacatgagagaaagcactgagagatatagagaagagaatacaaaagattaagagacagaaggagaagctttgacattttccacctacaagatcaccaggccaagatcaaaatcacttacgctaggccctatctcaaccacatccgcttcacacgcaaattttgaaacaccataagacaatagagccagggggccatttctgccacaagcatgtcaactcgagttccggcgatcaaaaggctgtgattgtccaggaccacccgcattagccataaaaaaacacgacttcatcatgttgctgcttgcatcaatgcctgccggcgccctttagggaaaggaagccccaaaggagggagggccactgaagattacggtcatgggccatccgcatcaagacgtcttcaatatggatttaacaaagtgctagcaagttcaacagcctccaacgcccttcgggggaaagaagcccctaaggggggagggctgctaaacaatgtggccaagacaaccaggtaaaagggtatagcggagcaaggaggtagacagaagagataatgaagaggtggagatctcacaggtaggaggaacatcaacagcactggcagagagatgcaaagatctgaggccatcacagccaatggagaagcacaatcaagaagagatagacccaaactatcaaacaaggagcaggttaatattgaggggattcaggtaagggagtcggcaccaacaaactcctagataacagatcaggccaaattggtcgtggcaggcttaactccaaccatggggcacgacagaaaaggcacaaagcggacaacagaagaaaaggggagaaggagtggatggaataggggagaaggatgggaaagcagggggactggttgcagggtttctccaaaaatgatgccttcaagaaggtgacgacgtcggaaaggacgccaccatcacataaacaggagactggaaagggttttcacccagcaaggaggaacaagggtgttacgacgacacctctagggaggggcatgatgtccgaggatgttcatcgccgtcagtccggcgatgagtcggacagagcttttcacccaacaccctaaaaccatcctcactaccagctagcacacaccgcgcaacccaacagccatgcgcggtggaactggtcccaggtcgtcggccgctaactagcccggcaggtcccaccgccgccaacctgcacaaccgacagcaccccacaaaccgcaagtcccactcccgacagatctagacgaaacccttgaacgggaaaaatggccacaacagccttccctaattccaccaccagcacaatcagggaaggggggcatcagcggcttgaaaacccagattcggaatgagaacattgaagaacaacaaatgaggagggaggctaggagaaagacgggagggtgggaaggaggtagaggagggtgggggcgccgccagcggcaaaggggggcggtgccgccgtcggcgaggtggtcggtggtggggtctcgggggtttggggctatcgcctcccgggccgcccgagcgagcgacacgggagtcctaggtccaggtaccgcttgcgtctgaaagaagtgaacgtaataatctaccgttaggggactgtacgttctgataccgagtctgcggtggctgcaatcaagagagaagcaagtgcaaatcccaaccatcctagacttgccatcttcggagcagatgcagaagaggtccaagaggataatagcgaagagagtgattataactggggttcagaggatgacgatgctactgacacctgatattgttgccagccatgatctttctggcaacccatgaaagaggtaaatagaattctctctaagtagcaagctagttgtggttgttacttttactatcttattttgtttcactcgatctgtaagaaatttgtgcactccatttctttcaggtttgcttcaattgcatgtcgtcaagtttgaaactggagtccacgttaagtccgtgcaaagtgggaagcataaattatatgtgtgcttcacattattgttgttgtcgacattttgtcttatcaaaacatgatcctgcatgttgtactttctaaataatgtagcaacttcgggctgcttggattgttataattttatttgaattttttatggattctagagtattaacatggtcagctttttttttcatccttgaaaagatatgacaatgtacgattttataccgtgaaaattgatcatctgcctgacagttcagtagcagttgatcgcgtttcaaaggcatatgtaaggcaaatgaacatttaccactcagctaagggccaaatgatcttaaagattacctattatcggtcaaatttagaaattctttgattgctattgtaaatctttagaagtctaatgtgacaacgagacttaggccctcttcgattaggcttagatttattggcttagacttttaagttaacttattggcttatatgatttataagccggtggatttaatgtcctaagtttaatagtggagtcatacatctacctcacataagccaaaatagcttctccaacttagcttttggcttaatagtgttagagtggcttatagctttagaaaagccaaacgaaaaggccgcttatttgtttaggcttagactttttgacttacaagttggtttataagccgaaacaaaagggccttacccaccacatttgattcaacgcggagctgcagggggaaggggaccaattgcaaggcctcgtctatagtctctgtggggctcaccagccaagcggttgaacgccctcctccagtgcaactcatctatttgtacaattgtgaatgtcacacagaaagatgatgacagtcgagagtaagacggtatagttgtgttaaatagtcctacattggttgtgaaagagcaaatgacttaatatataaatggaagagcccataaccttattggctagtttttggggtgggaaatgccctttatgattctacacgttgtcctcgcaaccattcggtcgaacaccgaaaatgcagtttttttttccttctcataatctctatacaacttttgcatcaaatgatttctcatacgatcactcaagctaatttacataaatgaaaatgagccgagtaataggagacacgaccaatgcaactcgcccagtatgcagccaattaatgtgaatgtatttgtggaacatcatgttaattagctttagcttcatggctggccactggtcagcggagcagaggaaatcagagcatcgcaggtgcaagatgaattacgctgagcaaagcagagcacttcaggtgactttctggtgctccaaatatttttattttttgggatagaggataaatgtgaggacaatagaggtgttattgaagataaaatggcagctgtcagacggattctgtactaaattgaaatataaaacacataagttcaataattgtactccctcggtctaaattgtagcaacccatgaagctcaataatttaaatcaaaccgagacttaaccaatttaggtaatgatccaatggaaatgcaattacccaaggcttcttttgaccaaacaatattcagaaacaatattacagcctcacgttcaccaatgtatccagtgatgttgcgagggtagggaaggtcatactgctgacgatgtgaaactcattctgttgggacggaataagcgtatcttccaaaaaaatcccacaacggttgatagggtggccaccctaattcttcaagatattgatcaaagactcttggctttccaacctccttgatgctttttttcgtttttgtgtttttgttgttttcttgtctgtaaataacttttatttcgtctaatatattccggcagtccttctgccgtcgttcccctaaaaaaaaaaaagaatcagggtcatacaagacagccagaaaaaaagggaaacagaaaattgtaccagataactacatgaatactaatactacagactgcagagtgtagacatggtttatttcttcagaagacacttcatatgagcaagaaaaaccacaagtagagcatcacctactgtgtacattaaggtcagatttttgtagagcgtgagatcttcaagctgcttgatccaatttacattacccaagataagtggagatcatgtttagaaagataactaatatattatattctcagtcacttatgcaccaatcgtgtatctggaagtcgtccagccagacgcaccaatcgtacttcacctgtagaaagcagcagcaaccaaatttgacgtttcagctactaaaacctataaattgagaatgcacgagtcaatctcacaaaccttccaggtaaatctcctataatcaggtcaggacatcaatcatcctggttgtaccaatatccaccacatccaggaatagcatatttccaagaccatggatccctcaataatggccctaaatgtataacagagagtcagaattcctcgatgttaatctgtgataaataagagagagagaattcctctatataaacaaacttcaaacatgtaaatcaggtgagcacttactaaaagaattaatagactagagggtaacctgcaaatggaagtttcaactttcaaggttatgagaacaggtgactacaatccgaaagtgaagattataataagtcgtgcattttcatatatatgggcaaaaggaagaaactagtatcaaaaccacatgcatgcatgccatatatgtagaactaagactggaaagctttaaaacaataacagagtaggtgtagtagtgattaaaatttgagtttctcaacaggcaaaaagtacagcaaggtagtactactatcaagggaaggttgatcgaaagggaccttcttcaggatttcttgaatgaacatctgataactctctgatctcaagactatcaatccgctgcccgaggcgttcatacagaggcttcacatttatagctgggcagtatttaatcgtaatatcttgaagaagtgggtaacgaccatggcaccctgctactgattgcaagcgtctgcatccctcaagacggaggattcgtagtgacggaagatctcccaaacaatccaatgactccagtttattacagtgatcaataattaagcgcttgagtgcatccagctgtcctgagacggaacaaagcttctcacagccaaatattagtagcttcttgagggaatgattcagcgcgtctagttgaacagaatgaaggttgtcacactgaccaattcccagcgacttgactgtcggtggtagatggttaagtgttaccaatctatgacacctacctatggttagactctctaaacatggcagagaattatttcttagtgatggagattgctgatctggaacaattgtggaagcaaggtcattgcagtgttccgacctgcgttccacctgtattacactctctgactctgtcttatcctctctccacattagctgaagatttctgcaatcatgaatagaaatagatgtgagagatggtggaagtctaaagatctcttccaagcttttacattgccttattgatagtgacgttagatacggtaacaactgatcgcttggaactcgagttgactccccactcacatgtctgtggcctattaggttattacatttttcaatggccaaattcttcaaggaaaccaagcatatgaactcttcctctggccagtacacaagcacatcacaagattcaattttcaaatccacaagttgtccaaaccatttccatatcccaactgttggacgggatgggcctaaggggaagaagaaggcgcagccacataactccatttccgaaagaggtgcttcataattctgatcaagctccagtcctgcatttccgtcactgacagacagtgttagctttgataatgaagaaaatctagacctcagaattaataaggatagctctgccttttcttcaactagcttcaatatccgaagctttggtgcttttggaagggatttcaacattggacagttcattatactagcactctcaagcaggggaaatgtcacttcttctccttccgtcgccgaccatctctccaacctctccaaacgatgtaactgaagttctcttagtgctggaaaaaaattggatgttgtgtagctgcataggcttgcaaggttgtctaaacttgtgagacaaagaacttttaggacattcaaatgacagaattgaggaaattcctcgcacattgaacaaccaactagatagagctcggccaagttctgcagcacactgagatctgtcatccaagttggaaaaccattgcctttgtaaaatgctattcttaacatcaggagcccatcatgaggttttagagcatctagtaccttcttttggcgatctggttcatcaacaaggtggtcattactccattcaagagacaagtgtgtgagtttcactttattttcaatattgactgtgcttgcttgtgcctctgatacattttctagaccacacaactctaattcaccacaaaggtttaaattctgcaattctctgacagtactgcaaccagagatagcaccaaccacaaaatatgttagtgtctgtaaagaagttagatgtccaaggtctggaggcatgtactccaggtttttgcatccattagtatagaggtgccgtaggcttgtcatgtacttcatatcctttgggagccggcgaagtctaatgcaatgagaaacattcaatgtctgtagatggtacagtatggatatgtcctctggaagttctttgatgtcgcagttttctgagagattaagataccttaggtgctttaactttatcggtctaattggaagttctttgatttcatatagctgcagtccacgtagagaaatgcacttcgataaatgatgtatcgatccataagtattccatgttggatacaataatgtccggagagttgtagattgtttcctcagaaaatcatcgaaatgatctccagttctatgccttgacacgagcaagtggtaagtcgaacgatttgacaacaactctttgcgataggacctatccgtaatagttacgcattctttccccataacatatagagcaatgtcatgcataagatcatgtatcttgcatgtggtggtgtatcggagttgcaccctgtctccattattactgcacacaagaggagtttgtttgacatcttgaaagaatgacctccaagctagttccttgaaaatttcttcccctgatgtcgtttcaaaatgatatttctcctctagtggaatgaagtcatgtgccatccatagttgaatcaaattctccacattaatctcataatttttggggaatatggcacagaaagcaaaacattgcttcatgtgcgatggtaggtcggcatagctaagctttagtataggtaaaattccagtcttctcgttgcaaatgtcacttttggctattatattcttccattctaggatgctggtcttggtactcaacatagaaccaaaggcttttgcagctaaaggagaaccttgacatctgtccacaaacttctgaacaatttcagatagctcatcactgccagccaaactgaatgctctagtctgtattatttccttcgtatattcttcgccaagtttctcaagattataggcttcaactacaccagtgatcataattctagctacttgtgaatcacgagtagttgttagtattgcactacccttgccacccagcttaaggcaggtcttcaatttttcccacttatcagcttcccggttccatacatcatccaagacaattaggtacctcttcccacttattgcctcctgcagatcctgcaatgccttttcatgatccttctctgtgctattgcagatgctatttgcaatatttccaacatcaaaatcatctgacacacaacaccacctccagagttcgaaatggttcttgatctcaggctcattgtaaatgagctgaacaaaggtggtttttcccagcccagccattccaacaattggaaggaccaacagatccctattgctgctagcatgattatgcaatatcttcacaatcttctttttctcctcatctctggatcttcttataatatccttctcagagtcagccattatagaatctgtttgacgccattgattggatggtggagcttgctgccggtgtatgaacccaaaggagttcatctctgagacaaggacctcaatgctccccacaatcttttgtagcttcttacccatcttattacgaaacatgatagggttataagaaggaaagaggcttacaacgtccatgccgagcatgttgaactgccccttcttccttgcgtcgcgccggagggcttcgtacttgaattcatcaaagacatcatttgcctcataggccaccttcttgagtgctctgagccaagcgcttactccaggtcgaaaagctcccttctcctccgcatcttcaatgacatccaggatggcaggcagcttgcgctccaggatctcgcgctgctgctccatgccttccataaccttgtactggtctagaaggtagctggaaaccttctccttcaccatggaaactagtggtccgataacaacctcagccattgttgcgctcacaactgacaagaacacaaggaaacactgcagcagtgaagactttggggtgcactagaaaaatatggacgagcgcttcagaggaaatagatgggagtgtgcttgttgtgatgtgtccccaatgatcagccacttaaaatatggttcacaggtaactataacactacagtactctagataccttattagcatctaaataaccatgtgagagcacctgctgtcatccatttgaacttaagaaacatccagtagaactaaagtcattagttactacttacacctgaaaaaaaaggaaattttgaagacatatcttttatattataaagatagctctaaaagaaaacaccatgttcgatgtgaaggcctagaaattacaacattacttggagaaaaaaataaaatataaaacattacatcatgatataaccaaattataacggtgtagaatgataggaacagttgtataaatttacaattatatctatggaaacacaatataagagttatatattaagcccaattctacttttagtatttatattgtatatagaatataattgcatatatatagaaacaggaggtaagagttgtatacttgtatatcaagtcatattcaacaattagcttgatatgatgcatagtaaatatatgttagaggtggtgtcttgtaaaacatgaattattggtcaattgaaaacaagagggaataaaattccacctactaatcatgtgagagcatctatgctcatccatttgctcttaagaaactacctagttgtcaaattgacctgtcgagatgcatgtcaaggcccatagaacaaaggtatttgaagactttgctagttttgcagaaaaaaaaagcgagcgattatttttgaagagagcgattattgctctcttcgaaacaaatttttgtttataggtaaatgaaggccccgggcatttgtatttgtatgcagatttgttatttcagccaagagggggaacccacccaattttattttaggccaattttattttaggacaagaaataaaaaagaatgcagccaatgtatgaaaaataggactaacgaatgtcagtacagacacacagcatctgacctcagtgagaagctagcacggcgatgcagtcggctggcaccgtggaacactctggcgacacatcttgtcggcgtcaataaccctccggcgatgccttcccgtcacgttgtttctgttattcctgatcggatccaatgtgtcgtccttgtacccatttcgtcgagcaccatgtgggcaccggcgtgtaagccgcctcgtctcccgcctcttgcttgaattcttggcagcgacagagggaggagagaggcgagggtgccgacggcgcaaagcatgggaggttgacggacggcgaggctggcgagtgggtaggcggctgctgatgcagcgatccggcgcccgctggattggtggggcgagacgaaaaatgcagcggtggcgccattagtttgcaggtttcagcgagcaattgccgatgcgatgcttaatttgatttttttttttttggaaaaagtacaccgaaggtccctcaacttgtcgtcggataaaaaatatcactgaaccgcaaaaccagatatacgaggtcccttaattatacaaaaccggccaagagttccttcagtggttttgacaaccgttttagtctacgtggcggctgagtaagcgtgggacccacgcgggccccacatgtcagcgtaatccacgtcatcccctccctctttctcctcttctatctctcacacacactttctcctctctaggcagccggccggcgagtggggaaggaggttgccggggcgaggcgggagaagaagtccggcgatgcggcaacgacgacggaggtggggccaggagcgaaggcggcgagggggtcaccaccgccgccacccctggggcgcgcgcgaagccagcggcgagcaccgactcctcgtcaatgggccagaacacatcgagcgactcgcgcggcagttcgtcgccagtggtgctcactaccttagccgcgccgggaacgtgaagccgccggagctcacgacgcggcggccaacaatgtccagcgtcgggaaagcggcgaacagcgtcgcgccactgccgccgccgctgttcggcgccgccgcgaaggtactgttcgcgagaggaggaggacgaaacatgctgctccctggagatatcttcatcttgatgggctgtgtgtcattgacggcgccgcctcctccctctccccggcgtcggcgtcggcttggcggtggcggcgaggcgggaggaccgtgtcggcgtcagcgctgggagccggagcggcaggaggcagggacaggcgcgacggcggcggtgcgccaggaccaagcgccgctgctactgccgtgctccccccgtcctcctcgcgctcccccctggctaccgccgcagccgccctccccttcttcccccgggcgccggccgccgtcgcgccgcagccgccctccccttctccccccgggcgccggccgccgtcgcgccgctgccgccctccccttctcactgtggaggacgtggattacgcccgtggaggagaaagtgtgtgtgagagagagaagaggagaaagagggaggggatggcgtggattacgctgatatgtggggcccacgtgggtcccacgcttacttagccaccacgtagttcaaaaccgggttcaaaaactactgaaggaccttgggtgaccgggtttgtatagttaagggacctcacatatctggttttgcggttcgagaacattttttatccccatgacaagttgagggaccttccgtgtactttttccttttttttatttgtttccgattggattcggaggcccaattggattctgtactgtacagtacatggcccattgccaaacatgtaatgctggcccaattattcctgcacttgctgttccctcctttggcgcagtaaaagttagccaaagaaaagaagtgagtgtagctcaactggttagattgcttgtaatagcagttcacacaggtttaaattttatatttgatatgtgtgctcgtatttacagctaattattttttaagtggcaggtgacgtttccgttgatagcgaggcgtccgtgacaactctgtaaatctcaagatatattggtacagtctttcaaaaatgctcataaggataaggggtgtgcgatgcatgtgtgcatgtgttgtgggcactgtgtttgtaatgtgtttctataaaaaaaagttagcgaaagatttatttgcacctgtctgcttttgcctaattatgtcctaagaactttattgaataaatagttcaacgagatgaatatggaaaacttgcctatcttgaacaagacaacttaatcaaactgagcccactaacagaatcgattatccctaaaaaaaaagaagtaaagaagaatcgattagatacatcaacttgcagtttaaataacaaaatgagtaaattgcacctacgataaaaaaaatccctgaactgtattgtatcaattcatccagcaatcatttttttcttcttttcttttttctagatttgaggtatcaagcaagcaggggatctgctgttctgttagagattaacacaacggatcgaagcgtcgtaaaggttgaacaacgttggggagagagaaaatgaatgtttggaagaggcaaatatatacgaaccgatcaatgtgcacacagaaacactcacaaaaagcgaatagtgcatgttttgtatgagatgcgcaaacatgttggtaatcgagaggaatttgacataaaggcaaatataaatcttgctcatcttgatatgttggacaaaagctccctatgcttatttctgcacataacagtttttcaagtaaacttactgcggaaaaaatgcctccgtccctctcccctagccccgacactcacccgcggcggcgacgcccggcgccacgaagcttccacccagttgatccctcgctccacatttcttccccagtccttgaatgtttccccaccaaccaatcttctccagtcttcctcccttccattcaaagctccctctgtccacctgaggagggagaaatcttcgtagactcccccctagatccaggctgttctgaagctggagaagagatcccccatggatctaacctccatctgcccgtttctgcaacggatggggatcgaggtaaggagaccggatctatctcaaaatcaatttcaaatctgcattcatcccagcatatccccaagcagatctccaagcagatttcaaatccccccgccggcccaatgtcttctcggcctctttactccgccgtacttcgacaagatggacatccaccagtagctcggcgcctaccgattgcaaatcacctcaatccctcaattcttggccgcccaccgcctcctccgtcttcaagagtgttgagcagtgggaaagttgttgatttgacgagacgccattaccaccccccctctttcccgaagctgtgctacttccaagactgagaaagagcagccatggcaagaagttaagcaaaggttctagtggaggaaaggatcctcattcaattctcctaacaaccaagagatcatggctgcaagaaagatccgattcctcaagcacacagaaggtaaatgcttccgctgcctccaacccggtcataaagttgcagactgcagggatcctcttcgttgttggttttgcagaagatttggtcacctctcctcagcctgcagagaacgccgctataaattgcaacaacaagtgcagtttcatccgccatcctagcaaccatctccaccaccagcgccaccactgctttcctccacagtgttccctcctctcaacaaccatctgaacacttcctctgctcctcccaccatggcctcggtcccaagtgacttggcctctcgccctgacctgggtagctgcatggtggcggcgacaagtgaaatggaacgtctgaagcagctcttcacggcaagatcggtggtggcctggtctgatgaaggccagaaggtggagatcggcacatttgctgatgacatccgttcggccttccgtatccatcgctccgacattcagatcacgaagttctatccagaagacttcttcctcacttttgttaaccatagcgatcgtgaggaagtgctgcaagagccaaggctggtaactcgaagtgggagagtgtatcacttcaagccatggaatgaaaggcgcaatgctgaagtaattgatgttcgcttccatgcccgagtctgcattgaaggtatcccaatgcatgcaagatcagaagaagtggcgacaaagatcattggctgcaagagttcagtccactacatagaagagtactcccgtcgccggaactacaaccgtacctttgatctttggatttggagctcagacttgagcagctccatcctgaaggcttcaagtttctctatcacaaggccagacagtgaagcaagagccactgatgttccttttcctgagttggagccgccccggatgccgggcattcttccgcagttgtttctcctcttccccaacctctctcacctgatctgttgcccgtgtcacaggatcagagggctttgctcttgcttgaaagacacctggatcctatgttctatgaggccacgatgggaggttccatctactcccctgatacttccctgcctcgtactgcctctcctgtgtttgttctttcagctgctgcagactcacaggcgacaccagttgaggtgacccggcatgatgtggaggagttcctggcggaggtgaccacacccatccagcagccactccttcctgcgccaggaaccaagccacgccgcccatgctgcaacaaggtgattactccaatacaaaggcaacgtgaaagactggccgtgaaagccagacgcaatacaaagcttgatttaattgcgcaagaaatacttgcaaagaaatttggcgttcttgatgataataagcgtctagatgaccaaattaagaaactttacttgcagcactacaagaaactgctctccccagcagacatgaagacaatcacgacactggtggagaatggaggctgcaaaggcattcggctgcgtgccaagaaggcggcatcggtggtgccgatatgaagccccaaccgtgacagaagactgccggccaactgttgatgatgttaagtagatggcttttgatgtttgtaatgcaaatgtgcacctctttgtgtttctgccaagtttcttggctgtgtttcagagatggccatttgcatcacaagtcctcccctgcagatggagtctcccccagtagtaatgacttttattcatgtcgcagttgaactgtttcatcctcaattggaatgtcagaggcttgaacagccaagttagaaaaaaaagtgttaagctgttggtagagcagatgaatgctacaatagtttgtctccaagaaacaaagatgaatcaaatctctgatgtggatgttttgcatactctgggttctcgtttcaaaaacgaatttgcttttctccctgctgatggaaccagaggaggaatcctcctagcctgcaacgataactatttcagcctctctaatgttctccggaagcagtacagtctcacagccacagtgactatgaaaaatgatggcatcgcatggacgataactgtggtctatggacctcagcaagatgcccagaaaattgagttcatcactgagctacaggaaataaagcaactggttatgtcaccttggctgctaataggagatttcaatctaatctataaaacctcagacaagaacaacagcaggctaaatagaagtatgatgcagaggttcaaaggaactttagacagattggaggtaaaggaactgcctctttcaggaaggaaattcacttggacacaagagtgtgataacccaacccaatcaaaaattgaccgtgctttttgctgtcctgattgggatgttcttttcgactcagcacaaatgtatgccctctcttcttcctgttcagaccacgcccccttattcataacaggctgtgtggaaagagagcaaaataactccttccgtttcgagtccttttggctaaagttcccaaactttcttcagataacagaggagtcctggaacagacctttacagaccaccaatccttttgcacgaattaatttaaagctaagaaggcttgcaagagatctcagaagatggaaatcaaccaaaataggagacacgagattgcagctggcaattgcgaatgaagtaatctttcaattagatgttgctcaagaggatagagttttgtcggatgaagaacagtgttttcgaaaatttttgaaagtaagagtgcttggcctggcagctatggagaaaattcgcttaagacaaagagccaggatcacatggctaaaacatggggatgtcaattcaaagttcttccaaatcaaggcgaacggtagaaagagaaaaaaccacatcctgctcctccaaacaccgattggtattgctttcacaaaaaaccagaaagaagaagtgaagcgatacttcactcaaaacctaggttcttttggccctagaaatcaacgactaaactgggctgccctcaacataccttctttagatctctcagatcttgatgagcctttcactgaagaagaacttaaatatgtcatttctgatctaccctcggaaaaagcccctggcccggatggtttcattggggcttttttcaagctgggatataattaaaatagatatgctgcaggcagtaactttctttggagatttgggatactcaaggctacaggacctaaactcagcacatatttgtctcattcccaaaaagactgatgcttcgaaagtggaagattttcgaccgataagcctaattcatagctttgcaaagataattgccaaactgctagccaacaggcttgcacctaagctaggagatttggtctcccaaagtcaaagtgcgtttattaggaaaagagcaattcacgacaatgtcctgttcgtccaaaacatgatcaaagcatgccatagagcaaaaaagccaactcttttccttaaagttgacatttcgaaagcctttgacacagttaattggccatatctgctagaggtcctacaaaacttcggttttggtcagaaatggtgtaattggatttctaacttgttgggtacctcctcctcggcaattctcctgaatggcaccccagggcaggtaatagaacatgcaagagggctccgtcagggagaccccctctcccccatgctttttattcttgcaatggaacctctacataaattgtttctaaaggcagaagagtctggacttctgtcaagtctccaaagacaaagacgtttcagatgttctctttacgcggatgatgttgcccttttcataaagccaaatcgagacgagatgctagttcttcgtggtattctctctgtttttgcagaagccagtggtctttacacaaacatggaaaaaacagagatatacccgattagctgcaatgagatcaatcttgatgactgtctatccatcttcccaggcagagtttcaaacttcccatgtaaataccttggtctccctttgcacacaagaaaattaagaaaagtagaacttcagcctttggtggataaagtgggatcaaggatacctggttggcaaggtcgattcttcacttcggctggcagagaagtgttggtcaaaaatactttgtcctcaaccccaatttaccacttaacgattctacaacaaaataaatggccatacaagcgaattgacagatttagacgagcttttctttggaaaggaaaagaccctgaaaatgttagtgggggcagctgccttctcaactggtcctctgtttgcaaacccaaatctcttggaggacttggaaccctcaatttggagaaattcgcgcgggctctacgactccattggctttggtatgaatggaaagatgaacataagccatggattaacatggaaattccatgtgacgagatggatagaattctgttcagggcaagcacgcagatctctcttggaaatggaatgaaatgtaagttttggtcagacaactggctacagggaagggctcctaaagacttggcaccaaatattttcagattagcaaaaagaaaagcaaattgtgtagctctagagatgcaaaacaaccactggatcacttctttaaggatgatcacctcgattgaagagatcaatgaattagtcttcttgggaacccagctgcaagagatcaacctacactgtaactctctagataacataacctggaaatggactcaacatggagagtacacagcaaaaagcgcttatgaaattcagttccaaggctctgttgtaaacaaaaactttatgccactttggaaagctgaagctgaaccaaaacactgtttcttcggttggctgatcctacatcaaagaaccctcacagcggaaaaccttttattaaggcattggccatgtgattggatatgcagtctctgcacagaagcttttgaagatgcaaatcatttagcaaaggaatgcagtttcactatcttggtctggaaccaggtttgcttgtggctaaatttctcacaagttccaaatcaccttgtgcattagaacatctcagattggtgggaatctttagtagtttcatttcaaggaaacagaagaaagaagctaataggagcccttctaacaacctggtggcatgtgtggcttgaacgtaacagaagaatttttcagcaaaaacatcttagtgccacacaagtagcttttatggttaaagaaaatatagatcttatgcagatcttgcgccaaacctaaaggtttgtgccttgcgaaagttgtttcttctttgcctgtaatttttttttaaaaaaaaagtaccactgcttgtagtggtcacctttaagactttgtgtctgctcattcttctaatatatccggcagatctcatgccgtcatttgcttaaaaaaaaaagtaaacttactgctgtggtggcttctacagtgaactgcagataacaatttttgaaaatatatgcaacgtatagcagattactacaaactgtcaaccgcatgctttttcagagaagcatagaaagcaatacatcgtggcagagcttattctctacaataaatacaggggtgtatatattcagagtttcagacaataaaaacagacaacacttccgctagccacatgtatacgtacgggagtaataattcaaagaagatcccgagtttgaatttattctgccgaaattcgagctcctcaagctgtatcacttaagcaaaacttgcaaatccaaaaaaaaactattttttttaaaaaaaccctctgtagtggagattcaccatcaaaaaggcagacaattgatatagtcttctatgaatggtaaaaatcttggagggaagccaagtaaaattatcagaagaaagaagtttcaaccaaaaacaacctctcatcttacactacttgttggattagagtcgagatgatggcaatcagttccacaaacctctatgatctggctattaggtcaccagtgacgggctgtcactcacatttgacgaaagtaaccctctgccgggttctaattccgacccgtcacaggtgacggaatacttgtgacagactgcgaccagtgacctcatctgttacggcctcccgatggacccgtcaaaggtgaggccatccgtgacaagcacttcggcctgtcactggtgggttcttagaagtgagccgttttggcgtggtgtaggttttcacttgaagaagagagggccgcattaacgatgccctaagagggaagacgacactcactagtgtcgatgtcgccaccgccagaagactgggggtaaggctttcgcctcggtctctctcgacggttgattgcctccaaaaaacatgatgagggtgttgtgggttatcgctgcctagctcgccacccggcacaacagctctgactctgtcacaaaacaagacgaccccatactataggagcaaacaacactactactccacccacggcgaaccacactacttgaggggttattgttcccaagattgtcacccagtcaagcagttctaactcctcagctcacgaaagctcagtcatgaggtggaaccaacaaaaaccaccaccaccgtgaacacagggcacctgattgtggtcggccttgagaaagcaccaacgacgctgaaggctgctcaaccttcactgagtaaacacccagcttggccaaaagcgacacctccttaccattgggcttcccgcgatcgggatctgagagcagaccagtacaaagaaggggggattcagctcatctgacttcacccctcacgatggcagagatcagtcgaggtcatccagccgtccacattcgatcgaaccgtccgcccagggaactgcatgatatacacgagcagacgcgtcgtgaatctggccaaggctggcccaacaagttgtttcccagcgccgtccgtcactcctaccctttttacagtgaacagatgcgttttggtggccgcgctctcctttttggcgccaaacgaggccacggcgccggacgatcgtctgacaacgcactgcgatggcaaaccacggattccaccgttgatcaagcataggtgaagtaaggacctaatctgagtttttacacgcttgatgaactgcttgatcttttaggcaaggtgagcatttatgcatccattggttgtacctcccttgtttgttactgcacatgtgcagatgctcccattcaccactgccaacaggtgctgaacgcaggggatgacatgattggtgttgagcacttggaagaggattctgatggcatggctcttcttaaagcacggagctctgccggatcaatgatcgtcttcagcctttttttttaacttaatgcacacgcatgtggttagtgtgtacagtttaatatgtcatatacacttggtagtggatagcagagagcaagcatgttgggtggagattgatgtagaggagaagggccgctgtcgccaccgctacctcttccttcacgccggtcttctctgccgtcgccactggatttgggctattgtgtgtggctgccgcggtcctcctccacctccgcctccgctgggagagaggggggtcggaggaggagggaagcggccggaggggagggcaacggtggaggaggcgatgccgcaaccgctccatcgatgccggtaaccacctcacagcagactaacagagatgaggaggagggggagaagaatggggggaggcggatctagaggaggagggggagaataatggaggaggaggacaaggagtgtagtaccgagagagaggatgtcggatggataaggagtggagtatgggcgctggtttgatcggtttgcctcagctcgagtgctggttttcctacaataaactatagtgccgatttatatgcagatccggcacctataatataagtataggtccctttttttaaaaaaaactagcacctatactataggtgccggtttttatggtaataggtatccattttaaataaaccgacacctatgagccaatacctattaggtgttttgtagtaatggtcacactcacatatgtccaggatacctgatggtagtccgaggaattaggtgcccacactactacaaaataccagggaggcggcactattgactccaagtgattggtgctggtttcaaaatcagcacctttgaggtgttcgcgagccaaaaaaaaaaggctcgatacatcggctcgaatcgagctggtgcatcgagcgcatccaccccctgcgttgcccccaaaatctcaaatccacagcatcaacgaatcaaccaatatcatcacaatgaaccaaccaacatcatcacagaaattatagactataaactcccgaatcaaccaacatcaataacagacatcacacgacaaacattgaaagaacaatgaactccaccgctgctcaccatcgccatctaccagacccgccaccgctgccaccattgccccgaggatactccgccgccgggctaccaccgcctcccctcccacagtcggaccaccgggaagtaggggctgtcgcatccgggaagtaggggtctctgcctccatgccgtccacggccaccgcgcctcccctcccgccagatctggcggaggggagggcgtcgctgcccctcccacccctgccgagccggtgccgccgccgtcgctgccctttctcccgccgtacgccactattccagccgctgcgagcgagatagagaggggagagagagcgaataaaatgagaggggagagagagcggagagaacgagagagatcgagaggatacgagagagttcgaatgaccttatctcctcgatgctagtggtggggcctgttggctcggctcaattcgtaggtgccgtacctatctatctatctatctatctatctatccctctatacctctatacctatactaattgggcactttctacgagcttccacgttaaccggagaaatctaaccgttgatttaatcagttttattatcatggccgtacatacaaaatctaacgtggcgggctaatttgccttctaatttcatgggctctttcagcccatctattttttctctacaacagatcagcagtaatcgagagagatacagatcgacctcatctctctgatagaaattaacgatagagaggtgggagagaggactagcaaccacgggatgatacccaatgtgattggtgatgatttgcaatctcaaatcctctctaactcgggtactattttacctcaaccttgaacagattgatttttcattgatttggattgacactcatctgaaacgtcatcatccaacccaataaatttcaggagtccagatgccgatccaaaaaatcgagtacatatgccaccgttccccaattcacacaggtaatgtcgaacttgcatcttctatgcgatctcctcagccatctatttaaaactttcttgattttttatttgtttggacttttgagtgatgaattactggccgatagtttccctatttaatgagttgttcggtgttcgatgaacgtacatgttgcaacctatttaagaaattagcgatgactaattttgactgaaataatgaaatagctgttgatgagctgtgctaatgatccggtaatcagatcagtcgacagatcatagacccttatctatgacttttctctaaatctaaatacaaactagcaaatataatatttataattttccaatttactgtatgtatgtccgtatgcactacatatagtctgcagcttaccttttcttttaccaatgacatggttcaagctgttgacaatgcgaaggaagcatccaaagtcaaggtcaggataatcagactttgggatggcctaaatcccaacagacatgatagttattaataaaggtcggaataaatattcccctcgcaaataatattggtatttatgggtattcccagagagctctcacatttactataaacgttaactaaaagatctgtagttcattaggtcgatcgtattaccatgacttgatcaatcaagaatttgtgttaaaaccaatattagttgcgcacttcagggacgctcgcacattaggaagaaagatcttaacacccactagaacggataccctcatctcaatcaggcggtaagccccatctcaatcgggcacagcgtccgtcacaggctagaagtcactgatgtgaagagttatctcaatcgggcaaacggccgtcacgaatgaatatatctcaatcgggccctaagtaaagcccgtcaccgatagctttgatccagacgaccagtcaaactatagcccgtcacagatgacctatctctatcgggccacaactagcgcccgtcacagatgactactaacctttattgggcctaaactagagcccgtcacagatgattctcatctcaatcgggcctaaactatagcccgtcaaagatgactgatgacctcaatcagacctaaactagagcccgtcacagatgactgctgacctcaatcgggcctaagctaaagcccgtcacagatgatctcatctcaatcgggcatttagttatggctcgtcacagatgactataatccacaaaaaaaataaaatttgttttttggctagcctcaggcctttgctagccatgcccgctgcaaaaatgacagaaacaaacacagatatccaatatccccagctccccagcatcacccattcatacatatgcattcacatacacagacatcaacatatttcacacaaccacacattcacagccatatcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattgttcatcgttttagtttaagcctaaacattcctttggggttaattatttcgcggaggatgaagctggctatctcctcgcgaacctcctcaaagctggtagtcagagacttggttattgtgccctacatagtcataattccagattagttgatcgatcatatataagtactaaaatgtagttagtctatcacaattgagaccaccgacctcaaactcagccaaagtcttcaccttttctctatacagaagtcgcatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattggggtccattcatatgcgttcttatcaattctggagttcaggtaatgacatgtactccatttaggtgttatgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcgtagatgtagttgaccattccttgacggtcattctggagatttgtgacagtgaccacttgtggatcaaggaaggcaacttccggtgcatgcttctgacaccattgccaacttaacctacacacaggatcaacgatcttgtaagcaagttaaaccgattgttattaacagaatgagttgggcgacaatacttacaaggagtagcacttaaggaggcttgtgtccaccactcggagcctgtagaggtcgaaaagatcgttgaagtcgaccacgatataatttgttggatcaaggaatggctttccatcgtgctgtccaaggatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggcctgcacctttcctccccttcctctcccctttgcttcgggtttatcgagagtaattctctgaggggaggagtgtgccttcctgctcttcttcatcggtgggggttcatgaatcgccttgctgtcggcctccgttcggtcctccccaaaatccgtgtcatactgcaactgcaaatcgtaagattgtgcatgacgatcttgagcaggaggggctgaaggagcagaggcgggtctctttggtggacgaccgcctggtgcagtggttggcctcgctgtaaccctgatctcaatgaggtccttgggccattggatgaaggtaccacgggcatttcctagtgagaggacctcgtcgttcgatggatacttcagagggaacagcttgtatccgggcttcaccgagtcgacttgaacttttgcacagtcggccctgagttgcgctccatgcactcttgtctctggggtcggcttgtacgcaagtccctcggctgctagaacagtgaaggtcggcattaccctaactgtgagggtgcagctcgttggttcctgcgatagattaatcaatttttttagaatattatatatcatatggattcgttacgtctttcatgtattgagtaagttcacggttaccgttatgtggtcgacggcgctgtcgaccaatgttggattttccgccaactcagttgatgcgcaactgctacgtttttcggtgggacttcctaactctttgtgcgcagcagcagcggcggcctgggggatctgttgctcttctcggatctcttgcctaatcttggccctcatcgactcgagcttttcgtcgaattcagatgtcagctcagctcgtatcgactcccggatcttggcttcaaggcgtgcatctttctccgccttgttggaagtccgcttcttgtactgccacgcgtagtctggaaatccataattccagggaacagaagacccaacgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgattagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccggcggtaccaagccggtgcggatgctggttcctggtctggagcaagcgatatgcctcgcttctagctctggactcgggggtcgacttcttcgcatggaattctgactagacctgttccgtgatccaaggaaatttttctcttggatctggatttgccgggttgtagacgaactcgccgactagcttagtcttgaagttcttccaagcagtgcccataaccttgaaagcagcccgcctgagacggtcctcatgctctgcaggataatcaaagctctccttgaacgttagccaagcaatgtccttctctgtggccggcatgagcttgaagtcgtcttgcagaatactgaatttctgcctccctatgaccccgcagatagacctaaattggctcaatattttccttggagatgtcggcaaccctacggcgtccaccgctgttatgcggaaccgttccttaggaattttgttccttgtcctaggagtacgttcccttgaggacccactagttgtcgttgacattggttcgccttgctaagacattgtctacttttttccaaaaaaacaaaaaaaacacaattgagtgctacaatctattacaatgaattgaatgtcacttataaaaataaatgaaacatataaataaactaaattgcgcatatcacaatgatagaatgaattgaatggcacatataaataaattaaacatatcatcaaatcctaaaatcataaattcacctcataccatctattcatccacatatcatgcatctatcactaaattgattaatgcaccacattccatctattcatcatcatgtcatcaatcaaaaaaatcattcgtttaccatatatcatcaatccctaaaatcatctatcagtaaaatcatctatcactaaattcattaatgaaccacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctatcactaaattcatcccaacatccacatttcatcccaacatccacattttcattatcaaccacatgcaagtagcagagggaggcgcgttggaggactcacatgaggtcggtcgggggggctcggtggtggcggcggcgggctcggtggagggcgtcgccggtcggtggaggcggcggctggctcggtgcaggcggcgggctcggcgaaggaggagttcacggcggcggcgccggtcggtgtagatgccggtcggggaggtcggcatcgggccgacgtcgccggcctcggtgggggctgctgttcgtgtcggtgaagaggcaggcggcgacgacgaggaaggccgacgccggtcggtgtagagactcggtggcggcggcggcgggctcggtggaggcggcgggctcggtggcggtggcggcgggctcggtggaggcggcgggctcggtggcggtggcggcgggctcagtggaggcggcgggctcggcggcggtggtggcggtctcggtggcggtggcggcgagggaggacgacggcggcgaaggaggagttggcggcggcgctagggttctaaggaggcgggaaactgtagcgggacttagaaaaattttcgattcgatctgagaaaccctagttatattagagtgatgagtcatctcaatcgggctttgccgtagagcccgtcacagatgactcatcggtgacgggctccatactaatgcccgattgagatgacattcaggcccgtcacggatgactcatctgtgacgggccctaagataatgcccgatagagatagattaatctctatcgggcttgaactaaggcctgtcaccgatgactatttttccatttcccagataagtctttatatttgtgagtacaaaatatatagctactgtataataattcattttattagtcataacacatttttggatagtaaatgatttcaaatcgaaatatggtcaacaacaaaattgatcttctcatcaagatctacaacttttattttggtcatttatctatataactttgtttctaacaacttgaaattgattttgacaatatgacaaatgtaaacaacatttgtaaatattacatgactttaaatgggaaagccataaacagctaacttgtacagctaatcaagatctacaacttttattttggtcacttcttcatccgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagattttgatgagaggatcaactttgttgttgaccatatttccatttgaaatcatttagtatttactcatgtcaccgaaaggattcatgccatccgtacaaagacatatcctcacgtttctagggtcggcagcaaagtctttgtgttttcgatctatattcctccattcaatcgaatccgctgggtgtctaagcataccatcattccttctttccatggcgtgccaacgtactaacttcgcttcgttcgggttggcaaagattctcttgaaacgatcaatgataggtagataccacacaacctttgccggaccacccctctttgacttatttcctttgtgagcacttttctttcgcttgtatcgagaagcattgcagacaggacaagcatccaagtccgcatattgcttgtggtacaatatgcatatgcagttgttgggacaagcgtgaattctacggacctctaaccccagtggacacagaacctgctttgctccgtatgtcatctcgggcaatgtgttctcaacaggaagcatagccttcaaaattcctaaaagatctgtgaaactcttgtctgtccatccactacttgccttaagcttcattaggtccaaggtaactgacaacttagtgtgttttgctttgcatccagcgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatgtcatgctcattttcatcttcctgattatgcgcaccacttctgtttgctgctgctccacttcctgattcttgctctccatgcttcacccaacatgtatagccctccatgaatcctcgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaacaaattagaggcacatattataagatcagtattgcaaaagtaagacatgatgaaattgctcaattaatgatttatattactgacttgattgatccattttgatcacttttgggaatttaatttctgttttccttggaaaaaggacaaaaaatcgccccctacagcctcccaccaaaatagtgaacagtgggatatagttacactaggtggtgggggtatttatactgtgcaacaaatatttgtaacggccctaaaacaatcaaccgtgacgggcatacaagtaatctctatcgggccttaataaaaggccgtcaaaaaatagtgtcatctgtgacgggcaataaacttatctcaatcgggcctctagttggagcccgtcacagatgaccctcatctgtgacgggcttcttttagggcccgattgagatatggaaccctcatctcaatcgggcctcaactatagcccgtcacatataagtgtcatccgtgacgggctttagttttatgccgatataccatggctgtgcgaccatatctcaattgggcaaaacttcggcccgattgagattacttccttgtgacggcccgcaaattccagtcttgttatgggccgtcacagatggaaggatatgtactagtgaccattgattaggtggtttacattgctatgatattcgatctatatgaattcgtgtagattaaaatatggcccggaaagtaacatggactctttagttttattttttttaaaattaataattctgaaatcagacatcataaaagacagggtttgctctcaatttagaaatttgttaatttaattgcattttttaaattcataattagcaagttgtaacttatgtgaactccaaaccatgtacaactaaaatgtattatttactatttttagaattattaaatcataaaagttataattgatacttcaaaaatgtattatttctaaatttacaaatgattaaatcacgaacaatctataaccgtgggtctggacagagtacaattttatatattatttaagaaattattaaatcatattttttttagagttgaaaatataaatcatgtactttacaagactccaacttgaaaacgtgtaacattcagcaaaatctgatgaccaacatattcataacttgattatatttttaatatttatattattaataactatagcccgtgcatcgcacgggttagcgtctagtacctataataaataggtgcaagtttttaatattaaaggtttcgttttaaataaaaacaacacaaaatacaatggatgtcggtttttatttagaatcgacacatataattacttcaaggtgccaattttttacgatttcaacccgcggaggtgggaaaaggcctataggtgccagttttagcacttatgacacctatttgatgttttgtagtagtgccatatgaggcgaggggaatggggcacatgtggatgacaaaaaagtacactaaccctaagcagtggcagttttcgcaatgtatcagttatccgttttttatcttgtccgtctccatgaaattagcactataatcagttgatgggtcaataggttggaaaacatagctgtttagcttataattgcaggtgcaaaacttgaaaatatattcctattattgactgtgtacataggagaccggaaagtacaaggtttacttggactgctatttgtatagcaagataattgttgtacatagtactcttattttactataaaatatcactatgtgttaccaaatcaactggtgcttcggcgcttccttgtagttgttgtagatccattcttgtcatgaaataaagctgtagcagaagatacatacttagtataaggtgatattcgtgattcccacgttgctatttcaaaatcaccacctgaaattgccaccgatctagctattacctctttgaacgatatacttggtttcttatagtttggaatatcatccctttctactcgaggtggctttacaagaatgcaggcgtgagtaggataagatgtcataaattcggtgctatctactggctgctctttctcaatgatatctttcggatgctcaccatatttcaaaaagttgttcttcaccatcctctcgaagcgtcgcaatattctaagccagaagtgaacattatggttccttctaagcatgtcagatatcatattggctgttatcaatgatccacccaatactactgcaagatcatttgcaactgagaccatctttggatggtccttttggtcggtcgctagcatcttgaaaaggtagctgtactcctcctgtgataaactatttagatgaactgcctttgctgttccgaaccttgcaagattttcaatcctacttatgattaccactttgcttcctccagctgtcatctgacttacagtagaatagaagtttacccaatcattttcatctatgtccgtaaaatattcacgaacaatcaatgtcctctccattttgaactttgcatgtgctattgatccgcagctgctatctccattgatgtacaaaatagaagaaaagtatgatctgatccgctcatcattgcagacatggctgatcaaggatttctttcctaccctgcaaccaccaatgattggaagaacaagacgagcaccctggttacctggattttgcaataaaaaattgataatttcctgcttctcgacatgatgagcaaacacacaattatcggtgtaaaggtaagcatcatagggtcggcgacacatgcattcacatctggctaggaatacaacaaactctttcactctacctccatctgaagtatttatgtgttttttgtgcagctctctaaaaagcttgcttcccatctcagaacagccacccttatatataattagctggaaatggttcagagcaaaaccagcagccattttatccacagctgttttcaagggatgagaaaagtgactgcaatttgccaagtttaaagttctctattcaatactattggtcgttgattgctttgaatatctgttccttaattttttaccatcacacactttcttgtatgaaatattaattaactggactatttgaagaaactagtatttttcttgctaacgtacatggctaggtgtgaaaatttctaaagactatgagggaccatttggaccatttatgaaaggaaagcaacaagttgattatgggaagctagaattcgtccacttgataaaccccgagctccacttgaaaatattttaccaaagtgtatgggatgtcatggtatagattgaaccgagaggagaggaagggagtcggactcggtggagatgatagcacgaggtggacactcggccttagtttggaaaggtcccccgtgaaaactagaaacaaatctgcccttcctttttttttctcttcttcctatccgaaacaaacccacggaaatgaaaggtagataagttggagtcccgaagacaagcacttaggtggtctagctgacacgcgtaactatacgataaagtagcaatggctaatgtttaatctaagcaaacccaataaaccctgaaggggtaccaagctatttaaggaggtgggtagatgactaaggggtccctagggtcctgctccacctagttggggcacgccctgcatggccccacttaggccgagatcccagatgaatttacgagttcataggctaaatataggtgacacaacaccttgtttctattattccagcctatgtagttggaatttggagctgagcttggatccgtttgaaagaggactgcaaaagctttccatcaagtactcacggacaaaaaacggagcacgtatgcatatttggtggccgtttgaaatcagcactttagcatgtggccgaattggatttcagaacttggtcagattgatcttgatgcaagcaaaggttatattaaaagtcaccatggtcacatcatcgtatgaaatattaattaaattgactatttgaagaaacgagtactttcttgctaacgcacatggctaggtgtgaaagtttctaaaaactatgagggaccatttatcaaaggaaagcaacaagttgattatgggaagctagaactcgtccacttgataaactttgagctgcactcaagaaatttttaccaaagcttatgagatttcatggtatagattgaaccgacaggagaggaatggagtcggacttggtcgagatgatagcacgaggtggacacttggccttagtttgggaaggtgccacgtcaaaactaaaaacaaacccgcgattggagaactgatctttcactagtggagagttgccctttttttttatttgcatggccctgttgctgcatggtttatatatatatatatatatatatgcaccatggtgcccgggcaccatggcatcaaatacacaaattcaatcaaaattttcaaattgtgagtatatacctagttataagtattcgattcatacctacacctcttaacaaaacaactcaaaatttaactttatttcacaatccaatattacatacctaactaattatatgtttggatgccatatacctagaattaatcaaaatctaacaaaaacatgtttaaactaagttcaaacttgttttgaactagttagaaaagtagttaatgttaatacctaaatatttaaaaaaatttcatactcatttgaattgagtatatactcaatttgaaccatggagctcgggcaccatggagcaccaaacaaatatatatatatatatatatatatatatatatatatatatatatatatatatatatatatatatatatatatatatatatacatatatatatatatatatatatatatatgagttggattttttgcacgcgagttcacatgtacccacaatctacaccctatatgtagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttcctatatatatatatatatatatatatatatagggatgcgctaaaccgcgcctggggtgcgcaataactaaactactcctctcacagcactcctccccacccaccaccccccctggtgcccaggaggctctcccgcacctttttctctccctcaccatttgtccttcagtaaataaattacttgcagttaatatcttcttattagtaaatgaattactaactaatatattgatttttgcattgtaatcccgcaccttttggcatgtccattccaactgcaacccgcacatttctcttgcacacgtagtaaataaattactctctgttaatatcatttattagtaaataaattactcggaatccaactcatttcttctctcagtaaatggattactcccaggttgtagcccttctcagttggttcattctctcagtaaatgaattactgtcgggttggtcttatttattctcttagtaaataaattacttaagataatacaacacttaattggatatcataccttctcgcagtaaataaattacttaaaataacgtattgatatcgtctcaagattttcttagtaaataaattactattacaccaatctcaacataacatattgacattgccaacaaattctcttagtaaccaagttactattacaccgatggttctcaacatatgtctctcagtaactaaattactattacatgcacgaatccaacaagcaagacaacgctagtgcctcatatcgatgttgagccgacaaagcactatagattccttaggtctccccatcgataggtatccatcacccacgaacatctagagaggcatcccacatgcacctggatatagacagaaacgattacatcatctaagagaagtctttaatttacactcataaatgactctaaatgagatatgattcgctgaagaagaaataaaatgcttcataaaaaattgagcagcaggaagagagaatatgtgcaaaatgcagcctccatctgaagaacataaatcgagtagaataaattttagaactgatgagtctatactgctttatttacaggaatacactccattagactgatcatagatttcagatgttcacatgcatgttaaattaagaaccaaaattctaattgacacattatcagttcgccaagataaatccagaaaaagtgtgcaaagtgtacgacatgaaacatttagagcgtccaagtcaaatgaaccaaggatcctatatcttcagagatcacccggatatcattgaggtcaagagaaaagttcaatttggcagtcagtaaagatctgtttctagggaacatattattatgcataaaaatgatactaatcaaatagactcgtcctaaatttttcacgataccaatgcccaaataagctaaaatgatatggaaattattcatggatgaaaactcccttggtgtccttgatccgcacctgcggaactagtgaaggacatgccatgtgcacatgagcaattagaacaacaatctcaatcctctgaatatgaaaaaaaaaagcatacttaggcaacaaaaattattgtgtgcccagtagcaaaacacctgcaccaagaacagggatttgtgccaatagactgaacaataaaggtctcaatgtacatcgttgtcagtataatcctcatctgcattgatgctgcatccggattctcactctgcccctgcgaaaaaaagacatatcttgtcttttcatgtctagttataaacactaaactaaaacctgggaaaattgcaaccataaagcatagaagattgaatcgagaagaaaaaccaccatgaatctgaacaacgtggggaaaaaaggcctgatcaccgatcatgcaaacatgaaaaaacaaaaacgaaaaaaagagaaagggaatagatcagattggcatggcagcaccaaagacactattcctttcatgggggatgcagacttcaatcacgcagacgagttcggggttgttgatggtgtcgcttgtgaaggaacgcagatggcgccggccctcctcctcctttgcccgcaccaacaacttatgcaaatccaatccaaatgttgctactacacctcctcagcgtcctccacgggcggcggacgagggcagcgggcgtgggcgatggtggcgatctggaggccgcctgcggacaaaggcggaacggcggccgccgacgaggacgaaggatgttggctcctccgtatagctcgccaacgtggagcagatcggcagcggtggaagggaagccggtggagaccatgggcggaagaaaggcaggcgcccttcgtcgtggagcttgcctccagatccaggcggcgtgatggcctctccccggtgctgccttttctcgaatcgccgccggcaacctcctcgttctagatctgaaaaaagcaaaagaaattaacaaaaaaaaatgagtgtattaaatcctatatatataggaggaagtttagtagtaaaagaattactactgtatgggaaaggggaggaggtcgggggtacaggggaggggtggggtgggtaggggtgggttgtgccatctgtagtatagtatgtctatatatatatatatacacatatatatacatacatatatatatacacatatatatatatatatataggttcctactaccaggagtagttactccctccttttaacgggtcaggttagtggaaccatcttgatccaataaccggtagttaggttgtttttttaatttaaacaattaactaaattgtttattagttgaaattatttcttttttgttagttgcatgcaaacgaacttctgcattggaatttctgctacgtgctggtcaacagaagatacatgttagctagctaaactgaatttctgctcgtttggtgcatgcatatatttcccatgtatttaggaacgttaacgtgatgaaaaggcagaaaatatgtgaacgttgacacatttaaaatgcacggtctgtgaaacagaaaaggaacagagcattagttgagaaggaagcagaacattgtttggaaatgcggcagaacatcacttggaaaaaaaaatcccaaaccgaaaatggagcagaatatcgtttggaaatggagcagaacatcgtttggaaaaaaaaatacattctactcttcctagacaaactccatcttctgctcgtcccggcagaaaatgtatctaaactgaaaatggcagaacatcaaatgaaaaaaaaaatccaaggaggaaaataaacctcaactaaaatttggcagaacgtcaactggaaaaattccccaaatatcaagggcagaacctccctgggtaatacgtgattagttacaaacaacaattgcggcatgtgctccgtgatggccgagtccatctgaacttgtaaataggcaatatagttttattagctagtaggaaggacgaaagcttaacaaaaaaaaaaaaggtgcagaatatgttctgctggtgtaactgaatcccatcctcttataggaagctctatggcaagaatacaggcagaaagtttctgcttgggtaactgaatcccgttctcttataggaagctccctggcaagaatacaggcagaaagtttctgctcgggtagaaacaggaacgggaaaggaagcagtatgtgagtatgtgactcagaaaaggagcagaacatcggttagaaaggaagcagaaaaataatttgaacagaagcacaacatcttctgctccttcaacaaaatcgtcactaagcagatgacgttaaaaaaggcagaaaattaaaaaggaatagaagaacatcaattggaaagaagcagaacattatttgtaaacggaacagaacatcaattagaaaggagcagaacattatttggaaacggaacagaacatcaatttgaaagggagcaaaatggtttctgccaatcatagtgtccatgttctgctcctccggcagatgaactaacatgcattcgaaactgtttgtatcccacgaaaatagcggtcggcattctaaacgggttggataacatggctaattaactccgaaatagcagaaatttgcactgccacgtagcaaaccgtacggtggataagctggaagtagttactcccagtagtagcttataatattcatatatatatatatatatatatatatatataggcaacatatcctatgcacacaggccctcacgtgtacacacgtgcacaccaactaaaaaatgtcaccaaaaaatttagaaaaaatcatacacatactttcaattgtattacacctagggttaaaatcttaacatcaaattcattatattttagccgtaacaaaaaaaaaacaaaaaatctgacaattttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcctgtgtgtataggatacgctcccatatatatatatatatatatatatatatatatatatatatatatataaaccatgcatatatatgttccaatacatatacatgcataatatatatgtatttatacatatatgtatgcaaatgcatatgtatatatatattaaagcacttaacattttatgtgcatatatatgaccaaaacatatatttacactaaagtaaatgtgtacatatagaaaaatagacatgtattaattacaattcatcatgtcctagctagctacgacttcgacgtagtagtctttatctcagaagctaacgacctatgaattgtatttccgtcgtagtaaaattcatcctcaggatcaaggacttgttcgttgatgaatcccatgagttgttcttgaaccgccatgataaattccttgtgtgtgaggttatccctcatgcgaataacctatgaatgtatgaaattaattagtaaacaacaaatcgatacgtacgcaatgaaattttgaatttatttgtacgtacatcgagctctcttgtggtgatgatttggtctgcaaggcagtggcaatactcgcacacgtagtagccgcacaagttagttccctgttcttgctttgcgcactatatatacatgacaaacggcgagagatctaattaatatacacttgtatttgaattggagattcaatataaatgtagagcatgtgtactcataggaaatttaaacttccgcttaagtctttctctccaattgccgcggaccaaatgacggaactgataccaagccctaaatggagtttaaagctatgattcgtagtagtaattaattatatcaagattcgtaataacattggaacttatgacattacctgtctataagttaaaaaacctggtcaaacgtagactcttttttatccattgagtcatatacattgactacgcaggcctccaagtcgaagagtaaaaagacccagtggaatctgcaatgtgcgtcggatgtgacatatgaaacacttagcatgtacgtacgggaatgaaatttggtagcaagctggtcagaaagttcattaatcgcaaggacaaaaagataaggcaataaaggacaaccttgacgaatacctccctcgatgagctgaaaagtacccgtacgattgaccatttataacaacagaaaaattagcggagttgatgcaggaaaggacaagacgaacgaaattagcatgaaaccctttacgacaaagagcatccgctatgaatctccattcaatcctgtcaaaagctttagacaagtctatttttaaaagaaaagctttttgattaaaagaggtgagattaaaagagtgagcaatttcctgggcaagcacaatattattagagatgcgtctccccttgacaaaagcctgctgagtgtcacaaataaggttaggaagtttattctgaatgtaattagccaaggacttagcaatgattttataagaaacattacaaaggctaatgggtctaaaatcagcaggggacttaggattagaatttttaggaacaagaacaatattagtagcattcatacctgattgaagcttacctgtttcatagaaggagcctaccatggtagtaacatcgtcttttatccaattccaggcagctctataaaatgcaacattgagaccatctggccctggggaggcatctctttacatttgcttcagaatttccaggatgtcattttcagaagggatttcagggggaggaaaaattacatcattgtcattttgatccttagaaggagtggcatcatctgtattggagctttgaaagagattttcaaagtaagaagtgaagacagttgctatctcatcaggatcattgattattgaattattatggataacactagagattctgttctttctccttctcttctgggttgctttttgaaagaaagaagtgtttctgtcacctttctggacccaatgcttcttacttctctgtttgtgataatcggccagcttctgcatggtaatatcatgctgttgcacaatccttttctcctcaaagtacaaatgttctctgtcgggggaactctgaattttcaacagatcttcttccaactgatccaattgctgctgaagaggtttcttctttttgctccaagaagttaaggatattgctaacaaaggttgttcttctctgaaaatgacagtttacagactgcagccaggctgaatgagcatgctgattaaaatctggttcaagcagccaccaattttcaaacatgaaagatcttttaggcctcctgttcttcggattgagaatggcaatgatgggagcatgatcaccatacaacatgggcaagtgataaacagtggtatttggataattaaaacaccattccacatttgcaagacatctgtccaacctttccaaaaccagatccttaccctgttgcttattggaccaagtgtaagctggaccattataacccatatccataagccccagattattgacatgatgcttaaaaatattaatacgattctgattaggaggggccaaaccatacttttcattagcatgcatgatctcattaaggtctcccatacaaaaggtcggtctgtgactactatgtacaacaaaagaggagatttcactccacatggcactagtggccctgtgactagggatcaccataaatacaaagaagattgaaaataggaccagagttcttatagactccataagctaaaatataattaacactagactgaactatagtaagatccatgtcttcatcccacatcagccacaaaccaccagaagcttgatcagcaggaaccacatgactattagctacatgaaaatgatggatcagatcagaagcagtaactttagagctttttgtttctgaaataaagattaccttagcattagtagagtatattaggcgttggaggtgttgcattttcctactgccgaggtgacccccccatacctcggcagttccagcttaaaagactcatggcgcccttgatgccttatgggctggcgccattgcccatccatcattctttccacttccatctccaccatttccagcactgggatcaacaagctgaatctctgaaacattgcattccctaggatctatagccagtatcagtctggagctagctccagcatcacttgcaccacccccttgagtatctccagcagcttgatcaacaaagatatcatgatgcgcctccaaagcactccaagtatgcttcctgctatgaatattgttaatgctttgaggggatcttggagcatctctttgaaagacatcagaatgagcagcagcaagaggtctccaagaagtggaggtcaccattcaaccaccataacctcctctctgatcccatcttgtaactctctgcccacctcttctacttggaaccctgattggtgctgaatgatggttagttggaggagctcttcttgattcaatccctccatgttcttcacctcccacaatcgagaaggaagaggcagctgaagtagttggggagcaatggcgtttggtagattcatgggctgcttcatgaaaccctctcttcttacttaaatgttgtgaggctgtctcataaatcttggtagctcttgtgcttcttctgtgttgcacttcgttggtgccaatagcagggtccatcagaggcatttttggatatggaggaatccaacaaaaattcaattgtggaaaaattcaggcaacatttttcttctcctcaattcaagaacattcaagaacagcagaagcagcaagagagaggaagtgggaccagccagtcattaatgcccaagctagattggaaaaaagcgagtgagaaagctttgactttagctggctgcagcactgttcaagggcccccaagtcaagctgttcacactaccacagcaagcaaacaatgtgagaaaaaagacaaagaacctaatatgcaaagtacaccagaagttggtaccgaagagatgttggtacatggaagtacagtgaaaaagaagctggtttctagtactatagaggatcatgtcagctgcaactcaaagaatgtcaatactgttggtaaggtgcatcagatggaaccaatccagtctgttcctttggttcaccgagtttcacctagtgcaagtgcccatcagaacagatttttgacttagtgatatatatgaatacaagtatgcatcatttgatccttac

SEQ ID NO: 61745 - DNA, 20635 bp, Oryza sativa
  unsure (1)..(20635): unsure at all n locations
atttccaatataaaacaaatatattataaaaatatattccgtgttatatttaatgaaactaatttggttttgtagatgttgctaatttttttataaacttagtcaaacctatagaagtttgactaagaaaaaaacaaatcaacttataatatgaaacagagggagtataagataaatggatatattttcctttactaaaatctgtaaaaaaaaatgaaaatagttctcctttagttcatatagtttcttgttattaggctgattgctacgggtcatggaggaggcaatccgctctggccatacatcaccttcccatgggcacgattgcagccaagattctgccgtgggaagcgccatctcgtgagaccctactgaggacaatcaatgctgctctcgatgacggcaatgtcgacgacgtgctgcaagcatttgccaattacaagaccctgcatggccttcctgagccgcgggtgttggacaggatgatcgtgtcgctgtcctatgcgtctagcaggagatggcttcagagggcattcgacatggtcttgtcagtttaccaatgcaatggcaaccttcttaattgtggctcgctgatgaagctagctctggcgcttgccagagatcagatgccgattccagcctccacagtggtgaggatcatattggagagcggcaagcttcctgatgttgatatgctgaccatggtgtacttgcatatggtgaagtcacaagtaggatcctatcttgctgctgatgttttgtgtgagacctgcgagtgtttcttggagcagattggagatagaaggcagctgaaaaaactggatccaataaagagtaatgttaccttgtttaatatggttttgaagtcatgtgtcgatttcaaatgcatgatcaaggcccaaagaataatggagcttatgtcgctggttggggttgtggccgatgtaaatacagtggctatcgctagccttgtctttgagatggttgggcagcaagttgaattggtgaacatgaaaagaagtatcgattcttttgcatctttgccgttcattcagcactatctatatttttatggaagtctgctgaacctgcatttcaaatataatgacatggatgccgctgctcagcttttggttgatctgtatcgacaacaaaagcctcgtgcttttgttggtgatagtgtccataaacaaggtgtaatacagataggctctggcaacctgaaaactggattcagaataatgtttgaccccataaaagtggacaaaggtttcgttttagatacagaaagtcaatttggccttcttgctgttattgatggaaatattcgtcctagtgagaaggctcttgctaaattcattgttggctgtttgaaagcaagtaaagtgcgtgcattgtctagctttcttattacattacacaaggaagatctaaaggggccatctcattcagatgtaattagtgcatgcattctgatgggatggttgcatgctgctcatgatatcctggatgatttagagtcagctgagattcctgttctaatctgtacttacatgtctcttttgagagcatatgagaaggagaataaaccggaagaagttaataggtttctccaacagatacaaaagaaagcatatacaatggctgattttcataccaatccatcctttaccataaaggatgttgccaaaatagtcaaggatgagatgcccctcagaaattcgtctttgctttccagtttggttcaagaaatagaacattatagctctcgagagcacttaacttttgagttcaataattcaattcttttcttctgcaaggcaaatatgatggacgatgctttgagcacatataagcggatgagagagcagaatgtaagacccagtctgcataccttttgccacatactgtgtggatattcttcactaggcatgcatagggagattgccatgctgtggggagaaataaagcgcagactcgaatatggagagctaactgtggatagagacttgcttgactgcttgattttgaatttcctaaacgctggctattttgcaagagtcatggaggttttaagttacatggcaaaccgtaaaatgtactgtgacaagtggaaatacaagcaagtttttctaaagctacacaagaatctgtatagaaatttgaatttgctgcatgaaaaaacagaacaacagagtaaaagaatagaagatgtcagagctttcagatcctgggcaggcgtcaaataggtaaaatgactgcagcactgtaatccttttgcatttagagaacactcttcttgtgcatgcacatctgtacagaattcttccgatgtaacatcatccgcatctgttgtataattctgtattgtcctttcaagtctttccatttattcttgatggttagttccaattccttagtactcactgtaacatcttacatgcatggattttttttttctttgacctctaaatccactttcaaggcttctaaatcaactttcaaggcttcaactatcgatttttttttatataaatggcccgtcttttctttcatctgttttggcatggatcatgaatctcatagcagcacatatttcctcttcaggttccaggtggttgctaattcttacatttaaatatgttgaccattgataatcttattgataattttattgtagtactggccttgtggcaatcttagactactgtcttaccaacagtaatgtttctttcttgtgatattctacaaagaggctatgctgatacagaagatcatgctgttgcttcaagttgtcaagtaattatttttgtgggaaaccgactccttgaccttacgtcacaagcaagatcaattgcatagaccacaaatggtatttattattttgaaacagttgtacactttgacatctctgacaatcatttattaccgatttcaagtttttaatgaaactgatgaacttgtaggcctgatgggagtttgatagagcacttgcagtccagaccttactggctactaaggtttgccatcactaataccagaattgtccagtactaccatgtggggtacacaacttgaacagtaactttttttagaggaacttgaacagtaacttggcatgcttaactagttgctgtggttctagaggacacagttatgaagttgaggcagatattctaattgtgatattctttttaatatagtcatatgacataagtcctggaaactctctatttcctaaatatgtgcagataatagagcaaaaacaggaaaaatgtttcaataacacagttgatgttcgtgcttaatgattccaacttttacctaaaaacgctcacatgttgaaggatgccatattgctatgaatactaattttaggaagtttttccttttagttgagcatagctgtccatcagctgctcaattacaagaaatattttacttctaatagtttttaggctttaagcatatattgcatttgactttgcacgttaaaaactgatgctaagtttccacatatcaatttctttactgttggtgtgttcattatttgattcggtgcctctttggaagcacgggtaattggtttggcttctttcttaactttagggctgacatcattgttggggatttctgcaggtgctgtgtttataaaacccaaaggatagttggattgatcagttggttctttgtaattttagttaaatgcaggactatggctatgtcacagtatttatctagtaccaggttgatgtaagcaggtgcattctgtagatcgtgtctttccgaaatacctagcttggttgctcttatgctaaatataatcaattatgatgtgtctatgctttctgggtgcactatcattttgccatgaacttgtgattgttcccatccaaaacgtggctatttgtgtagtctggttcagaaagaatgcgatcatcctcattgcaaacctctgctttgtattataacccataaataaattaaaaaaatatatttctttaccggaaaaaatgagaaaatgtttaaggaagaaatgagtttttttttttaatttagaagaggagaagaatggaacggtggcatgttttccgatgtaatttttgtaaaatatttttatatatgaacttcctagaataccattttaaatccatttttcgagttgataatagataattcatttgtttgtatcctctaataattgtcaaaacgcttcgtccattaagcatgaaaaaaagtagccatttaacatataagaactatgtgtgctgtggattatctacttgattatatggataaattaaacattttaataaataactttaacaaggtgttctaagcaatccaataaaaattctttttttagaaagcatattcttagaaacgcggagtaaataatccattttaaaaaatccaataaacaatatgaataagttcacttgagacccttaacttgttaacgaatctgattttcacctttcaaccggaaaccatatacccggtgcaacataggtcccataatggtttgaacggtggttttagctggcatggctagtttgacttgatctttatcccatatagcatccacgtgacgtttaaagtggcaatttgatatggaaatgtgttctcattcgctcctttctctctctctttccacatgatgaagagatgacagaggaggaagaagaacgaccgggagagagaagaggagggagtgagaatgacacgtgggcctcaccatttttaattattatttttattatagctgacatatgggtccacggtttttattatttcccagatcaaattgtcatggcaatgccacgtagaataaagaccgagtcaaactagccatgtaagcgacatggcagcgaaaaccaccgtccaaaccgccatgggacctatattgcgccggttttgacagttgtgggatccgttatatctatttttttggttgaaggaccaaaatcggattcgttgatcagttaagggacctcaagtgaacttattcctaaatgatatgaaaagaaggcaggcgacctagcctaaatatagaaacggcccagcccaaactcgcctccactcccactgacccacactcctcacctcacctcgccctccaaatcgcccacacccctggaaccccattccacccacccacgcgcagccgcagcgacgagaggagaaacgagagagagaaaaagaagaaagagaaaaatgctgcgccacgccgcccgccgcctggccaccacccgcgccgccgccgccgccggccgcagcagcagggcgctctcgacggcggaggtgccggccgaggcggccaccgactccgccttcgcggaggcgtggaagaaggtggcccccaacatcgaggcccccgccacgcccatgtcgctcatgcagccccgcccccccacgccggcggccatcccctccaagctcaccgtcaacttcgtcctcccctacaagtccgagatcgccaacaaggaggtacgcgcggaccgtgtttgcccccccccccctccccctctcctctgtcctcctcggtccccagatctgtgcgtgtggcgtcgctagggtttcgggtatgtgcgcgatctggggtttgcgtcgtgcgattagggataggggttgggtgggtcaaggcagcgcgatccgattcgtcgagctggtgtggtagaggtctcgcatccagactcttcatccgtaggaatatatcatggtcaatgcttctatcctccgtttatcgtttgcccagaatgtttgtgatgtggccatttgttgggcgtgcgtatttgcaatcctattaacacgaatgtgtggcggtttacggttgtacatggctgttgaatcataccaggtatttccttgttttgttgctatgagttggagatgttctttcatgggacaaacataacgtagcgtgattctccaggtggctagatgtcatatgactatagaatttctgctcaacatttgattgctgttgagtgttggtagcaaattgcatttcttttttcttgtttggggtgcttgtgtgccttaattgcaaggagcatagagaattcataaattgatatttcctcgccttaaaagactgtgtttttagttagctatgaacctggctaaattcgtgattcatacaaccaaccaaacaaaatcttcaataaacacggtccgctccttggggacagaggtagtagtagtctagtgaagtatcttttggaaaccccgttacattttgttaatcagattgaggattccaggtcgctccttgggtgtttcttatttatagatttcaagtttctcttgctaggattgctgtgtgccaggccaagttttaattctgactacaacagtgtattcagacctgtttatctctagtgtttgtagtgctatgcggctttatgcattgtctggatttatcggtatagttgcagtttctcttgtttacattaactagagtttgtgtctgaacattcactgtcaatgttcctgatgtaaatttctttggttgagaaaatctttccttctgaagttctataaataaaactgcatattaatatagcctactattcacttatattttactatgctgcataggcagcttcttttttgactgtgcgccaattatagcttttgtccttgatatatgttatttgccctgtgataaccaagtctaatactacttgtttagttttgtggtgattttctttgtttcatgttgtttcctttagcttgcttgttggccttgatggtttggtactgtttacttaatggttaatggcactattaagaagtttcagatcatcaatttttccttaagtatgttgctgagcgtcatgttcttttgttgctattgtgtatgaaatataattggttgatggtgttcgaaggttgtctatgtttgtgttgttgcatttcaacagatgataggcaaattatctatcagttgattcacatagattttgtatgtcaatgcttgattcaacaatactactgttaatgtaccaattaattcttcccccatcatcaatattgtcttctgttgcttctttcccttgcttatgtctttgcttgtctatactcaggttgacatggtaattgtaccagcaacaactggtcagatgggtgttttgccaggccacgtttccacaatcgcagagctcaagcctggtgttctctcggtacacgagggaaacgatatcaccaagtactttgtgagcagtggctttgcatttgtccatgcaaactccatcgctgatatcgtggctgttgaggctgtccccctggaccagatcgacccagccgcggtccagcagggtctcgcggaattcaacgccaagcttggatcggcctcaactgaactggagaaggccgaagctcagattggagtggatgttcacagtgcgctcaatgccgctttggctggttgatcaatacgtttttaagttgctgtccctctctctcttttgcatcttcatttttagaatgtgagctgaagtttgcaaactcatggatgatgggatggagggaatgatcttaaataaattatactccatctcaaagacagaaccctgtttcttcttttaacttgactcctgcatggatttttgtaatagtgaatatttttctccgagcctacaaagtcgaagttttctggttccagttttccatcctgagtttacgcttggatcaaatgacaaaacacaaaagccgttctgtttctagcttctgatgaattctcttatgtggagagtgtagtcgtcaagattaaaatccacttttggtacggtacacatcctgtgttcaaactatgtggtgatgttaagaaatcagaaattgctgctgtttttcaaatgaagaatatcccaatgccgtacttaagagaaaccaaaacacttattttttgaaaaaaaaatgatatgcacagcacaggcttgcaatggtagtagaacaggcgagagcaagtcatcgaaacaaaatcaggtcgtaattatcccaaaaattagtactctttccatttcatttcgtattataaattgtttgattttttttctagttaaactttatttagtttgaccaagttataaaaatatttttttatctaatatatcaaattagtttcattaaatctaatattgaatatattttgataatatgtttgttttgtaaatactactatattttttttataaattgatcaaatttaaagaaatttaacaaaagaaaatcaaataacttatcctccctccgtttcacatcaatatgaacgtgagaaattctagcacatcaatatgaatgtgaaaaatgttagaatgatttacattgtgaaacggaggaagtaatatagaataggaggagtagattacatgatagaatagtagtgcgtttgaactttgaacacagggaggtctcaagtctcaccatgctgcgtgcctgcgttgcatgtagctgctgccttcgtcatcttcatgtgcaccagcctccgcgccgccggcgccgcgctcgcgccagccgccagcttggccaggtgcgccattcgccgccgcttcgccgtcgctgccttcttcgcctccggggaggaggaaccggagccggcgtggcagcgaggaggcgggggcgatccctcctccggcggctcggggggaccatccagctcgccgtgccgcgccgcgcgctccagggcccgcgccgcctccgccatggacgggcgctccccggcgcggtcggcgaggcacctccacgcgagcgccgcgacgtcctgcgcggcgcggtgcgagtacctccccgcgagtcgcgggtcggggagcctcgagaaccaccgggtgcccgcggggtggcggcgcgcccagtcgacgagcttctggtcggggcgtggccggctccggtcgaaggcgcggtggccggtgaggagctcgagcagcacgacgccgaagctccagacgtcgctcctcgccgtgaggcggcccgtctccacgtagtccggcgccgcgtacccgtacgtgcccatcacctgtttgattttatgcccgtttcatacacatcacacgttgttgttgattgttcatgcttgcattgctcagattaatacataataatcctattattcctgtcctacttcgcactaaaattgatttctaatgtaccaatcttttgataaccataacacccaatgttaaaattgtacttcctccgtttcacaatgtaagtcattctagcatttcccacatttatattgatgttgatgaatctagatagatgtatatgtctagattcattaacatcactatgaatatgagaaatgctagaatgacttacattatgaaacggagggagtagccattagtctccgatcgaattttattttattttttttgcaaaagtttagccattagtttgaactttgaactaaattggaccgccaactctcagatcttaaatttctaggggttgcattggttagcttatttttgttgaaagggtggaagtttcgcattcgttgaactgcatgaatctttttgtgaaaacacatctctccaggtgaaaacagattatatgtcaggacaaatgcctgaaacgatggtttggccgcctaccaaactttctagaccgttttgatgcccgattcgaaccaaccatgaaattattcaagaaaatactgtaattctacttttttttttgtgcagattgaatgcaagtagttcttaaggtaaatggtaaccatcttgctagtactgatgacaaatgacttaccgctgtggacacgtgagtttgtccatccactgggccctcccttgctaatccaaaatctgaaagttttggtctgaattcctcatctaacagcacgtttgatgattttaagtcgcgatatatgacctgtaacataaagagtgtcataactacaagtctacaactctacaacatgtgaacacaagcatcaatagttcagaatataaacactggaaaactctgttaatttgcgctaacaagtatagaattatagatcagaaagccttctgaatcatagctcctgatacatatccctatgagactatcattgcaaaactggaacaactgggagttgtcacttaactctgagcacttgggttttgagatagcattaatgggaaacagctgtattatttgtttactaatgtaacatagctctagagccctaagcttctaataacaactaatagtaaggattaaagaaaacagcagaaaaagcagaagaaaagaggaggaaaaaaagagcactgctatttacattgttctctgaacttgtaactgacaatactcaatatatcgattatcgaagttgttagaccaatacctgaatttccaacccttcatgcaagtactgcagccccttagcaacgcccaaggctatgctaagccttgttttccatggaagtgttgggtatgctttattgaacaagtgatattttaaggtcttgttaggcataaactcatacaaaagggnttttggggggaaatttttaattttttttcttaaagggggngggnttttccccctttttntttttggttttttttttaaaagggggggggcccccccaaatttttaaaaaaaaaaaaaccccccttttnccccccacacaagaagtctctgaggaccttgttcgccgtcgtcagtcccgcagtagccaatgagtttgacaagatttgggtgatccacaacagcaaggaactgaacttcagccagccactgcttatgaccctgaaagtgatgtaattgaggaataaatcaactttttgaattgatggtcatactggaagaattgtagaagtataaataacatttaaacaaatttaatggaagaatttgttttttcagattgctactccaagtgcatgattcctcaaaatgttgtaattactgcattctagatgttaaaacttacaagccatggggggttcattttccttttttgcatataagacacaagaaattcgtgaggcataattttctataacatgcagctataatttgacagttatatatttgctgagtattatgcatgggaaatgcaaaatatgaactaaaaatgtattttaccagtagtctacatttgagaataattttgctaaaatccttgtcatcagtcatcctgaggctaacattcacattccattccataagtgataataattttgaccaaaccatcctgcccaactttttagagtactaaatgcgatttgtataaaaattgttacacagcctggaatcctacattaaataatatactcggcacgattcgaaagtaaccaatatgtgcagaatcagtatatttacttatgcaatttgatcccaggctccctgcatccctttgtttcataataaaaggtatgcttcaactccatttaacaattgcagtgtacatagaaacatgattatagcatctaacattcataaggtctatcgaagacaatcaatacctgcattccattaggattgagcttcttgacagccaccaccacattgccactgtcattcctgagccccaaatgaccgcaagaagtttttaggaagcccttgtacacactcccaaaccctccttcccctatcttgagctctctactgaagttaccggtagcacttctcagctcggcaaggcgaaaatcacggagctcatgcgcacgctcctcgtatagctccagtatgctccgtggtgatgaagcaacaaccaggctgcatgatctgttggccttcttggacatttcatctctgaagtcatctttgtctacggttagtgtaggggatgaccttgattgcttcttgttcttattcttgttcttctctcttgagtagaagaagcagcccattgtgattgtgctagaatgatttggataagtatggtagttttttcagaacagagtggagcattacaattgtaaatcttgtcacgattgcaagaaggaagagaaaacaagagaaaatcaaagtataggcagaatgatgctagcaacaaacttaggcatgtaaacaaggcaaggattctttgcaagaaagcagtggaacatatgaacttgcaagaccaactgaagagctggaagtaggatctcaggaaaatgagaggataaaaaaaaaagttaagaagaattcatgaatgttcaactttgtcaaagaaaggtgatgccaatatttcaccagaagaaaaacaaacaagtgaaggctgttcaaatagctcagttctggacgctcaagatgtaaagaccacctcctttcctagaagtccaatggagctacatagagagatttcagtagtagagaaagccatggttacaaagtaagggttgaagaaggttagttacttctaagaatgatttaggtacatagctctgctccaagaatgtgtgactttaatatgtagtgtatataatgcaagaaggcatcacaaagtcgcacaaaagagaatcaaggaaggctgtgcttactttgaccggtgaaactgatgtatatataatcttgtgaagaaggcatggagactgccaaaattcaaccactaaagttagaagacctcattgcacagaagaggagagatgtctggttctgaagcttggagagagactggagtgtgatttcatggtaagctctggaagaaatactggtcttctctgtctcttctctagtagcttagaattgtattttcactaacctaatctagagcactaaatacatagccttacaagttacaccaaccctcttgacttattgaccccactgatgatttcaacccctatcattctcttgtgatgctttcattttcagtaaatttggttgacctttgggagctgggacttgcaaacctgttgcatgtagtagttccataatgttttctgccaatttagttactaaaattattacatcacatggactgcttcttgttacatatctggcccatgcagtttatttcatttagtaactgaaggtttggcatgttttacatctacaatctagttattagtttgtggaactagaataatctccacattttgatgtcgtaaatgatactatttccaaaactaatcaatcatgtctagcaaattatgtctttttctccttgttagtacttactaataatcttgaaaaaataactagttgaataattcatacatgattaaatgatattcagcaatcgttgttttccatgatctccctctcttttaagtatgaatttattttgataagaattacaaaaaaaaaaaatctggtaggattctacttctgatgtacattatgctaatgtgagagcaacggacatggatatcaagcatttcgtttcagaacaacatgtgaaacttagtatcaatgtaaagtttcttactgtccttcattacagctcattaaattgatctaaaagtttacaattagaattaagaatggcaaagcatggtctgatcatagctgtccatggcttacaatattggtggagtcttcttaggacaccaagtaaaatgcttctttagtgaatatttttgtccttaaaatctccaaagatcaattcaactcatatattaaggactatggaggaatgatgccctgttttgtgccactgacactattgaactgcatgtttattgttttctgttatttccgaagtaactgctgaagaactgacatgtcagcttaaactggaacctggtatccattatcaacgtctccccatcgtcttaaatgctaggaatagtttcttttttcgtaagtcaaacagatctctgatcgaaacacatattgctctgttgagttacatatttctggatctgaaatttgcagatagcaaagctgcggcaatataaactgtctctgttgaatttgtgaatactaagagttcctttcttaaacattatctttgactcaacgagttttagctttatattaactctgttgttcaatagataacgccattaacttttggcatggcgtttgaccattttcttactaaaaactatataagtatcatttatttttttgtggcttcttttatcattaacataactttaaaataacttttttttcatatttacactagaatttgaaataaaacgaatggttaaacgttacactgaaagtcaatggcatcatctttataaaaatagaggtagtatttttctattcatcctaaacaatggttaagtctatgctaattggcatgcccacgagaggtgaaggtgtaaattgatcttgggatatgagagcatcaaacagctctttttaaagttaagcatgattaagcaaagtcaatcctacctccagaacctcatgtgacttcgatatattttccatgtattatcatctcccacatctttggagcttcagttttggtaagaggaaattactcctcttcattagtctcaaattaccgtaggggatattgtctattcactggcacaaattttaaggaaaaatatcctgaaattttatctaattatttacctcaatgtctccttccttgaaatctgaggcagtgaataagggatcatattttttaaggcaaatatgaaggatttgctttctaaagttcatggtactcaggatttttttaaaaacattgtattgaggatcttagaatagcaaaaactatcccaccaagtggaagcaccggcgggtagagtcgtgggtgcatgacttcacccaccaaggttcaaatcttcatgcatacgaatattatgcacatgtaagtagacttttaacatgtttttagtaagattagggatgtgtcgctagttctcgtctcttaacagcggagttgtctccattcctctcccactagctgtaagctgttagatctcaattctccttccatacctatctcctaccccattgacttgttagatcttgattctccttccatccctatctgctacccatcgatcgtaaacaatgtgactcatcctaattatatgggtccaagcaatgcaccaatgtctctgactcatcctaattatatgggtccaagcaatgcaccaatgtctctgttggtcgaaaattgtactactccccaaatataacaactttctagctatatatctttatctggataagagcatattcagatatatagctaaaaattactatattttggacgaaggtagtagttatgtctcaaataagtttatttttcacatatcccacatataccaatataaaaaaaagactacaatatcctcattttatcaaaccccaatgcaattattgctctctatctattcccaatacatttatcccctattttcacaaacttcggtacaatggttgctcaaaaataacttattttgggacaatagggaaagacaaaaaaatcttagggcctgtttagttcccctggcaagttttttcaccctgtcacatcgaatgtttggacacatgcttgaagtattaaatatagacaaaaaaaactaattacacagattgcgtgtaaattgcgagatggatttattaagcctaattgctctatgatttgataatgtggtgctacaataaatatttgctaatgacggattgattaagcttaataaatttgtctcgcagtttacaggcgaaatttgtaatttgttttgttattagactatgtttaatagttcaaatgtgtgtccatatatccgatgtgacacggcaaaaatttttaccccctggatctaaacacatccttaggaagtgtttgagaggagggaaaggagaagattgagaagatacacaaaacgatgtgaaccattagcacataattaattgagtattaagtatttcaaacttaaaaatgattaatataatttttaaaagcattttttaacgttttcgtagaacttctcttttaaaaaaagacattgtttaacaagtcaggaagtatacgcgcagaccgaattctacggcgaagggagtactttctctgtcccgaaaaaacaaacatcgtctcgcaaaaaataaatattcagttttagattttttttttttgacggagggagtagtttgctaggtttccctggtaggagtatatgcttgcctggtcgaactgatgggagaaaaaaaacaaaaaaagggtactttttgtactgtgctatgaccagctggtactgcctccagcttgagcttacctgactctcagactgaaagcaaccattcatgccactagcctcccattctccctgtgtcttcgagtccctgtcacagtctaaagttgctggctggctctccttacaaagtctatctggtagtacagtacaagaccaaataacttatttttattaatcaagaaaagttgtatgagaccaaataatttggcctggatgacttgggagaatcgcttatcgcttatcgctaggccctatttagtccccaaaacaaaaattttcacgcaatcacatcgagtgtttgaacacatacatagaatattaaatgtagaaaaaaacaattacacagattgcgtgtaaattgcaagacgaatcgtttaagcctaattgcgtcatgatttgataatatggtgctacactaaacatttgctaacaacggattaattaggcttaataaattcgtctcgtagtttcctgaattctacagtaatttgttttgttattagactacgtttaatacttcaaatgtgtgtccgtatatctgatgtgacaaccaaaccaaaattttttttccccaactaaacaaggcctttttggaatttggaagtctttttacagccacggttcatgaccagcagcaaagtaaataaatgaatgattataacacttctactcttattttagcagttcaaaaggccgaggattgaaaaatggaaggcgcctaaaaccattacaataattctaaaataaaattctactagaattaccagaataccgagcactgaacatcacttccatccaccatgatgatgaattgtgtggatactccgagcaagcaacagaataccagatcaatatggaccagaataccggcctgcccctgtcatccctcgccttccaattgcaggcatgaaccttgcttacaacttacaagataaaataaaccaatgcctggggcagcacaccattttaatcaaggcacaaacaacatcggctactttagaattacgggatcccacagattcgctaattaaagaacaattggaattacgttacaacattgatcgattgatgtctttttatagctacacttcgaatgtggagtgggcctgcctgccaaggtgcatgcatgcggcaggcctgtggaggtggcagtggcggcatgatagagaccatcgctggcaaatgccccccactcttgcagtagtccaccagggtgtctccaagccctgcaaaactccagtctccgcctcatggcttgtggagcttgaatccaaatacacgaggaacgtagcgctgcgagggtttctgaggcttgaggtgctcgtacgtcatcagaaacaggtgcgggaatgttgtcccaaagtatgcgccgtcgatgtctgaacatggtcaagaaaacagcagaatataacaacaaaatggcagttctatgtaactatgatatcaatgtaacacagatgagagtgtgtggacttcatctaataagcgataatatatattggcactgagaacactaagaaagcaaaagaccatgcgttaaagattactgaattgtttatgtccttagtattgatattagtcgtcctaacaactgtatatgtctgcctgttaaaacttgtcaaagcatttgccaaccactcctatcagcgaattagggcaaaactattagaatatagtaatgctggaaatccaaaggaattctattttcttccagagaaaaacaaaaaaggaacgctcatatagacagtatgataagagagtggttaggatactgccttggtacttggaccgtggatagtagatgtcttcacacttggggcagtatatcttcacagtactagatcggtgtatatctgattgtccaactggtaaacagggttgaccacagcaataaactcgtgggcatcttccaaaatcatagtttttgtacttctccagctgtgacaaaaaatattaacaactgtcaatttatcataaatcggaagtacaacaatataaataccaaagaaaggtaccattgcagccaatcctttactggtcaaaatgtatcgtgcatgaatcagcccatataacatctctgcagctgactccactagctcgttttgttcttcggtgaacatgtcacctacatattgacacaatcaagaaacattagcaaaaagaatgagaacagtagaaaagagaacatggattaaagggagctactgcattatgatgccataaagaaggctgtgttacattactgatgggttatggcatttaaaatagcagacaaaacaacacacatatcctctccatgcttgctaattactaccacaccatttactgccacagaaacctaaagcaatctattagcaacatcactcttaataacattagggcacctaaacaggtgaccaagaacaaaacaaaatcacaaggtttaataatagtgagaattaattttccatgtaatagaacagaaagtttctaagcatgtactatgggtactatcaaggagcaaacgacaagtaacgcatgatggtgcagccatatgcagagttgcaaaagagacggtcatccagaatacaaaagcacaataactaacagtaaaagaaaaggccttttgacctgcactggttatttgttcataatcatagaagttgataacagagatcaattcgaggagaaaaaaaggaacatctatgttttgtgttctttctaggagaggtaccttaaattagtcatggtactccacaatatctaatatctagcttaagagttgaacaaatatctaagaattgtatgtacttttgtttaaaaagtctaagttgacctctgtttggacatcatcaatacaagataccagtttcaactattaagcagatcaaggaagaaatacaggaaacattttttgctcaaatacatccaccatttgtttcatttgcatacgtaaatacagggaacatttaccgtgagaagattcgatatctaaaatgagatcaagagcataatcataatatggaacttgactgctaagcccacagaggttgaagtcatcttgtatataatcatcatcaacctcacagaagaattcattccctcttagactgcagtaccatgaaatccatgagtgatcctctccgtcagaaccactaacatctgatgcttcactatcagattcagactcccctgcaatgtcaagcatggacttgtcaatgcaaaggcttttacaaacaatgatgcaaatgcagcatacctgtaaacacagtatcaaatctgaaataaaacatagcatgcttaatcaacacctcaaaaaacttaaaagttatactccagttagacccgcaatagcatagatgaattaaactaatggactcctcaacccgactggcaacattcatgcaaagaactgggcaatggaaccaaatttaagcaatcaatgaagcataaaaataagatattactgatcgtatgggccacttgatttttggttttggtaacggagaccactccaggaatgtaatttcaattaacctttaaatcaacaacacatgcaaaaaatttcaggattgtttttatttttgttgtccttggagttgtttttgttattcttgtacgtaattaagccacgcgttgtatttgcatataaaatcatgaagataagtgatgttagacaatgccgttaatcttttttgcggtgcacatatggaaagcccaatgggaggtaaggccatttaaggcatttgtgtgcttttacacaacattaactatgcgtctatgcctgaaacaagcagatggtaaatcggatacaacaagcaaacacttcctcaataagatcctacatcagcatcttcaaacatcatcaaaacaacagcccaattaacacaaccctgaaacacctccaaaaaaacttaaactgacatctctacacacatatagaacaaataaatcaactttcatagtcttcaacacatttaggatacattaaacagatcattgcaaaccagtcacaatacctccaacgctccaacaacttcgccgctaatgaaaatccacaatcaacaatcaattacattcctacgtcaaattagttattccctgttaagttctatagttccaaacaggttcataagctcatgccatcgatcaaacaccacatgtgacgaatggttccctcttaggaaagctccgcagacatcctaatcctaacgtttaaaatcaaacaataaatttctaccgcagccgcctgaatccccataaagacgaatatatgcaatcactaatcatatcaaacacaacggaataccaatccagaaccagttccctgctgccgcagcgcaatctatcccctcccatggccgcaaccgcatcagcgcaccacgcaaacgacggatttctcaatctcaggcacgacgcgccacgcgagacggccaataaaaaaaaaagaggagggggaaggcgagtcggtcgcgtcgcgtcgcgcgtgacgtcaccttcggagcaccgtcccttgggcatggacgacgcggaggacggcacgacgaggcgctggtggtca

SEQ ID NO: 61746 - DNA, 11848 bp, Oryza sativa
gctccatcctcagaataggccggaaacaagccatccaaacccgtgtggataggttccaaactatgaatccaatcaaatgcactctaatttccataaattatacgcttagttccagttaccataccagtgccatatcaagaaactttcatgttgcctcgtggaagttgagattgaagctactacgggagaatcggatgtcggtgtgtgatgttttgatttctacggtattatataaattctaaaataattttgggaaatggctagtttaataaaaacaaaaaaaaaattattattatgaggaagccatgtatgcatgatatgtgggtctaataatctcacaatatacctatgtgaaccacctaacccctccgcctagggatccgcctaatattggtctctaatgtttcggtcttcaacgtactatctaaattctgagaaattttttcaggaaatagctagctaaaaaaaaaacttttcttctttcctttcaaaagtaagctttacatgacccatgggcccaatggtcccccccatgtggaccccccacctcccaggacccaccccgttcacacgcgcactcctctggagactgcccaatataggttgattatgattcagttatataaataaaatgattttttgttgagcaaataaaatcgcatttcacgaagaatgtcacggtaactaattccatgctccttagagacgatgtgcgggattcctatcaaggcaatactacaatatagtaccatatttatttcttctatcttgttcttgttcctctctctttctcgtctgagccatttctccgtgacctcttcttttcatggcttggcactatgctagcttctcctcctccctcttctaatttcttcttaccctctcgctgttgtttgtgtatttgtttgcttgagtgcaacttatttgtttgtcatatccctcttgcgttaaccgcgtaccgttcttttgcatgcacgcatgagggttttggttttgtggtttgccctgtgcttacatatttgctagctagcttaatgctaaatttggttataatatttatgtgtttcctctcttgtttgctctgtcctattgtcttccggatcagaagaggcctgaagcgaggcaccaaaaaatccaagtggtcaagttccaccacagtaaacctaaccaaccgaggcacgcttagtttgtgtatgcatattatagcttagttccaatgaattgttccggtgctatatatgttgagaaaaattccatgttacctccctgtggaagtggggattgaggctactatctacactctaaaacattatttttttgaaatggctagattaaaaaaaacaaacattttcttccttttttatgaggaagccatgtgtacgtgatatgtgggtccaatagtccccatacacctgtgtgaagcgcacaaccccaccatatcggtctccaatgttttgatctcaccgtactatcagaattgagataatttataaggaaatatctagcttaaaaacattttcttatttcctttcatgaggaagctaggtatacatgatctatgggcccacgttcccccataatacacacccatgtggattgcgcacaacccctctccccccccccttccctaacatgcacgtttggaggtccgcctatattgattgatgatgtttctcttgagtaaataaaattgcatgtcatagtaacaaattacatgaagacactgcgtgggagaccatattaattggtcaaggtgatcagatttgagagtgtaatatatgtatcatccaaattccggctacaacctgcaaaatgttaagtacactatcatctttgtgttgtgtacataattccccttattgtgcatgtgctacatacatccatttatggtataccataatttttgagggggggaggtggcaacaagggtgaaaccctgattaacttggcctagagcaaccaaattgatcaagatacgtgtaatagtgttgctgttgtggattatgttttgagccgtgtagtttttggtatgtcagaataatttcattgaatttgattaaatgtatgattgaaaaacataggaatgtatcttagagatatatgttaattctaattaagtgctaaatataacatagatttgtctttcttatcttctggtgtgaaaggttatatgtgtggaccccgtagtccgcacaaccccacgtaagcatcatggtcccactagtcaatttttgtccctctcacgtgaatagcgcagctatttagaataaaagaggtgtcacaactccaataagatttatcatcggcaccgttcgagcagacttccatcgtgccacggaccaccgctatgggtggccgtcgatcaagacctacttagtaggggagaaacggatgctagaaagtttcaatctcgaccatcggattatttatctaaatttggatacaaaagctttaggaagatagagatcaatttaatatatcaaattctcattatcttaaaaaaaatactagattaacatcaactctttttttttcatttccatgaataacgaggtacacgcatgggggcgacctgtgggcccaacccagtggtccccacagtcctgcgtgggcattgtgacccggcctccacccccaggtttgctgtctccctttctctggtaaaatagcatcacctgctctgtgctgtggatggcgaaggcaaagctagcttgcatatattggcgagatatatatcagcttgcaaccactcccaccaccaccaccaccacaatagtgtactattccccggcgagagatatcctaaactccaaagcaggtagagttcagagaagtgagtgattgggaaagaaacaagcggtagggttcattcccctcctcggttcctgtgtgtttgtgtgtgtgccacacataattcctctctccttgatgaatcatctggccactatatttttaatctctctttgctcgtttggtgtgtttctcctgttgtttttaagggtttggttggctcagcatagctttcccaaatctttgtttttcttctaaccttgttcctctctctttctcgcccgagccatttctccgcgacctcttcttctccctcgcttggcacggtgtgctagcttccatatctcttcctcttttgattagttccttcttctgccgtctcgcggttgcttctgtgtttgtttgcgtgagtgcaacttgttcgtttgtcatctctctcttgcgttaattgttgttttgcatgcaaacatgagtgttttttttttgttttgtggtttgtcctgtggcaggaaccacacatatttgttatctaggtgaatgctaaatttggttacaagtatttatgtgttgctcacttctttcacttgtcttttagatcagaagcggccggaggagaggcagatagataaacagtgccagccatgtcgcctcctctgtgacttaaattggactgaattgatcaggtggctgcgcctcacctgaagccaacaaagtaagcagcgagaggacgcgccgccagggtagggagagcaagctatatatctagctgtgctgtgctgtagtgatcgatctctccctgttgttttgcggggatggcggccgcctcgtccgcacccttctttgggctcggcgacacgcagatgccgccgccgcagaatcccaccaatccagcccttcaccaccaccccaaccccttccccgctcccgtcgacgccgccgcgcccgcgccgaaaaagaagaggaaccagcctggaaacccaagcaagtgttctttcttgatcgattgatttcccctttcttcttcgttcgattgtatcgtgttaaaattaatcagttgtcgattcttctcgtgcagatccagatgcgaaggtgatagcgctgtcgccgcggacgctgatggcgaccaacaggttcgtgtgcgaggtgtgcaacaaggggttccagcgggagcagaacctgcagctgcaccggggagggcacaacctgccgtggaagctgaagcagaagaaccccaaggaggctcgccggcgcgtgtacctgtgcccgaagccgtcgtgcgtccaccacgacccgtcgcgggccctcggcgacctcaccgggatcaagaagcactactgccgcaagcacggcgagaagaagtggcgctgcgacaagtgctccaagcgctacgccgtgcagtccgactggaaggcccactccaagacctgcggcacccgcgagtaccgctgcgactgcggcaccctcttctccaggtccgtatgcttcgatcttgatcttcctcgtctcgtccatggattgattcgttcacgatctaagttaattaattcgagtaattgatccatatctttgcaattaattctttcgcgaattgaattgacagcaaaatcggctggctaggatagtagctagatagatatattcctttcgaattcaatggggtattattatcttcctgttttgttcgttcgcatgattgggtcatgatgaactcgatcgcgggaaagtgatcgatcgatttgatgggtggtggtggtagtacgcctttgttagggttagctagggttgtcgtcgttcgttcgttgctatagctcgttgctccgccatggaagagattggattccttcgagagagaaggaacggtagggacgacgacgatctccatagacgcgccgcgcgcgcgtgcgctgcgtgcagtggatcgagcatgaaatgcgacgagagggcatgagcgctgctgctcccacgtgaaccgttcttgtcgggaggagacgggagagatatgcatcctgacatgggcgacggctcaaaaaggagccatctcctccttttttccacctcggaaaccacgctcctctcctctcctctctcttcccccacctgttcacgtggtgagacatacgcgcccccgtcgttcgtctgcaagctgctacaagccacggcatccaatccaaacatgcctcgcagcgcggcggctggctagcttgtttctcatgtgatcgtgtagctgcattccgtggtgggcaactggccggcaagcagtgtactgtactactgctgttgctgtgcttgcttgacccatgcgtccggtaaaaatcttagcttcttctctctctctctctctctctctctctctacctccatctatctatatctctggcatactgcactgtcattggttttaattactagctagctgcatgacaattattagccacaagcctgcatgcagccggatgcatggattggccgctagctggtgttttcttgtgatttatgcttgctactctctgttgatagtagcagcagatatggtgctagtgctacagctaagatgatttattttcgttattaatattggaggtttttatgcgagaatttcatttctgtagctgttgcatgcgtacgtttactcattcattaattatttggttttatttgccagcctgcaactaatctgtacgcaatcaatctacagctagtagtgaccaagtatttttggcagtgaaataaattgatgattaattgaaatactatccttgcatgccattaattcttcagttttcttcacctctgtattgctggtgatatgcactagtcattaatagtacacttaagattgttgccagagcagtgacaataatctactgctatgtatagattccatgttttaattactacccacaactgagacaccagtaattaatcagcacatttaaaattcccgccatgtgtgattttcaatatattgcaaatcaatgatgaatatataagcttaattgattgtaaaaatgaactgcccatttttctttttgcgaggaaaaaaatgacctgcccattatattacaatggaatattgatcaactggcacttaggctcagtttgaggctcagtttgaaattaatctcgttaagctttttgcaactttttttaaaccactatgtgtgtattcttttaaaaaaagttaattatatacaagtttcttttaaaaaataaaaaatacttatttttatgtttataatagttaatacggaattaatcatacgctaatatatttcttattttacttgcctgcacccaaactaagccaaaccattcgaaagaacgtagccttagttatgcatgtgtacacgcttatatcatatgctagccagctttggttgcggacccgatcacagaatatgttgagaaaaaattcactataattttgtagcaaaaaaatataatttcactctaacttgactaaagaggctgatcagggaactgccgtgcgcgccgcatcgtgcgtacccacctgtgttcgaatcccattcgacatgtgtgttcacattcttttcattctttatcaatgcataccataccaagttactctttggtatccaaaatttaaaggctgctttttttagcgaaaaatatagtttcactctaagttgactaaagaggctgatcagggcgttgtcgcgtcacgcgtgcgttcccacccgtgttcaaatcccattcgacacgcgtgttcacatttttttcattctctatcaatgcataccataccatgttactccttggtatccaaaatttaaaggctgctttttttagcgaaaaatatagtttccctctaagttgactaaagaggttgatcagggcgttgtcgcgtcacgcatgcgtgcccacccgtgttcgaatcccattagacgcgcgtgttcatattttttttcattctctatcaatgtataccataccaagttactccttggtgttcaaaatttaagggctgctttttttagcgaaaaatatagtttccctctaagttgactaaagaggctgatcaggacgctgtcgcgtcacgcatgcgtgcccacccatgttcgaatcacatttggcatgcgtattcacatttttttccttctctatcaattaatacataccaaattcctccaccatggtatccaaaattttaaattaaggctgcgcttgcatacccacccgtgttcgaatcccattcggcacgcgtgttcacattttttcccttctctatcaataattagccaattaatcccctaaccattccatttttctcccttttttttaaattttttttggctcactgtctgatttacacgtcgctgctctctcctcctggctcctcgcgcgcgcccaaatgaccgctcgtaagcagtaaccggtcaaacaaaattttgggcgccgtgggagactgcatacgcgccggtatccaatacgagttagagccggttgtattacaaggctattttgcaaaaaatacataccaagtttctccaccatggtatccaaaaatttaaaggctgattatcctggctataatttagtgttcatgttcaccgcaatagtaaatgctatagctcctagctagctccaatagtgatgctccagaatttcaaaaacgaatttcattattgcccgcagtgattgaaaagtagttgtactactcactgtaaatatactatagcgccatatgtgatcatgtatagtggtacaacgaatttttactgagattatttcacgcatgcacaatgcattccatgaaataatttgatacatttgtgttcttcacatattggatcaaaatatgcaggagggacagcttcatcacccaccgcgccttctgcgacgcgctggcgcaggagaacgcgcgcatgccgcccatcggcgccggcgtatacggcggcgccggcaacatgacacttgggctcaccggcatggccgccccgcaacttcccgccggcttccctgatcaggccggccagccgtcggcgtcggccggcgatgtcctccgcctcggcggcggcagcaatggcgcctctcagtttgatcacctcatggcctcgtcgtcgggctcctccatgttccgctcgcagggatcgtcgtcctcctcgttctacctcgccaatggcgccgcccatcatgctcccgctcaggacttcggcccggaggacggccagtctcaggccggccagggctcgctgctccacggcaagccggcggcgttccatgacctgatgcagctccccgtgcagcaccagcaaagcggcaatggtaacctcctcaaccttggcttcttctccggcagcaatggcggcgtcgaccagttcaacggcggcgctggaaacggcgggcagggcagcatcgttacttctagcggcctcgccggcaaccacggcggcggcggcggcggcttcccttctctgtacaactcgtccgaaccggccggtacactgccgcagatgtcggcgacggcgctcttgcagaaggctgcccagatgggtgcaacgacgagcagctacaacgccggcggcgccggtggcgcgagctcgctgctccgtggagctagctcccacgggatcagcgtcggtgaagggccggccaacgagaggtcgtcgtaccagaatctcatcatgggctccatggcgagcggcggcggtggcgcgggtttcgccggtagcttctccggcgcgtctggattcggtggcgccgtcgacgacggcaagctgagcacgagggacttcctcggcgtcggcgtcgtccagggcatcagcggctcggcggcaatggggccgccgcgccatggcgcggccggcctccacgtcggctcactggacccggcaaacatgaactgaagtcatcacagagaagaaaaaaaacaatagaagacggaaggagatgatcatgctgctaatttcatttcatcatatcagaattagtcaagaaactggaggtaattaattaagaagagaaaagcgatttcaatccatgcaagatggatgtttctggggaaatctggagctgttaatggtgagtcgtagttgctagctagctagccagagctgggaggaataataataatacctggattaagtggccagaacttaattttgtaccggtacatttcgtttgtttttcatgtacttttggcagggaaatgggtctcttttgatgtgaagtcatcatgtgaaggcctgaccccagactagaatcaattcaagcgcgcgctgtgcctggattaattaatcttggagttttattgcttgttttggtgcacatatatgcaggtacagtggcttgatcatctgtgcactagctagtctcgttactgtcttactgattactcatcagtgtaaggcttagctataatatttcatgttggtttcttctctgggtgtgctgctttcaaagttgaaagggaggagcaaaagcaagcatcattaaatgtgggctttggcgtagtgtcagtatacactgtcactgtttgatctgaacagcaagcaagcagcagcagcataagactgaagaagaaggttacaaacagatcgaccaaagaaggcacgcatcccactgtcctaataacacggctgtgttgctttgctcgatcgcttccgtaattattccctgcttggcttcttccttcttcacttcactgtccaggtccagctgaaacattgcattgctgcaatgcttgctactagcaaattaagctactatgctgcgaccacagtgcatgcaattgcacactcgacatgtactacagggagagctcagctcacatagggcaggattattattattattattgatatgtatgcatatgtagagacacacacagaaaggtactactacgtagctaccgaacatttggaagtagctaaatgctacagaacaagagttttggatgaagtttgtccacgtgaagagagagatagaaactttgagagagaaagatggatgcatgcaagtctgtgcaggtcagaggtagccaggtctctctctgtgagtactgtgcactgtaacacactggggtgagcggctgctttcacaggagagtgttgcgtatttggggtatatatctacttgacatttttgttcaacacggttacggtaaaagtgtgttttacatttttctgaggagtttaagttttgactcttgtctagctacttccgctaaccattacaaagatcaacccttgctttttttgttcgtattaagaattcgccccctggcaactggtttggcgatcaatatttttcacaataaaattgaagtcgttgtgcaattactttctaccttttccccaattacaaggaaattcacccctggccactggttgggtgatcaacggttttcgcagtacccatagtgtcaatatgcatggatgcataacttcaaatgcaaaataatcctactagtagtattcgttagagaataaatacatatgttaaaattggccatatgatttaggaaggagatgtgcttgctggtacagtggcaaacgcacacagtgccatatgatttagtaccagttacgcttgttggtgcagtggcaaacgcgcacagttttaaccccatcgagctgcgctcgactccaggacgctcgcaatttcatatgaattaatatttgataccaagctccttcttggtcgtctagtctacatatcgatatcgatatgatttagtaccagttacgcttgttggtgcagtggcaaacgcacacaattttaatcccatcgagccgcgttcgactccaggacgctcgcaatttcctatgaattaatatttgataccaagctccttcttgtcgtctagtactacatatcgatatgatttagtactagttaatttatttcctatcaagcttaaatttctatatataaacaaaagatatatggtaatatgtttgcattttccacgtcgatccggttcgactctttctgtgttcgcaacaagagaaatagatgggtgcgcttggtctctgaatttggaagagtagtgaataaaatggagggagaagaaattaagaagcgtacaaattaaacctacaaagttattaatttgagtcgtttagttgagaaagtttgtttcacgatagttaggcctaaaacaaaactcgcaactcccctttcattgattattgtatggtagtttaatttaaaaaagtccaacaccatcgatcttcaccaacaactaatcaaattacaaatgcatcggtgcgtaaagattatacacggactgacggacactcctatttcaaaattgttcacatgcactatcaatatatggcctgtatagctctaattagctatagcatcaatatattttatgataaatcaacggccaaattagtcgaagaccttttcaatataccatgtaaattaaaatgaacagagatatcattaatttgatttgcacatataagtgtatttgtctgatattctgaaccaaattaaacaagaccccatatacatgcatgaattgaaaactgatttcatgtgtgcagtcgatcgatcgtccataaatatcctacggattatatatacgtacatttttgtggatgacgtgcattctgtgatgacagtactccagtgcataataatgacgtttgtggtcctttgttcgttacatgtactgatggcgacaaagtaattcgtcctatctctatatacacgcagtcgtcctgaatactttgccgctagcttagctgtcggcgtcatgcgataagtgtccaggttcctgactcttctctgtgtggcttcgttgatagtgtatatagtactatccccaccatttcttatcgtacatgtggtctcgaacatttacatttaattcgttttgagcggtaaacaatatgttaattttaacaataaattaccagttagttttttttactgggaactgtatagtactccctccgtcccataatataatggattttgagtttttatttgtattgtttgaccactcgtattattcaaaaaatttgtgcaaatataaaaaacgagaatttgtgctaaggataataaagtaaataaaaaaaat

SEQ ID NO: 61747 - DNA, 8800 bp, Oryza sativa
cgcgagtaatttttccagacggcctggacagaccaccactagaccaagaaattaaagaacgcatgccaacgtaattggaaattaaagattcaataccttgaccgctttaaccccttcttccccgaatgttgcaaccaacgcgttagctgcgattgacgccttacacaccacgtcgcactttgagctcgcacgtgctctgctaaaattgaccaaattgggaaccttaatttgatcagtatggattctaatcaactagaccggtgactgaagagcttccaccaaccatgaacgggcctgataagcgataaaattgtctgaaaattctcaggagtgtggaagaaccgatctcgcaggtagcaaccggcaacagttaattggctggggaagttaatttaagtacatgtaagattagtaacggtcgccatgctgcttgcagtgatgtgtgcttgtcagtttgtcagcaaaccaaattttgattaaaacgcccgtacttactaaaagagtactagttggtatactcggtattattagcagcaaattgagacggacatgccgctgaaaattcgtgtctacaactctagctgaccaaacagttgggtgatactgtttaatttatacagtaattttgccacgtttgaaacagtttattgattgaattatggctcatttctatttgattacaggaatatataaaatattttggcaaataaacttaatagttttaaaacaagtggtctaaagtctgaacaatgaaaatgtatacagtacacacaagctttccatacatgcgaactaataactatcatcaaaagttttagaaaaatacacatgttttccaatattattatatctatgtgcaaagtttcatctttaattttattatatttaaatcgtaaaaaagataaatttctgacacattaattcgtacatttaaaacggttagatttttcatctttttttttgttgtcatggtcaaaatgtaatgaatttaaagttcatactacatatatgtataatattattaaaagtacgtacatgtacattttttaaaagatttttcagttatacttattacttcctccatattttaatgtatgacgccgttgacttttcaaccaacatttgaccattcgttttattcaaatttatggcatgcttaaacatttgatgacgaatcaagtcacaataaaataaatgataattacataactttcttgaataagacaaatagtcaaacattggataaagtcaacgacgtcatacattaaaatatggaggtagtagtttgtttacacggaatacaggtgtaacgtaagtacgtctacagtatatgttcgcttaagcagtacaagaaaaaaaggtttttaacaccccaaatatatttttgaaaacgtagagcaaataatccgtttcaatgatccaataaataaataatctaattaagctttagccggtcagatcatcgtcgttgaatcggccatcggtgatcggttgatcgaatgccgcgctaggtagcaatagcatagctacatgctgggttggttggtggcgccgtgcgtggcggtggccgatcgcgatcatcgatggccggcgtcagtacgtcttgacgactagtgaagaattcgatcagggtattgctacgaccagctgctggttctctgaattccggcgagatatatatcgatcgatcgtacatagtactccctccatctcaaagatatattattttgaccgttcgtcttatttaaaaaaattaagtaattattaattcttttcctatcatttgatttattgttaaatatacttttatgtatacatataattttacacatttcacgaaagtttttgaatacgatgaacggatcaaatatgtttaaaaaattcaacgacgtcaaacatttaagaaaggagggagtacgtacatacatggtgccggtggcaacggcggccgaagcacgagctagcaacaagtctcttctccggccggcgctcgcttgctttgacgctggaattaattgaagcgaattagcgcgaccgatcgacggccaagtggctagctatagctttcatttcatatatactgttataatccatgcatgcatgctagtacaaattaagtcgtagttacgtaatgaaacgtcgttacttcaggcccaggagcacgtactagctagcaatcgcaatttccatgcagtttctttgatttcattcgatcttgcactgcatgacgaatttcaaaagacaatgatatattggtcgcgatcgtcgatcggaaacacacatgaatcaattaaccgatcgatctagctagctatcgagagagctgctcatgattatatatcacagtgacgggagttgccagattagaattaagctggtcgagaaatgtaattaatcggtccaagtccgcgttgaattatcttcccggtcttgctacgcatatactatctgctactcaaatgctatacgtggcacaatttttatggtggttaatttctctaagaagaagggggaaaaaagggatataattggatgttgtcaaatgcctgagtactgatcagcatattagttatgagcagtcaaaagatatttaccaaggcaccaacttaatttatttatgcacaaggtgaagatgcgtgtgttgaacgtatggatcgatatatgctacacgtgtggatacaaacattgcctctactgcatgcccctcgaatctctctagtttgtaattatatgccatgaattttgtactcttccccggaaaatgttttgacctctcgatggatcgttgtaccacgtttatttagaaaccatcgaaatagttataattttttaatttaaaaaattatattattcatacaatatatgtatatccctttataaaatttttatgtccaaacttaactcatacattgagatataaaaaaagaaaaattcaaccatataaaagtagtagtgtactatttatatctgaatttattttttccctctcaatgtagagtggtatatttcaatatttccctataccgtatattatcattttttaaaaaagaatacaactattctacttttttttaaaaaaataactattttgcaatgaatttggaagaaaatgtgtacgatgggacattgtaaacccttaaggaggtacatgatggaacatttacttgagatattaaaattcatttcacctcttttcctttgtaaaatggaaactgtcgacgggctatacccgactacggtatttgtaaagtatgaagatcgtacgtaccagaatatacgcgggattgtatcaagaagataagaggcaatgatttatattggttcgggctcttaagataagtaataaccctactacagtttatatgtattgttgggagatgtgccccacagattacaacggaggagaaagagatgatcaatctaatccgccgactagaacctaccacagtccagctagatctaatcatcaactagggcttcggcttcttccagattgtatcttgatgtggctttggctatggttgtaaggactctttatatttatagcgatgagtatcttcttcaagtagaactcagagtttatgctagacactagtgggagaaactttgttttttctaaataggactctgacaccttataccccggataaacaatttccttacagactcgcaaaaatctgtatataaggaatttccttcctgtatacttattaagtatgtggtatttttgtatatcacaaacccttgtatagaagagatataccttatctataacccaaacaaatatatatatatatatatatatatatatatatatatatatatatatatatatatatatatatatatatatatatatatagacacacacacagatgaaggaagatctctcgctcatttgaccttttttttaaaaaaaatacacaattaagttatgccagggagacctacacaagtattaattaatgatcaaaagtttgaataaaatatactccatgtttgtgatagaaggtttacgaatcctttcctggatggatgtgtacgtcttctttatcaatggaatgggacgaagcttctgcctttgttttagaaaatatatactcctcaaaattgtggcatataccctcaagaaggatcgagtctctccattaactagctacttcatactccctccgtatttcgtattttaatgtatgacactgttgacttttcgaccaatgtttaaccattcgttttattcaaatttttttataaatataaaaatatttatgtcatgcttaaagaatatttaataacgaatcaagtcataataaaataaataataattacataaattttttaaataagacgaatggtcaaacgttaaacaaaaagttaacgatgtcatacattaaaatatggaggtagtactgcttacacgttgcctctcaataatacaactatgcatatattctcttcttttttaatcttacatgaacagcactccagttacaaatttttaatttacgcgcgccactaacccgtcaattacgccatctctccacccccaaacattataaaaacaggaccccccttgcacttgcacacacgcacactcctctcattcgatcgccattagctgctttgcttgcactactgctgctagctagctgctcgatctcttatcacatatcatatatataccaactaattacgatcgaattaaggagctagcaatcaatcaagaccatggatagcctgccaaagagagacgctaactacgtccctttgagccccatcaccttcctccacagagccgcctccgtctacgccgaccgcacctccgtcgtgtacggcgccaccagcttcacgtggcgccagacgcaccaccgctgcctccgcctcgccgccgcgctccagtccctcgccgtctcaaagaacgacgtcgtaagcaactctataccctattattatagtcgtaatcgggcgagttcagaggttctgagaagcagcgggtgagaacgactagctagtgagaatctaaagagttactgtagtttttttcatattttggcttctagaataactacaaatttttacaatctaggtaagaatctaaactattttgggagagttgaaaataagatgtagtatatgtgtcactctccatgcatgtcacgtgctaatttttgtatcatgtggttacgtaggtgtccgtcatcgcgcccaacacgccggcgctgtacgagatgcacttcgccgtgccgatggccggagcggtgctgaacgccatcaacacccgcctcgacgcggccaacgtcgccgccatcgtcaggcacgccgagcccaaggtgctcttcgtcgactaccagttcatccgcgtcgccaccgacgcgctcaaggccgtcatgggcgacggcgacggcgacggcggcgaggtcagggcgcccttgccgctgctcgtcgtcatcgacgacgccgacaagccgacgggcgcccgcgtcggcgagctcgagtacgagcagctggtggcgcgagaagacccggcgaggtacccgcctcgtccggtggaggacgagtgggacccgtcgcgctcaactacacctccggcacgacgtcggcgcccaagggcgtagtgtacatccaccacggcgcgtacctcaacaccatgggccttcttctccagtggggcgtcggccacgagccggtctacctgtggtcgctcccgatgttccactgcaacggctggaccttcacctggggcgtggcggcgcgcggcggcacgaacgtctgcatccgcgcgccgaccgccgacgccatgtacgcggcgttcgccgcgcacggcgtcacccacatgtgcgccgcgccggtgctcttcaacatcctcctcgacggcgcgtgccgggagccgctgcgccgccccgtggaggtgctcaccggcggcgcgccgccgcccgcggcgctgctcgagcgcgtcgagcggctcggcttccacgtcacgcacgcctacggcatgacggaggccaccggcgtggtgatggtgtgcgagtggcgggagcagtgggacgccctgccaccgtcggagcgcgcgcggctcaaggcgcggcagggcgtgagcgcgctcaccctcgccgacgccgacgtgaaggacctcaagacgatggagagcgtgccccgcgacggcgccaccatgggcgaggtcgtgctccgcggcagcaacgtcatgaagggatacttcaagaacccgcgcgccacggcggacgcgttccgggacgggtggttcctcaccggcgacgtgggcgtcgtccacccggacgggtacgtggagatcaaggaccggtccaaggacgtgatcatctccggcggcgagaacatcagcagcgtggaggtggaggcggcgctgtaccagcacccggcggtgcgggaggcggcggtggtggccatgccgcacccgcactggggcgagacgccgtgcgcgttcgtggcgctgaagcgggagttcgccggcgccggcgaggtgagcgagcaggaggtggtgtccttctgccggaacaggatggcgcactacatggtgccgaggaaggtggtgttcgtcgacgagctccccaagaactccacggggaaggtgcagaagctcgcgctgcgcgacatggcgcgccgcctccgcctcagggcgcccgacaaggcgaggcccgtcgctgcccctgcccgccatgggccgttgactcaaactgctaggctttgacttttttgctgacgtcagcacgtgactacgtggtaaggattgctattggtctctaaaaaaagggaaaaccacagtaccacacacctttgtagtagtgcactttagtattttctttttaatttttcatacgctgcaatatggtcatagtgtatattatcatcgttgataataaatgaactagtgaataattaatttgctcgttgatagatgatgagaaatctcggataatccaaataaggtctaagctacgaagattacatgatactattgtcttaagagtcctatagctaattaaatggctgcaaaatgtaaagaaaaacatttttgcattgttttttttcagtggtattttctccgtctcaaaataagtgcactacttcacgctaaattagaggagtgcagttattttgggatgaacgaagtcctagtactacatgtgaaatgacaaaaaagcagatttaagaaaacaaaatatatgtattagaaacaaaaaaaaagacaatttgcacgcccatatacactggagtagcttcatagctatcagatcaatgtcacgctgagcgcatgccaatttttataatcagatctacttagtacctccgtattttaatagatgaccccattaacttttatatacatgtttaatcattcgtctcatttaaaattttttgtcagaatatatgaatcatgcttaaagtaattttagtgataaaataacttacaacaaaataaataataattacattttttttataaaatgaattgttaaatttgtgtaagttaacgacatcatcggttaaaaattgaggtagtattccttattagctttgtcggaaaacgaagtcggaaatagatgaaacgtatcatttaaaataacaaatttaatcttgccatatgtgtacagtgtacttgtttatcagcgttcattgtcctggttttagcatcaccagttctgtaaataatcggtcgtactatcaaagagctgaaggacagttcttgcaatcaatcttctatcggatgctgatagcgctttacttttaaaaaaaagaatcgtaacgtgcgtccatgaacaaatcgccaccaaggcaccaacatcaaattctgacccgatagtcagcatgctcaaatcttttaggtagacgctcttatcatgaaaaaactagaaaagaagtcatcaagcacgggatgcacattatgttctgcaaatgcaacaaatattttaggcttgtggctttgtttaagcttaactacgtactatgaagtattcaagtgcacgtattatttattttgtggggaaaaaatcttgtccatatcgagctgaatcatgcactgcatcatcacctacgatttataattgatttccgtttgggactatttacacatcacatatgcatttatctcttttcccttctccaatcatatgattttctttgtcttctactcccccttggccttaccggtgtcacttatccctctccctgaaacctccataccatcacctcctttatcttctttggcttcggtaccccgcaccgccatactcatagcttgtcttccgcggctccgtcgttgaaactgccgccaccttctatcggctatcgtctctagtattcctacgctatatccctcctaagccttctaaccactcaaatgatgagcttatcccttaacaacaccaggtcaccactctcctcctctttcaacgccgaggtggcgccaccgtggtctcttgctgccctggccacctacacaactagccgctactgtcctagccatccttctaagtcgggcactaccttccgccctcagccccaactctgaaatcctaaccacttgggggattgtcggagatgaggaaggaggccgtggagtacaaatcttgaagtggatctgaaggttagaatcacttgatttttcctctaaaatcgtgcgcacgatgtatagatttgtttgatacgtacgtacagacttgatttccgtttccttttaatttgtggaactatgatcgtcactgtaaagttttactcttaacctatcagagaaacaaaaaaaaatttgtttctaggcactattcca

SEQ ID NO: 61748 - DNA, 5988 bp, Oryza sativa
caaattccaatttaatatttgggaattggatgttctctgtacacggatcctaatatgcattaccaatgaaagaaaccaacccattatcaggtatcgatttaatggtgtgtgatgaatcatctctttctagatagtagtagtcaaaataaggaactttcactgcctattacacgaaatggtggatttaataggagaacaacagaaagaactgcataataataaaaattaagcaccataggaaaaacaccaatgatccatactgcatgcatattttacctgtttaatcatgtttataatctgatcaatgtggtctgaaacgcgaggctccacagatggtggtaaacaatgaagattagccatgtctgataggaagtcatcagagtaccttttgcttaagctaaaaggatcttctcccaattgatttgctcttgcaattatctacagaattccagaagtgcaactcaggtatcctgtgcagattagcaattggcatataaattttctttctaggtttcaagcaaaatagcttaatataatgagggaggtaaatatattgaaacaaatttgaagttaaattcaggtattaatctgaaacaaacacaacattggttgcaatatgaatcaaacatgaccttggtctactctacttcaactggtcaacatgacacgttttctccatattaaaggtatggatataatgacttctaactatagaagatgaacaggtagaataactgtagcataaataaatacaatacgattccttgtttacattaaatttagctttcagataatgaggaccagcatcacttgtttgaaaataaatttgacccataaatcaccttgtcatcaatgtcagtaaaattccgaacatagcgcactttatggtccaaataacgcaagtacctgccagatatcatgatacatgagataagcatatgaccgtatggtactttctagcaggagaggaaaataagacaagacaacatggtaagagtgtgctgaatgtgaataaaaagaccataaaggaatacggccggattcagggtgtgaaattgttcctgggtatgatggttgagttgctccgttatgcttagctaattgagatgcaacagtgaattggcttgttttcctaacgtcataacaaattaacaaccattcccagagtaccttttctgtttccggcagatctgttgctaagggaagagttaggatcatttcgcacgcaactaccataacagtttgccgtagttctaatgtcagaacatcctaaaccgagctatttagagcgcaaaatgtttctcacagtgtgtccacaaacaaattgtgaatgtacataatacattgtgtaattttgcaatgcacttactgctataaacatgtctcctcatttctccatgtatagaatactgctattaagtcggtgtaaatttgttaacacatccatataactaattaagtacataacgcctcattgggtgagtcaattgcacagcacagtcaacatcactatcactagagcacgcaattcaccaacgggaccaaatccggagaagaatgaagctagggggaacctgtagaggacgtcgaaggcgacgtaggcgcgggcgtggccgatgtggctgtcgtcgtagggggtgacgccgcagacgtacatgccgacctccccgccgggcacccggggctggaagagctccttcctccgcgacttggtgttgtagaggtgcagctcccgggctctccccgcaggcgcgccattcgaggcggaggcgaaggcggaaaacgcggcggacgacgagggcttgggggagtgggagtagaggcggtgggggcgaagcagaggaggggtcagggcaagcgcttggcggtgcggtaggcgagctcgcgacggcgaggagaggaggagagggaggaggccagcggcgcgcctcgccgccgccatggtcggtcctcgaggcacaggaagcgcgacggcgcgaggggttagcggatagcgtttccctcttttcccattttttttgggttttccgccccacgatttaatttcgttccactgaacagtggaattatgaaaaataaaagggaaatacaagtacctcttgatgggcttatttgaattccttattttgttactaaatttatatatagtatgtacctgaagttttagagagagaaaaaagtctagttcaaaatgtgaatccgaagagtatatgacaacagttttattggagacaaatatagcatattaagggtctgtttagatcctccaaaatagtgaaagttttgtcgttttggaccactttttggcaaaatagatctaaacactactagcaaaagtagacaagttggcatttatcatttgggagtccaaagcagcaagttttgctaaaaagagcgttgggagccatgtgggacgcacactgcccctgctcgctctctcgcatcccttaccctcgcacgctctctctcatccgctcccccaaaatttccccatctcgtatgcctcctcctctgccgatctcgctcaccgccaccgctcacgcccgcctccgccgatctcacccaccgcattagtccgaggcggagacggacggctccagcacgagggacttcatgtcgtagtccgattcactttcccccgccggcgggcacgaccccttcaccgactccctgtaccacttcactggatccggcagtggcagtgcttctaggataggcatggccgccttcgacctcaactccggcagtgatgggtggccaggaatggaaagctacgagggcctccttcactccggctcgcaaggacgcgacatcggcggatttgggagccacctttgggctggctcgcaaggaggcgacataggtagatctgagagccatctttgctctggcttggtatatgatacatttgtgtagtatcaatttgtggcttgcaagaagttgagcaacaacagcagcactcgagcaagccgctgcatggaatgcccgcataggagagagagcaatcaataaggtgcaattaatacgggcaaatcaatctataatggtaaaatgcaaaactctaccatgcctctaaacatctattccctccgtccaaaaatataacggattttggacggatgtgacacttcctaatacagtgaatgcagatatactctctgtcatattcatcatactcagaagtgtcacatgcatctaaaatcccttatattttgggacggatggagtaatatatgtcgtgaagtttcggtggttttaataatcgcatgctttgtgttagcttctcgcaggttagttggatgcttttaagcacgcaaatagaaatatctgaaatgaaaatttgaaaagaggatatgtatgaagccaaaacacaaaggctctgatgaggacatcctccactattacccgctggcaaagacgccaaagtcgggcggcgaccgtgtgagcttttgaataatcccaccttgctaagcttgggaggaggaagccaccttaaaagggagagccacccttcccctattggactagtcttttagggagattaggccttttcctgaatgggtgtgcctatgaactgttggggtccgagcaaccttaggttatttgttaaaggggtgggaatgatgaggacatcctccactattacccgttgttaaaccttgctaagcttgggaggagaaagccaccttaaaagggagagccacccacaagtcataaatatttaacgtgtatgatatgatcgaactcaatggattttttaatgattaattcagaaaatggtatgaatagatttgttttgaaaagtgcccataatatcataaacttattctgatagtacaaattttatgtttacctttttaaagtttggttaaatctttttctaaacttcgaaatattaaagacaagagggaatactgttttattattatggccaaatcttccaaccccaatgttgctactaacaactgcctctatcactttcgtggcacgtagatattctggcatgatttgattgacgagtttgaattttatccagttgtctcttgccagtaaggtttcgagtatatatattccggattatcggtccttggtggctgataccggaatttacctgataaacatttaaattcatttttttatggaggataaaaatcagtttgttttcttttcatggacctacctggttacctggcccatctggacccagctaatacttaatgggctcgacaaacgctggaataggtccacgagggtacagacgtccagcccataaaccacatcacgaaccatcagtgagttagctttacggcccatctaatggcccagaactaccttcacttgtccagtgccgcagccaggcccagcccaccgttcactgcgttgcaccgtaggtggggtccgcatcttggttcatgcggcacatgaagaaccaggtctacggagggtcctttaccacaggtgggcccccgtgttccacgccttgcactgttcacgggccccacgctcctcgtgattggcttttgcaccaaaagtggtcgatgcaccaggtctttatggaccgttgctgcaaaaatggtcagcataaaaagtcaattgaaaaaggaaaaaaaagaaagagagaaaaagttactagtagtgacagtcttgcagtcagccaaacacctctttgtttcaacctcacacttgataaggcacagtactcctatagacactgtttttcgatgttaatatcagtggatgattgatgatcaatgtattactactacgacatgattggtaagcattggatagataatattgtactacccagcagctcatgtaagccacaaccaaatctagattttgaattttttactctaggtgttatttcatcatttcatataacacattactttcaaaatctaccttattagctttaaatattacttactaaaatcataggaccgagattcaaatcctaccaattttatggtggaattgtatggaaataagatatactgtaagattagtattgttccgtcttactatgattgtagtagtattgtaaacctttgtcacggctattaatcgccatgcaaaagtatgtttcatatggttttgtttgaagaactcgagattctatgaaaccagctagggattttttttttgaaaaatgtgtctcccaactttagacttgtaaattataatctgaattttataaatactaaatacattacataatataagtcacaaccacttttttagatgttctatgcatgcatgcatgccattaactataacatattcttcattaaattactactttcttaaaaccttcactctcacactctctaactctattggatgtactccatatgcattatacatttattaagataattcaaagtacaatatgataataattatttcttgatctttccatattaagagtggctgtgtattatatagactagagggagtacgatactcgtaattttcgagttaagaatatggactagaatcccaacatttcgagtaaagctgctgccactcattaatcagagccaaagcaggaacatttatcgtctgcaacaacggcagcagagtggttaatgattaaatggacgaggtccatccagggagacaggcgtgccaatcctatcgtctcagcgtctgaccctgcctgaccagacctgaccagaccagacccgagtgactcatcaccagcagcaaaaggcaaaaaaaagccggcccgcccgaccgagccaaagcgcgcctcgtccccaccccctcacctcgccacagttctcgtctacagtatccccccccccccgcccataactacgcgagagccccaaagcccaatcgtctccttcgcctcgccaccaccaccaaccacgcctccgctgccacacgatggacgacgcgtggcccgcgcggtggcctccgcctccgcctccgcctgctccggcgccggcgacgccgacggcgacaccgctgccgagccag

SEQ ID NO: 61749 - DNA, 23805 bp, Oryza sativa
tacataagcgccacgtcaatgccacgttagattaagacccgagttaaattagctacgtgggcgccacgtcagccaaaaccgccgagagacctaatctgcactggttttgatagttgagggactcgttgtgtctggttttcaggttgagggacgaaaatcggattcgttgacaagttaagggacctcaaatgaacttattccccccttaaatactgacccattttgctttcttgtgggctggcatgatgtcatggcgtgcaggtacatgcgctcctgtggacacggagcggagcagatgggaaggcaacatccatgcgtggccttggcccactgcgttgttgttctctaaaaataaatgcgtgtggccgaacacattccgactcgattttgctatatatttgtcgacaaatttttcccccaaaatttgacagatgtaattacagtacaatcgtagtgtaattacactgtaacttgcatgtagttacactgtaactatagtgtaacttgtatgtaactttcaaaaatctctccgttacatgttatttcggtaaaatggaggtcgtgggaacaaattctttcacatatgtgtgtgctatgatttgttttcttcctcaccaaaacaaatcttgtaatagatccaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggtagtcccttccgactggattgggagtcgcgggggcagcagcctgccggcccagtgaggtcgaacagctgggggagttgtctgcggcccatgaagcagacgacgagcggtgagtgagacactcgcactgcacatattgcatgaaaagtccatcccctcccccccctcctcccgcgtggggtgtgcacttttaattttgaaatcggacacccaatcttctaaactttacaatccattcatattttcatattacccctaaagtgatatttttggatggttgttttgcgtagatgtttaaataagcggttttgatagctaatataacatattatattacatgtcgttaatttctagacctcaggttatactctatagtaatgctataatagtattattatgttggtacttagtaagtgaaatactgagagaaaaaaagattgttagaggatatatttaactgaagatttcaacatatatttcaatgtgtataccacatagtcaagcccatgcaacatacttcctctataaaaaaaagattaactcctgaagatgagtatggacaattatctaagttcattatcagaaattggttttttctataatggagggtgtatatgcaaattagatgaaaaccaccataacgggttatatgaacagtattgtaaattttagttgttagatgaactttcaaccaaagtttagcggggtgacatggactttttcatataatctaatactccccctgtttcataacataatactttctagcattacccatattcatataaatgttaataaatctagacatatatatatatatatatatatatatatatatatatatatatatatatatatatatatatatatatatatatatatatatatatatatatatatatgtttagattcatcactctctatctctctatctatctatctatctatctgtctgtctgttatatttttaaaacagccttgaaaggaggcaacacgttcactgtagaggctagaaattccaacattaatcggagaaaaagaaaaaaaaatacacgccattagattatagtgggtccaaattataacggtcgagatgtttcttgacagatatagaaagatatatcttgctctttgtttccgactctagttgtcataccgaagcaaatagattgttattaataccactggtcatatgccagccaaaaaaagagctttattaaggtacgttccggccggtcaacgactattggctggcaaaaaaaaaccacccatcgtccggtaatccataaaacacagctcttaatctttaaggatgcatatgactaaaactattaaaaaaatccatataaattagtagtaatataatttaaaaataactgaaattcaaaaattagaataagtaatattgaaagagaagtccatataagacccaatacgagatcaattaaaattcaaaataaaaaataaaataaaataaaaagagttcaagtaggaatacaattttgaaacaactgaagttggaaaaagaataaaaaatattaaaagaatagtgcatatagaacacaatacgagattaattaaaattcaaaataaaaataaaataaattttgaaattagaaaaagaaaaatagaatttcaactaggaatacaatgtataaataactaaaatttgtaataacaaagactattgaaagaagggaccatctagaacccatgatgagattaattaaaattatgaaaatttaaaaataataataagagtttaagtaggaatataatttataaataaaatacatcggaatgaaaaatatgaaattttcaaactcaacgatgataaatgacaataaagatgggagaagccataagcctgtaaagaagtaaagtgatgacggttgaaggggcatctaaaaactattaacaaaaccctaaagagaattcaatgatgattaaaaagatggatgacggacaggcagttaagaagcacgatctcggcggttggcgagacatctaaaaagtaaaaagtaaaccccaatgataatcatattcaattttaaaatcacaatgccaataaaaaggggaagcaacaggcgagccgtagagaagtccagtggtaaacccgtcacccctgacggtttggcgggacttctagaaagtaaaaaatgaacccaaatgccaattatgtttgatttttgaaattccgatgacaataaagagaaagtagcgaccgggccgtagagtagtatagtggtagcgtttgatgggacttataagcaacatgtctgaaaaagagtagagtggtgacagttgatggggcatctaaaaactattaaaaaaacccccaaatagaatttcaacgacgattaaaagcaggaatgatggacaacatggtcgcaacggttggcgggacttctaaaaattaaaaaaaaaaaaaccccaatggtaatcatgttcaattttaaaatctcaatgacaataaagaggggaggcaatgagcgagccatataggagtacagcgacaaagccgctgacggtttggcgggacttctagaaattaaaaaaaaatgaactcaaacgataattgtgttcaacttttaaaatcccgatgataataaagagatgagacagcgaacgggccatggaggagtacagtaacagcgtttgacgggacttctaagcaacatgcctgtaaatgagtagagtgatgacggttgatgggacatctaaaaacaattaataaaaacccttagtagaattccaatgacgattaatttttactcaaccttatcctctacgattaatttttttatcgtagaggagtatagtggcagcgtttgacatgacttctaggaaaattataaagacgaaatccaacaagaaaataaactctaaaaactataagatcctacttttaaaggttctaaggagaatgaatagaaagtggtagatcgaacaagcaaataaataaggagatgacagaagtaaggggtagcaactggtgtaacttttaaaaactataaaattaaaaacacggggatgataaagtttagtctttcaaagttttaagacaacgagatagctatttaataaatttttaagtaaaattatattaaaaatatataattttgtacgggtgctagccgtgcaattgcgcgggccacccagctagataacatctatatgaatgtggacaatgctatatatgaatgtggacaatgctagaaagacttatattatgaaatggaggaagtatttactattctatcggatggcactgtaatcacctctctcataggctttttgatttgttcgtgctaagggaattactattattgtttcttgtgctgccatgcatgcatggtgatggcgtgcagatacctgtgcgattgtggcctgcaccgtggccctggaggggatgcaccgaaaggtgtacgaggagtccaacggcgttgggacgttccctgtcgcttggcaggccgcggggagttggaacgagcagctgcggctcgcgtgcgagcgcaaaggcgtctggaaggcgcgcgagggagccaatgtgggcgatgtgctaatcaagattcaggagcttgcgggcgtggtgaccagtgtccccggattgttgatgccactgctcagttgggagaagcacagcgccgggcttacccgggagcgcgtggctgagctcatagacctcggcccctgcattgggagactgtgggtttgtccctggtaccattacttcgataccgataatggctgggtttatcttgggtgcggccgggacaaacttgatagggacgatagcaaagagcgctacagaaatcaggtgggctcgcacgctgtcgtctgcttcgcatatcgattctgcgaaaatggtgagatgcatgtgctcgtgttggacaaccatgatgatgacggcccacaacggtggatcgacgttgaagagctggatgcgatcttcaccctgaccgtggagtgcctaaccaacggaggcgcttctcccccaaggaggtgaattttccttcgggacacacacatatatcaaatactatatatcaaagatttctttatcaaatatatggtctgactagagttgttctcctggttggttcctggcaggcagctcgccgcctaaggaagcatcgccagccgcaagcttccgaaatcgaaccaaacatgccctccgagttcgagttggactttaaaaccttatgtctcataaaacatatgaggcctcgagacgattgtataacctccctgcttcttccggccgtagcatgaagcatcttgagctcctgcttctcttgtctccaaataactactagggaaaattcaccgtgtatccctaaaaaattgtccaatctctcatgtatttttctcattttcttcaatactcctgaatttatccttttcataaccttctcgttagttgaccgttaaattcttaaaaaagagagttgtccttttgtatgaagaaacacataaatttatagagtatatcattgaaatatagaaatttgttgtacggaacttatatatttactagcaaaatacccatgctttgatatgggtaaaataataataataatatatcatatatagaatatagcttttatcaaatatgatagtattatttattttcttgtttttatgtatgatatccacttgattcaaataaatattaaactattatataatataaaaaaattatggactagctaatttataaaattgtaaaagtagtaccgaggatggcagaaccaccaaagaccgataaggctaaggaggccgaggcccccctttgctccgccacatccatcgcgccacttcacaaacaagcaccatcactcctctttctctctgcttccctcgattccgtgaaccgaaggaattcctcaacggagggaaggcgaacatgaagcgtggtgagggcggcctgcgccgcgacgtgttgggtgaaggggagcgccgcatcatcagcgaaaagctagtcatggtggctggtaaggttcttgacgtgctcacagttgcgtaagaaaggagacgacaaggaggcgttgtggtcgatgtaggggaaaggggaagcgaggaccgctgtaaccctaagcaaccgccggctgcggcatgaccgtggtggcgcgagctcgctggagtcactggatcgggggtgtacaagaaagggagcgaggacgtcagggcgatgaatgctaagcaccatgtcgatttgcataattatatagggagccaatttgcactggttttaaagatgtgtagcaagagacgaaagatttaaagatgtgagagatgtcatacctggttttacggtgaggggagacgattcaacgtggagcaagagatgaaagaatgcaaaatatactgcgtggggtttacatggcgcttggccaagttgaatccgaccactccacttggaagaagttggaaccgagtcgagagcaaattaaagcgtggcctgcaggagcagagcgcggccgctggactgcgacatggcgtggcggaaactgatatgcgctaccctgccgctctctactctacccagactaaactgtccgtggggaacaacagcaacatagcctacgctaatgcggcggggcacacgcttgagtgcgaactcgagttcgttctcgtgcaagaaactaaggcagtggctgggagtctagataaccagaacagcgaggaagaagggcagcggtgcctcaccgacggtggcagtgccgcggcggccggaagtagaattaatgtgggccggcgatggaacatcttcggacggctctgtggataacgaacaatggtgggttagcgcactggacaagaacagaagaactagctgaggggagcgggggaggaaagctcaccagggcctccctgcaggtggcgtggcgagaactcgatcggcctatatgcgttcgcttcaacgcccattctgtcaggagagtaaggcaagggattcagacagcacacacggtgctggactgctgggagggtgagcagctattggtagagccgtagactcgtagaggttgcgaaccctgcgacgaatggtcgacggtgggtgtgcaggatcaggcggccggcgatgcaagatagcaccaacaccaaactgtcaacttcctccagaaccagatagccagttagccacagggtggttgacagtacttcctccagaagtagatagccacagtatttcctccagaaccagatagcattctcgtttcgtgtaaaatggttaatccggaagtggttatggttagaggaataaacccttataagttagttttactcttgctaaactagcaagttggtactaaacatgcgcacccaactctcatgggccacacatgcctcatcttaattgtgtcaggatgttaccgtggcccaaccggcaaggtgtgctttttcaaactaataaactgtgtgttttgtgtgaaatttttttaataaaaaatgctttaaaaatcaaataaatttatttttcaattttttaatgatcaatatttaattaatcatatgttaattgtgtttctagttttacgtgtagctaatcatccaaattcaatagcccaaaagaacatagcgtaatttctcattttgcatagcaggactttgtcgttacttggtgattgctgaaggttacgaatttgctatattggaaaataccatcattacaattcgtgaaatttgtcacgtgtcaatggaagtttgcaaaattccaaccataacattgccctaaaaaaaatgtttgcacctccatctaaacgtagaaattgtcgaaattaccttttttttttcacattctcctttctctctctgcagttcttctccgacgtggacagctacaccttcttggacgtacgccacctagaccccgccaccgctcgctggcctctgttcggggtcaatatctatacgcggagggagatggccaagtttttccacgccaagagcaggttccacaagagtcaagaccatggaattccactgtagggaaagtttattgatcgctcgagggatatcctcttatttatacatatatctaaatagttataaacaaatttaaaataaattgacaagatagataaggatgaaatatatcacttcacaaacatgcaagttagaatttaatttctacaagttgtaaaaaaaacaaatataattgcgaatgtactataactatttttagttaatttgttctttttattgcaactagtagaaattaaatttggccttgtattttttagagtaatatacactacaacggtcatccacatctcaatcaggcggcaaaccccatatgtgtcgggtatggcgcccgtcacgacgtaaaggttactgatgtgagaagttatctctattgagcatacagccgtcacggatgaagttatctcaatcgggccccaactaaagcctgtcatcgatagctttgacccagacgaccagtcaaataagggctcgtcacggatgaccttatttcaattgggcctcaattaatgcccgtcacggatgaccacaatctcaaacgggctttagttgaggcccgttacggatgagtcatccgtgacgggtttaagttaaagcccgtcaccgatgagtatttcctcccaaaaaataaattctgttttttcgctagcctcaggcctttactagccatgcccgttgtaaaatgaagaaacaaatatatttcacaatatcccagcatccccaatcatatacaatcattcacatacacatatgctattcacatatttcatatatccattattcacatatttcacacatccattggaatacacatccattattcacatatttcacaataacatcttcaagtgctaagcatcaaaacctgcaaaacagagttgtaaattagaacaaatttctaactggcgaaggaagaggttgaggcggcgggcgtgctcggggacagcgggggacggcgtggaggaggttagtggaggacggcggccggctcgaggacggcgtggaggaggtcggtggaggacgacggccggctttgggatggcgtggaggaggttggtgtaggacggcgggcttgggcatggcagtggacgtcgatgcgacggcggcaaggacagcgtggaggaggtcgacaccggctgatgtgggctcggggacggcgccaggctcggtggatgacaacgctgggctcccagacagcggcggcagcacgagggctcggggacggcagctgacagcggcgacgctaggacgtgcagttagaaaaatttttgatctagatatgagcaaaagtgaaaccctagtcaaagcattatctcaatcggggtaatttatactgtgcaataaatatctgtaacggtctaatagttatctcaatcgggcctcaagttggagcccgtcacagatgacattcatctgtgacgggcctaatagttatctcaatcgggtctcaagttggagtccgtcacggatgatggatatcggtgacgggtttctgttagggcccgacaaaaatatcatcggttatctttatcgggcttcaagttgggctcgtcaccgataggtgtcatccgtgacgggctcgatttttatgcacatctaacatgtcagtgtgagtatatctttgccggcctctttttgggcccgtttgatgacttcgttgtgacggcccgcaaaatctaggcatgtgaggggccgtctatgagaggatctgtaatagtgatatttcgtactaatctatattgttaaatttttttaaaaaattataattatatttagatgatatgtaaacaataagtggacaatccctttaagggatgaaaatctatatctgcatatgttttttttagagaagggtatttttacccggcctggatatatacggccattgaaatagggaacttagccccgcaaacaacccaatctgaaattcgctactatagagatttgaactcaagaccttgaagtactatatatacggccattgaaatagggaacttagccccgtaaacaatccaatctgaaattcgttcctatgaagatttgaactctaagaccttgaagtactactcaggtcactgcaaccactaggctacgtgccctttcgtatatttgcatatgtgtgggatagagaaaaagaaaaaggctaaagaaaactagaaaaagaaaaaggaaaagcgcgcggcgtgtgtttctcgcgcgtatgcacgaattcgagctcgacggggcttctccggcatctcatggcttggataaggattgtgaatggatggcgaaggtcagagcagcaagccagcaacagcgtcagtacagcaaatcggaaggctaagaacacgctaatttaccgttatactgtaccagaaccgtagcgggactttatcataaaaaaaggccggcacttgatgacctttgtcgttacatacatttcctttattagaaaaaaatggctattttaatcttattatcgttatatgtttagttaaaatgaaattcattataaaaattcgttttgatatataactttttagaaaattatgaactgcaattaagagtccgatcatctcaagttagtatttaagtttttttaaagatatttcttatacgacttcttctgtatttcaaaagcgaacaaacttaaaactaactcaaatacggatatggatatgtatttctagaaacgaacgaacttaaaaataaaccgactcatacataaatgacgtaccaaattattggtaaaaatatcttcaatttttataatagtagagatacagagtactcacgcactcccacctacacttaccatgtggatgcaaacacgtacccctccgtaaaaaaaaataatcaaatcatacgtgtccagattcgtagctaaagtttatcattttttggacaaagtaatacattttatttcgaagaaacttgatagatttttgaagtggacgaaccattattatagacacctcgctatcaaggttatatcatctagcacgaaataaaaatgctgttaaatcctaaaataaatctagcaaaatatgagtgttgtgtcacattaacaacttaaatatcttactcgttccgtttcaaaatacaagagaattttagtactgtaaatttgaacatgatattttagtactataaatctggatatgatcgtattagtaatatgataaatatatgtatttttgaacttcaatatagtcttcgagatgctaatttaaccaataatatatataaaactaagatttttttaaataaaaagagttacatattatgataactagaaaaatgcatgtgcgttgcaacgggtgattgttattttaatcttattattgttattgtcggtgacatgggaccgggagtatcatgacttagagacttgaggcagacatgatcacccacgtggtctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccatatttattgcggtttggacgagcgcgtcacgccgcatgtaacgcagtgcagcgcactcgtttatccggtctgtgaccagtcacagaccgatcagatcgtgggttaggtggcgacaggcggtctgacgtacgcctcgccccatcccgtcaggatgagagcctccaagcactcatccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggattgatttttttggggggggggtccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttctacataccgagagcttagaatctcacccagggcccccggccgaaccggcaaaggggggcctgcgcggtctcccggtgaggagccccacgctccgtcagttatacagtttaattaaggtgaaattcactgtgtgaatttgcttggatatatatattttttagaaagtcataattaagctgtaattaggagtccgatcatgtcaagttagcatgcaagtttttttttaaaaaaagacttcttacatgactccttctgtgtttccaaaagcgaccgaacttaaaaactaactcaaatatgtaaatgtatttccaaaagtgaacgaagttaaaaaccgactcatacacgaatgacgtacgaatgtaccggcaaaaacatcttcaattttataatagtagagatttgtttaatgataaatttagtaactttaattttacatgattaagcttttttctaattaatagtcaaagttaaaaatatttggcttaatactatattaaaaatgcttatattttagaacgggcagagtatatttcattcaacaaaaatttctttaggacggatggagcagtaaatactcagccctactggataagatatgctcagtcgctgtcgttggtatacaaggcagagggccaggttaagcacaattgcactaatgtcccattccaattatttcagtaaggtgtcccatcaaaaaaagaatatttcagtacgtgtttttaatagaaaaggcgtctcctcgtaagcacccggaaattctgctcgtggaaataggcgctgctcgtggaaaggcctcactttcacagtagtaataaaaatgaaccagcaattccgtaataaaaattctgatggcgtcactttcgccgtcccggccagaaaatacgaagtaaaaaagaaccagtgatttaagcgcgtcgatcgatcgacgagggactatgtatttaccgacttactgagaattccaggcatcactgatcaaccgtactaacaataagccatagctagtgatcgatcgatggccggcgtcgtagaaaccgccgacgaagctacccaagcaccagctgttgcttccataagtaccgcagcagcatatgcacggccggtgggcacactgcttgatccgaagctgttcatggctgctcgccgcggtgacatcaacgggcttaaggaacttcttaggccagacgacgacgacgacgacgacgacgacgaggtagtcatcgtggacgtcgaccctgtgcctgctgctccctcctcctcctcggcctcggggtcgtcgcatcatcagctccaacaacttgatgatcatggggtgaccagcaacgagggtgactccctactccatgtggtcgccacccgcagcggcggcggcgacggcgaccggttcgtcgcctgcgccaacacgatctactaacacggcagcagcaacggcgccctcctcgccgcgcgcaaccacaagggcgacacgcccctgcactgcgccgcccgcgctgggggtgcccgcatggtcgcctgcctcgtcgctctcaagacggctgaggtggtggccgcgcccgcgggagacgggccaggtgtggaggagttcctcaggatgcggaaccagtgcggggagaccgcgctgcaccaggcggtccgcgctgcctgcacggcctgcatagacgagctgctgctggtggatccgatgctggccaccgttccacaggagggggagggtggcgcttcccccttctacctggcattttcactgggtaaactggatatcgcacgccatctgttggacaaaactaatggccagttgtcctactctggactcgacggacaaaacgtgttgcatgcggctatttctcgtggtcaaggtacgtgaaaatgatactaagggcctgtataaatcttctggcaaaatttttcaccctgccacttcgaatgtttggacgcatgtatagagtattaaatataaacgaaaaaaataactaattatgcatattgcgtataaattgcgagacaaatcttttaagcctaactagcatgatggcccgcgcagattgcgcggctaacatcattatattttctctcatataatagcatatatatttttttattatattattaaaatatattataatgacaatataattttaaattttacaataactttacgaaactactaatgtataatattcatattatattttatatacgtattagttattaattatttttaatatcaaattttagttatttgtaaattatatatatttctatatggactctagacttgtcttttaatatattttttaattctgaatttttattatttctaattgtatttctatgtggactctaaactcatctttcaatattctttaatttttaatttcaaattttatttacttctaaattgtattcctatattgactttaaactcttcttcctatgtttttcttaatttcgaattttagttatttgttaattgtatttttatacggctaaacactacttttcattttattatgtttcttctaaattttacctagttttaaatttctatatagactctatactctacttctaatattccttattttttaattcttaatttctattttttttcttaattgtatttctatatggactctatactctacttctaattttccttatttttaattccgaatttctattacttcctaattgtatttctatatgaactatatactctaattctaatattttttatttttaattccaaatttcaggtattttctaattgtatttctatatggactctagtctcctcttctaatattccttattttttaattccgaatttcaactatttctaaattgtatttctatatggactctagactcctcttctaatatttcttattttttaattctgaatttcagctatttcaaaattgtatttctatatggactctgcttttttatatggactctatactctacttctaatattccttatttttaattccgaatttcagttatttcctaattgtatttctattggactctagtctcctcttctaatattccttattttttaattccgaatttcaactatttcctaattgtatttctatatggactctagtatcctcttctaatattccttattttttaattccgaatttcagctatttctaaattgtatttctatatggactctaccttttctttttctccgattaatttgagaatttataggctatgagagcgaacgtggaggctcctttttctattcctttaataatataatagattgctccatgattcgacaatgtggtgctacagtaaacatttgctaatgacagattaattaggcttaataaattcatctcgcagtttatatgcgaaatctgtaatttgttttgttatagtctatgtttaatacttcaaatatgtgtccatatatttgatgtgacacgttaaaatttttcacccctgatctaaacacagcctaacactacgctagatcggctcacatgtgatgggtcaaaagtacttgtcacggatggcctcatctttaatggattaataagggcataataggtgaggccatcggccgaggcctgtcatatttatttggttacctgtgatgggccaaaatttacacctgactgaggtctacctttgccgggtgcaaattctggccctttatcggtataaatttcagcccaacacaagtaaccatatacatgtgatgggtctcactattttagccaatgattgcaatttcggttgaagttggtcaaagtttatttaaattcagttaaaatttcggtcaaaaaagtgcaaaaaaatcccgaaattttggtcctaccgaaatcaccaaaatttctgccggaatcaaaagtgtaaaccttgtgttctaacctgtcaaaggtgagtttaactcatctctgatgggctcaaacactgacccgttagaggtgttggaaccctatatatacccttaccgtcaattgctttccatctcaatcctgcacacttttcacttttcgggtggtaaggtaggaggcgaatttttgctggatgcatgcatcttattttgcgggctaattaagagtgatcgagattatcacaattaattaaatacaaactgcaactgcatatatacataatacatgcatgcagcgctgcctgtgcttttggagtggctgaaggacgtgacggtggacgtgcaacaaggcgaccgtgctatcagggtgcctcttgtatcgcatctggcgcagcaaagggaccatcagacggggagcacgcctcttcacctggctgcatcgctggaagggtggccatacgtgggcattctttctaaatggttcccagatgtttggccgcggccgaaatcagcagtcgcgctgctgctagaagccaacacatgtgcagcgtatcaaccggacgctgaaggattataccccatacatgtggctgccttggctgacagcctcgacgtagtcaggaccatgctgcagaaatgcccggactgcgccactttgcgagatgccaaagggaggacgttcctccattccgcggttgaggcggagggatacagagtagttgaatatgtctgccgccgaatgccaaaagaattttcgtccgttctgaacatgcaggataacaatggggacaccgccctacaccgagctgtccatctagggaatctgccggtttttaactgcctaactcggaatccgcatgtacatctgaacataccgaacaagtatgagttgacgcctcttgatctttcatggattacagtcccttcatcgttttattatgattcggtaagttactagtgctattgttcttatttcaagaggcagttccctccacccaaactttataagttatccctccatccaaaagtttaatacctatttcattttaccatcaaaactaaagagtaattaactcatccactacgtaacaaaaccattaaattatacacaaacaaataagtaataagatggtttctcggattctggtcaacaatttaatttagggactatctatacaacattcaactgaaaattagcctaaaaatctatcaaatgtaactgtaacataattacaatgtaattttcataattacactatatttatactataattacatatgtaatttttataattacactatatttgtactataattacatatgtaacttgcatgtaactcacgtgtaattatagtataagtaagatataagttcaagctagatcataaaaatatagtagcccaatggggcagtcacgccttcatcccatgaggtcaaagatcgacccctaaatatggttttgtttttcttcctaaaagcacatatcttgatgcgtattaaactgttatagcatgaatctaggacacattcaacggtttagaaagtgaaagatttagccataaaaaatctgtcaacaaatatttagcaattccatttaatttagtatatagagattacaaatacggtttaaacttttggaaaaaccaaaaggtgaaatagattttagacttttgaatggagggagtaatatttttatacaagatcattgcttaaatgatactagtatattaactgttcattctcgcagaatccaaggggtctcatacaattatcattgcaatttgtgggagctccatgcggtgcaagtcgaccggacctcttatcccaaaaacacatcccaaagatagacaacggcaaggtctcggcgcatctaacaaatgcatcgcaaatgctgggcattgtgtccgtacttgtcgcgaccgtgacattcgcgtcagcattcacgttgcccggaggttaccaaaccgggtcggataacgcggcaggcacaccactgcttgctgggagctatgcctttgacgccttcattttatctgacacgctggcattcatttgctcgtgtatggcgaccttcagcctgatcttcgctggggtccctgcaatggacatctctatacgctgcaggtacttcgaaatttctgccctcttgctgcggagttcgggaagaagctttgtggtcgccttcgcgttggggctatacctggtgctggctccagttgctcacacgatcgcgactgcggtctgtgtgattatctttgtgtcttcgctctacgggaattcggaagcctggcagatccttcgtgtcgcagacatggcccgtgctagattgggaactcgaatgcatgtagcatggactttaggactcacgttctataacgtctttgttaatttgtttttgaacttctggtccttcattataatctttggcctcccagcagtaattcggaaggttcatgcaagggagtagttttcgctacctttccatttccttcgttagcattcggttaaaactaaatctccatgtgatcaattagcaagggacgcatgggctatatacatgtatgtaatcatcccatgtacaagattcatgccccttcatgggctatatatatgtatgtaatcatcccacactactgaaaaaattatctttgttggttcactcaaaaatcacattagtcctggtttgagtaaaaaccaggattaaaaatatctttagtcccggtttgaaaacacacaggtattttttgatcattactccaggttagtaacaccaaccggaactaaatattacttttactcctagttcaaaaacatatcagagccctgttatttttagtcccggttggtgtccatctttagtcccgattgtttataccaaccgggtctaaagttaaaaaaagttgcgaaaatccttgcaccgagccacgcgcgctgcctcgtccttatcccctcctcttctcctcctcccctctcattttctcgatctcctccacctcctccccctccccctctcctcccccttcccctctcctcccctctcccctccctcctctgacgatgacgacggcgacagcgggtggcggcccggcggcgcacgatacggtaggcgggcggcagaggtcgggtcgccaaagcggcagcagcacacggccgacggcctaccctccgccagatccggtggaagggaagcccgggtggcgccgaacgggcaaaggcggcctggcggatacggccgggcggcggaggccgagaggcggcacacggccggacggcgtgttttgtgaaaattttatttttggaatgatatgtaatttttgttgtagattattttagattttggaatgattttgtgaatgactcgtgaatgtggatgattttgtggatgggctaagaactgtggatgatttgttgtgcatgatttggtgatgatttgtgtggtttggggatgatttgtggggatgagggtgacaataaatgcaagaagcaaaaaaaaataaaggaaagaaaaaaggctaaccaaccggactaaaatgggactaaaaatccattaagtatctttagtcccggattggtcgtcccggtttacaacctgggactaaaaggggttataaaccgagactaaagagcccttccccagtaatgccatgtacaagtgaaaagtaaatacaagaatcattcatctctagagttctttacttctaacatgttatcacgcacgttagttgttccacttaacgatagaaggccaagaatacgttcttcgtcaacaggagattggtcgatttcttccaaggtaagaacatgaatcaatttcattcttctacctttgccatcggcatcgagtggctcttccccaaaacctttcgcaagatgccgcaatggtgttgccatgccatggtcactgctaaaaaaaatactcattggtgctggctccaaaggtcttataggtgccagatttggaaccggcacctataccaccgttgccgccaccttcaccaccacacgcgtgcgacgtgaagtaggcgggtgccaggggaggaggggccaccgccgccggcacgcggaggaaaaggggggaggaggggtggcggatgaagaggacggtggagaggaggagaccagtgtgagagagatggagaggagacagtctcgaaaatataaggacggagaggaagaatgatggcctattttttttaataggtgccggtacctatagttatattataggtgttggtttttttaaaagtccaacacctgtagtattggtacctgtttttctctaaaattgatacctgtaatgtaagtgtaggtgtcgattcttctaaaaaaccgacacatgtagtattggtaccagttttttccctaaaactgacacctatgtgtttaaaggtgccggttctatatttttttcattgtggcagaggtgagaaaaggggtataggtatcggttttaaataaactggtacctatgggccagtcgtagtagtgggtctttggtccgatattgcacggagaaatttggtgccgcccatgcttgcatcttcgttggcaaccccgacggcaccggccttgctagctccggcagcatcggcgccaccaccacagccgacccattttgactggccacggcaaaggcgctggccatccactcaaatgatggcatcaccttacagggggaggatttttttttgaacttttttatttttaaattataaaaacagaccattctaaaacttattacagaatctaaacctttggccatatcaactagtctggcgtggcaaaacaatactgacaccccacacatagcgagcataataattttgtcctactacactagcgagaatagtgtgaccaaataacgttgccacgccagccagaccgacgtgaccaaataacgctgccatactagccagaccaatgtgatagtattattttaccacgccaatctaactggtgtagccaaaaggttcatatcttgaaaataagttttgaaagagtttgttttaaaattaaaaatttaaaaagttcaaaaaataaaataaaaatttgagggagagaacggccgcctgccgaaccccactccattctctccaccgcgtggtgccggaccagacccccctcccccgggtgtgattggtcggtgaccagccgcgcggggctgcacccgcacggtcagttttgcccgccttagtccattagtataactactgctgctacaaatactacaactactactaatactaccacattaccactaccagtaatagtagtaatagtagttctattaatactagtactactactataattatatatatatatatatatatatatatatatatatatatatatatatatatatatgcgcgcgcgcaaagtttatatactacgtattaaaaaatttaaaatactaaaaaatatatcatgtatacaaactttgtatatacatatacaaactttatacacacgcatataaagtttgtatatgagcatataaagtttatatacatgtatgtatataaagtttgtatccacacgtataaaaaaccaaaaaaccaaaaaaaaagaaaaagaaaaccagagaaaactattttttttaaaaagaaaaccaaccaaaaaaacccacccacgtgggcttcccacgcgcgagcgactgccccccctctccgcgtgccacgcgttcatccacgcagggggaggggcgcgccccgcgtcccacgcgtctatccacgcaggggaagggcgcgcggatatccactttttagcggatctgcccccaaaccacgacatatgtcctacttccctgcccacttctacatggatgtgcagccactgggggatggggatgaaagcgatggagtatgtgtagctgtggctgatggcagaatcgcggtatccctcctacgtcgtggccccgggccaatgctcctccctcctcgcgcaatgtgtccacgccccgcccgtctctgacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgctaccaagaagaagtaccatcaccacttggggtcaggcggctatagcgtcacgatgccgaagtgggaggagatagaggctagcttgcttgagaggggtatcgaaccggccaccgctaattggccggaatgatcgaagttctggtactatgctcacggtggaacgctcaacccagctgatggctccctgatcttcggcgatcagatacgcgaggctgcgcgttgactaacagacgtagtggaagcctcttctcagggcacgttccgaccggacagagagaaggacgagctgttactcgccctgcagactccagagcatccaggacgaacacgagggaaaggagtgattccttggaagattgggttcaaggaggacatccacacgtataggagttggatgagagcaagagagataccgaggcgaagattgcagattttgagttcagggtatcgagctacgagctcagcatgcaagaggaggtggcaaggaaggttgatgaatgtcacgcccagaaattcccgaatagaattccaagcagaatgtgcattaaaatccccgtccaggaccggcgggggtacacaaacgacaatgttgacattcagatccacgtcttacaaatatcataaaagtcttacataaatgcagcggaaagaaagaaagacaacaggagctaagccttgactagaactgcagcgggaacaccactccacaggcatcctcgacggcacgggcaaagcctattcctcggagaaaccttcatctgacacatactcgtactctggggttgggaaaagtagagcaagactgagtactacccactgtactcagcaagtcataccggaatagaggcatgatgcagggaatcatcaaagaagagctaaagtggatcatttgcataaagcgagcatttataaacagaagttgaaagattaaacagttgtaataattaattagtattaactatccactgtccaacgctatcccacgttgcaacaggcccaaccatccacctaaactatccaaattctaaagattacactagggtgatactaatcacggtgaatctggttgaccgcccataaccgcgggcacggctattcgaatagttttactctgatcagaggtgtacaactgtacccacaagacacagccccacaacacgtttccatgcgccgacatgccaccacgacatatcggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgttgactagaggagagctacactacaagcccagccgttgcccacgctggcttgtggtaagtacgataagttcttccagggcatcccgcgaacaggtccttaattgccatgggtgcgaccagcaaaaccatgcacccacaacccaccatgtgatttattttaattaaccaacaccaaagcggtgtcactaatccaacaaaaccattagaaccaacagtctaaacattaataggattttccccattgtgcactagttg

SEQ ID NO: 61750 - DNA, 12345 bp, Oryza sativa
gatagctagtgggactctatgattctgaagggttggatgcccaagttggccgtgtccaccatgtccccatgagagaacgacaccttcatctgaatacagccaaagaagcaagacgttagttgtgtgctacaataaccaccatactttcttctataaatgcaatttatgagtgaaaaaatctctctaactattattgccttatactgtttgttgcagttccaaaagaaacttgactcattatcagacatggtatctgattgaaggtcatcattgcatggtgcaaaactggcattaggtatggtcaacaactcacttagataatattttaaaatgcaaatttctttatttttcacttctgtatgaatgttcgtcgggaccttggttgcaaatgcttgtttcaacagtataatacagttttgaatttagctaggagaatagccaaaattgcattctattagtggcaggaaagcaacagaatttgcaggtaataataacttaccagtcagggctaaagaatgatatccaccacatgctacttggattacatggagatttttcaggctagggataagctgtggcctccagtcactggaattgctccctctacccaattcgaagtttgaatttgctggaaatcgtatggaggttagacaaaaagcatgtagaaaattaaattaaagagtatctacacagtttgacaagaagtacatttcaggtggcattccttaaccatttaactcaaggtttagaaattctagacccaacatatgtgattccacttgcattaaaaacatatgtgattccacttgcatcttttataaaaattgatgggattaaaacaggagattctagaaccacgatcagtggagaatagatgaaagcatatcaaatcaatttgttcttgagatattggttttgcattttggataggttcactaagagccaactgaaagcatggagtaccatgtcagatgctctgttcaatacacactgcttagcttgagattattatagtaaaactatcaagccctaataactttatgcccagtctatgaacaaaggatctggaatgtagatgccagctagttagagggaaacttgtatattgccacaacatttcccggttagcaccttgcacagttgcacgttaatgtgaactgtaaggcattgctggttgctaaagagaagaaacactaatccaataagagaaaaagataaaatattccaagtgtttatacatactaacctccccaactccatagctgaccatctgaagtcagagccatagtgaaaaaaccaccacaagccacagcagcaactgaaacaggcagagcgttcaccttggaaggaacactgagagatccagcttcaccaggaccacctccacttccaagccccaacctaccatcgccttcatcacgaccccaagtgtagagctcacctgttcacaaaagccacaagatcagggctgaggcggtctgacaatcacaaaatgccaatattccaaagcattcaattgtgaaaggcagtggaagattatccacaatgtctttcaccctttcaggtttcagcaatcagcattaaccatgaactggaccaacctgagtcagtgattgccgcagtatgtgctccactggtagcaatgtgtgatatcttcccttcccaaggaccattcactttccttggcaacaattccctatggtaaacataatgccccaaagcaccaaatccaccataacccctgcagactacagtaaactgagtgatgcagcagccaaatccaataaatttgcaatgcattcttcttgcagttcatccagcgagcactcactcactcaagcatctattattattattattattattatctaatcacaccaaaaggaatttcaaatgagcaatgtggtggtggtttcctcaccaggtgaagacttccccggaggcggtcagggcggcggagtggatgccgccgagcgcgaggacgcggagctcgctgaggttggggttgtggcgcgggacgaaggcggaggactcgtccccgaggccgaggcggcccccgtcgcccttgccccacacccaggcgccgccgtcgacgacgaccgcggagtggaacagcccgcaggagatccccacctccacgccccccgctgccgtccccgcggcggcggcgtcagggaggcgtccgggcgtgggggagagcaccggcgcggggtcggggagggagaggtgcgcgacgggggacgggtagaggcggcgctcctccttgccgccgccgagctgccccgacgcgccgcggccccaggacaggatggacaccggggtggtgccgctcgagtagagggttggcgtcgcgctcgaggacgtcgaggtggagaagcagcgccggagggggaggaggaggcggcggaacattgccggcggcggcggcggcggcggcggccggttggttcagctgcgtgacacgaagactactagaactagacgaacagtataaatccgggttcgagggttcaaacccgttaacccgaatcacttagcgcccattaggtttctaacccgttaaccccgctctgtcaggttcgcgtgttcagacccgttaacgcgagtcccgacccgagaagagtatcgggttaacgggtgcatctctccaacctccaacaaaaggcaaccaccaccgcgccagcgagagcgaaaccgcggcggaggcagccatggcgaacaaggcgccggcgacgacctcgtggcggtggcggctgctgctgctgctgctcctcgcggtggccgccctgtgctggatccctccggcgatcgcgatggccgccgcggccgccgccgccacgacgtcctccggggggcggaggtcgctgctcgggttcgtggaggcgcaggggaactcctcctaccggtgctccccatccgggccctgcgtcccctgccaatactccgagaaggtcagccggttctatgctctgactcttgtcattcgatcttggggctcaccgtggaggggggaatcgatcttgggagggtgaaacaagagggacgatgttgcagtcctgcaattggattggatttgggatttttcaggactatattcctaatttatttttcgatgtagcttatgaataatccgtgttcttggattgctacaactgaagaagtgtgcacattaagaaacgatcggatcttgattaaagttaggcccgttttgcttcaaatctgagtttcttctttgactttcgttttggtttgcgtggtaatagttagtcttcggatggcacatatcactatatcaattatcaggtccaagttcttgatgccatttattagttggagtgtcattgatatggtattgattattgaagaagataatccttttacagtaggatttatttagctggtgatgtttagttcatctccttaatcactgtatcggtttgcacaataaagatatggccaagtgataatggattcagcgaacttgcttcatgtgtaatatgattgaggggttgctaccatgtgtgagcttgctggctttgttggaataaattcaaaataaaggactttgttgctctttcaagctgttgatgattctataataaatagcatttctaacataatgaaatttagttctttcatgcaaagatttataggaaagttgagtcttattcagcctttctagtgattatagaatcgtaactttgtggtttgtgctctagctgatgcattaaaggtgcaatattgtatgttagagtgtatcaaaaaagaaaggggcaaattttatgggttgagggaaatacatatattatgtttttaagttacctcaacgatttctttgtttctcatctttatgttattcatgatcttaggtgtatatcttgaagatacataaacagagttttctacttttccattgagtgggagatgaaccttttatagttatatgtccttttgtgcatatcatagaatgtcaacggggcattaatagtttaggaaaaagccttacatataaatgattccatttatgttatgcccaaaatcaccaacctacaaatattgattgaataacaaatggaatttatattacagcctgatggggcaggccaacagggtttgtaagaacaaggatgtctcgcacagtgcactttatctttattggtcagaatcgacacccattaactcttatccccagtccccacccccgcaactccttatactgtcctatcaagtaattaacttcctattaccacgtttcctggccttttagaagatgtgatctgaaaattggctggactgtgctgattattcgtagcttttggataattagtttacagggtgggattagttttcctggaccatgtgttcattcagaactcagtgtcttttccatggttatgaagcttagaagctacttatgttgggatttctgctgtcgtgcagatgactctactaggaaacctaatttgtatagttatattcgcaaatacatgtgccagagtctttgtgcactgtgctttccctgaccaccaatagatatgcctgctttcagctgctgctcatttttgctttttccttcatatttgtaatggagttgaatactttgtttgtgttgagtcagggctgaaaatatcaaattacctctgttgaagacaactatcaactattgaaatggcatgctgacatacaatttcattttcatttttgttagagcgatgagaagtactgttgcagtgaaaccggctaccgcttgccattgaaatgtgtagaagtacaaaatgttaccaaagaaggaaataatactaagcaacggaaggtgctggacgatgcatccacgtcaggtggttcaaagcattacacaacttacaggagttgtgtaccattggaggatgaagagaagttatctgttcttggttttgaggtattaaatcatagaacttctctctgttcatattgctataaagattatgcctgtctggctgtctgccatcaatttattccctccagcataaatttttgattacattaaaactgtggaagtagatagtgtaaagccagaaactgtgaaatatttatctatttttttaagaacgttgggacgagatttaacctatcacacttaaacaggagcaaacacatgaaccacccttttttctgtcagtatgtgcctgtctggagctttaatttctggttgattcagttgtgagtattgtcttgtttttttcttgtgaaaatactatctatacttgtgtaccctatgaagcaaagtgtacgtttctgacaaaactttattctgttaaggttatatatgtgtgatcagtgtgtcaagggttttagtcttgtcctgtattgtgtacaatttatatgttctttgagcctaatccaaaatatctatttcattcctcattttcctgttcttcctaaattaaacatcttcatggctcttaatcatatcatgattatctatgacaggtttttattctttcttatagcatggtaatttaaggaagtttatggtctttacaggttatgatggctggaatgctgctaataagtggcccatttgtatactatcggaaaagacgaacagctataatgcagggggcttcaaggatcccaacaagccctcctaggttttaagtatgcaatgatgaatcggctgctcaagctgatttggtgtaccattttgatgatttttcccccctatcaatgtactgtatttacacgtgctattgttgaagaagtcaaagtgttgggtagttcttacaggattagaaaagcacagttgctagtctcattgtgctttgttttcttgaatcaaatctttgtaatgtttatatgtaacaaattactttcgattttgttaccccaatgaagttgccctgacaaaggagactctgttgttggcaatcaactatttgtctcgcagtgttatctgattcactgcagaagtttgagtctctacgcaaggaaaggtgtcctcatatcacaatggtcatcaaaaattgttttggaataactctttgccttttggcttcgagatattatcttttgagcatgggtagttcagtaaggattttgtttagtttgcggccgcatgttgcctggtggtgtcatacctaaagtataaactatcttgtgatatgaggacaacttacagtgatatggggttattatttggtttgtgaccatcataagttaccttacagtgccattgtttggtcaaaataaccattcttatggttctttatcatacttgtgataaaatgtcttcttcatcacaaaggtttcacgtctcggtctcaatgacaaaatatactgccccgttctaacatgagcaaaattcctgatattttagaacggagatagtaacaaatttggtctcttcctagccaaggtgttgttagagtttcaaattgtaaaccaaatcctaaacggtttggtggtctccgaggctctaaaagctaaatttataacctataataaggggtgaaaatggttttttaatggacgatcctttagaatggagctatagtattacaattgtggtcaattgatttcgatggcatctggcaaaatctgtggtaaatatgcataggcaatagacatggtactatgtatcacataagattagtgtattacgatataggtgacaccgttctttcagttttatggattcaattctcctagcgatatgagagtccgattgtctctttacaactcagatgctaatagtcgatagataataaaatagatagatccgttcttacttttgtggtcaacaagacaaaagaagttcctgtataaatggagggatttttactgttcaaaagattcacaaagatcaatagaattagtcataaaatagcaaatatcgtaacagttgtgtcatgattataacttcatcaaacagatgatccatcatgatcaaccaagtttcgcaaatgatatccctttttccccaaacacgaaaactcttttgtgtcattactgcctctattgtctaggattaaattcgaattctagcagtaacaattttgagagttttctttacattctttttttttaacttctctattaaagtagttatagaatgtaattttgcgaaattagcagggactccagtgcaaaaaagggtgtccacaacacaatccccaattcccccgtcaggctcaacaccacactcgcatcgcatcccgatctgattgaatccgagcagcacaagcggcggcggcgatgggcggcgaccatggcgggcacggccacggaggcggcgacttccggcagaaggtatggagcatgacgggcgggccctactgccggcccgtgcactggcgccgcaacaccgccatcgccatgttcggcgtcttcctcgtctgcatccccatcgccatgaagtccgccgagctcgaggtacgtctccccgccatccaaaccctaccacgtagtactagtcacgcgccatgcttgtcctttccgcgtatctggtcgagctgatccgaaatcgctagccgggagatgtgatccgtggggaatggaaatgaggagcaaacaatagatagggtggcagaaacatttttgttggggtcattacgaatatgaacaagatttacgttgttgtgcatatcaggaactcggtgtgcagaagaagaaatggtaatagctctattgggaacctatggaatacgcttaactcaaacctggatgaaatgtttgagtaatattttcgtgtaatacctttgagttgctctgggtagtaaagtgcaatagaatgttgaattgttgatttttcttgttagaggagaagacattagatagggcaactgggagaaatgctagatataaaacaaaaaatgtcgtgcaattttccagttaatctagacaaaacttgaaatgaaattacttgttcccgttgtaaagcacatttgttctatgcacgtgacaggcatgcctgttcagttagttttgtactattgtgcaaacaaatgctaatatgttctagtggtagctgaatctattcaatggagttctgtaatcagttcttgaataccagtttctaccatataccatatggtggttaagattattattcctcgcttattagacaaactacgataaaggccaactttgtcagtaaatacataatttcatgagtcatttagtaattcttcttgatttcctcaaaacaatgagaaaagcttctttctgaaccccctacttggaaagggatttattccatgttcctggctgcattatgaccattcagtagtaggtgtgctactggtgggatgaagccatctaggataccctgtttttgttttgcaactagatctcaggaggtttgttgctaagagatcttgtagtggtatatgcgctgatgttcatttccaaataaatttgtggattgtccacaggaacttgcacgataaagtacagatgatctagtgtttacatttggtagatggtcttgataataattcggtttttcatgtcatgtgtttcaaagttgtcttcatcaaaaaattatacaagcactgggatgatgttgtcgacttgccatcagctgattattacaattattcttgtttttctgtacatcaatgtgtaactttttttgtggatagtgtttgctttctgttggtgaagagtaaatgaattcatctgaatcaaaaatcataggcaaaacataagcatttgcatatcattgttttgtaaagcttgacgtgtatcatgtcaacaccaatgcatgccaactgtatatctcattttcctctacttatcacaaaacatgaaatcttgctagtaggtttcctccccccgtacattcattggaatatatgttttcacacataataatttccattaagtaaggttgcagttgttaatgatcttatccgttcttttagttgtggaaagatgtgctgacagatctaatgttttgcagcaacgcccacatcacccggtccggccgatcccatctcaactttggtgcaaaaactttggcaagaaagagtattgaaggatgtctgaacttgcaaggaggactcctgtttttatcttgttttgtcataatttgttctcagcgatcaatgcttgaagaagtatgctcctacgagtatgcacttgatgcttcatgtaactctttcgacttatattatgtcatacaaggagtttgcctgttggtaactcaaaataaactcgtgacgcataagcctctgatggatttactttagggtttaatgctctgtttggatgattcctatttcatgcatttttctgaagaaatgctaacgtctcaatgatgaatttacttgatttttaaacgcattttgtttgcaagtagacttgggaatatgagtaacctggtgacgttgtctcctatgtagtatgaaccaagtattctcaaaggaaatacaagagactgttagtgttctgaaaagaaggtaaaattgctggtgtttctatcttaaatttgttcagtgaattacagaataattgtatacatttgagacgttgcccaagcaggagctatacaatgccttttcctagtgaaaggcgtaaagatatgagctgtgttgctaagcgaagccggcgatcagttgtagaagtggaactcggtggcggcgtcgccgggcttcttgccgacgacggcgaggtatcccttgtcgaagtcgtccgccgtcacggcgccccgcctgtcgcgcacggcctgcatgccggccttgcggcacacggcggcgatctcggcggcgctgagcttgtcgcgccgcgccgccagggcgtcgaggtcgacgtcgccgtccaggctcatccccgccgtgcacgtctgcagcaccagccgcttctcctccgggctctcgggcgccgtgaactcgaccttgcggtccagccgccccggccggagcagcgccgggtccaggtcgtcggcgcggttcgtcgccatgatcacccgcacgttggtggactcgtcgaagccgtccatctgggtgagcagctcaatcagcacgcgctgcacgtggcgcctggcaccgccgtcgtcgtcgtcgccgccttgccgcgccgccgcgatcgcgtccacctcgtcgatgaagacgatggccggcgccatgtccctggcgagccggaacaggtcgcgcaccaccctcggcccgtcgtgccgcgcgagctcggcggcgttcacgcggaagaacgccgccgaggtctcccgcgcgacggccttggcgagcatggtcttcccggtgcccagcgggccgtgcaggagcacgccgcgcggcgggtcgacgccggcggcggcgaagagctccgggtgcgtcaacggacagttcacggcctcgcgcacctcccgcttctgcgcctcgcacccgccgatgtcgtcgtaggcgacgcccggcttgtcggcgtccgcgacgaggaaccgcgcggccgagcaggcggcgacgtcggaggggggcacgccgacgagcgcgagcgaccggccgttcagcgcgacgttcgccgagggcttgaggaggccgcggtcgagcgagccggcgacgccgacgcacatcttcctctcgcatccgtcgcccagcgtcacgacggcgtggtgctcgtcgacgacctcgtcgagctgggcgacgacgaggggggtgaccgccgtcagccgcctgacgagctcctcgcggaagcgcaccgtctcttccagcacgtgaatctggaacagcgcgttgtcccgctgctcatccagcaggcagaactcccgctccagcgactccagcttctcgcgcagctggcgtccctcctcgtcgtcggcgtcgaggaagatgagctcgtcgtcctcctcctgcaggtccagcaactcgagcttctgttccggggaagtcttggcgttgccggcgccgtcgacgtcgtgctgccgctgctgcacgccggccggacacggccgcggtggtcggagcgccatcacggacgacgtccttggctgcgaatctgcgacgttgtccttgtgtcaaagaacgcatgcaatgcaagcaagcggtggcgcgtgaattataggaggagagctagtacaaatccgagtcggagactcggattccgattaatacatgtgagactcggattccgattaatacatgccaactattttttttctcccttgtaggtttgcaggggatgaagatgcaacatactgccattggcacttgtgtgttcaaggaacagtgcaaatcaactcgctcaggtaactaactgttcaaacgctaggtctttgattctctcgtcaatcctgataattgcagattttgcaaaatttcatcagatgatcagctggtgcagaattgtaagggttgaacttcagtttaccctcataccctgtctggtggcattaagggggcatcccagtggagaaggcctcgaacttgtgcaaacgaagaacagtgtcgaggccatggagattggagagggttcaatttattgagaacgggacgataaaagaccatggccagtggggtgctcaaaagatgaacctggtgaggattgtggcctgtggctgtgataattcatattggctttcagacaaaggtgtcaaacatccctgaactttctgctgcagattgttatccaccacctatttctgaacccccttgtttatctgtattccagacctgaaagaacaacatgagaaacaaattaacatgtatgtctaattatgttctgtgagttatatacatacattgggtgccactctaaacacaccttgctggaataagaaaacgtccacatacaacggtcgatctgtacaagctatttttctacagcaatttaccagtcatgtattaccttcacaatgcttgagcactgcagaagtggatttcctcatatggaagcacgctgctgtacaattaacatacgtattgtaacacagttaacacttgatatgagccccaaaactagacaccttcgcttgattgtatatctgtctcaagtgatcttcctactcccaggtactcttcagcaaaaagttcatcattttttgcaagcatgtctgtcagactgcagtctatctttctactctgaagtacacaaaaccgcggctttatcctcccttccagtgaataactgaagtaccttggatattctacaacagctttaagtggcttcttcatggttcttaacagaaattcaagctttggtttcataacaagttcaatactgtaacccagaagtgaagagaatctatagatcatcgagcacacattttttttagacaatcccatatccaagaggtagttgattctgtaaacattggaatactgttacatgcattgaacatatttggtagagtatcacatcattagccggtaagtccat

SEQ ID NO: 61751 - DNA, 4979 bp, Oryza sativa
tcttgtatagtaataagcacagtgaatcttctaaaattcataactaattcatccgagctccgtttaagcccattcaagtctcagtaaatcaagaaaaatgtgtagaatccattaaaaatggttttgttcctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgtttcctttcaaatattgcattgttttataatgttactatgggatgtttacctattgtcttagccatgttattgttgtaccttgtccctttgtcagcttggggttataacatgactagagattggaccagggattgcttagccatgcttagttcaactagtgcacaatggggaaaatcctattaatgtttagactgttggttctaatggttttgttggattagtgacaccgctttggtgttggttaattaaaataaatcacatggtgggttgtgggtgcatggttttgctggtcgcacccatggcaattaaggacctgttcgcgggatgccctggaagaacttatcgtacttaccacaagccagcgtgggcaacggctgggcttgtagtgtagctctcctctagtcaacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcatggaaacgtgttgtggggctgtgtcttgtgggtacagttgtacacctctgatcagagtaaaactattcgaatagccgtgcccgcggttatgggcggtcaaccagattcaccgtgattagtatcaccctagtgtaatctttagaatttggatagtttaggtggatggttgggcctgttgcaacgtgggatagcgttggacagtggatagttaatactaattaattattacaactgtttaatctttcaacttctgtttataaatgctcgctttatgcaaatgatccactttagctcttctttgatgattccctgcatcatgcctctattccggtatgacttgctgagtacagtgggtagtactcagtcttgctctacttttcccaaccccagagtacgagtatgtgtcagatgaaggtttctccgaggaataggctttgcccgtgccgtcgaggatgcctgtggagtggtgttcccgctgcagttctagtcaaggcttagctcctgttgtctttctttctttccgctgcatttatgtaagacttttatgatatttgtaagacgtggatctgaatgtcaacattgtcgtttgtgtaccccggccggtcctggacggggattttaatgcacattctgcttggaattctattcgggaatttctgggcgtgacattcatcaaccttccttgccacctcctcttgcatgctgagctcgtagctcgataccctgaactcaaaatctgcaatcttcgcctcggtatctctcttgctcctcatccaactcctatacgtgtggatgtcctccttgaacccaatcttccaaggaatcactcctttccctcgtgttcgtcctggatgctctggagtctgcagggcgagtaacagctcgtccttctctctgtccggtcggaacgtgccctgagaagaggcttccactacgtctgttagtcaacgcgcagcctcgcgtatctgatcgccgaagatcagggagccatcagctgggttgagcgttccaccgtgagcatagtaccagaacttcgatcattccggccaattagcggtggccggttcgatacccctctcaagcaagctagcctctatctcctcccacttcggcatcgtgacgctatagccgcctgaccccaagtggtgatggtacttcttcttggtagcattttctttgtttctttccatcatcgcctgcccttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcaagagacgggcggggcgtggacacattgcgcgaggagggaggagcattggcccggggccacgacgtaggagggataccgcgattctgccatcagccacagctacacatactccatcgctttcatccccatcccccagtggctgcacatccatgtagaagtgggcagggaagtaggacatatgtcgtggtttgggggcagatccgctaaaaagtggatatccgcgcgcccttcccctgcgtggatagacgcgtggcacgcggcgcgcgcccctccccctgcgtggatggacgcgtggcacgcggagagggggggcagtcgctcgcgcgtgggaagcccacgtgggtgggtttttttggttggttttctttttaaaaaaaatagttttctctggttttctttttctttttttttggttttttggttttttatacgtgtggatacaaactttatatacatacatgtatataaactttatatgctcatatacaaactttatatgcgtgtgtataaagtttgtatatgtatatacaaagtttgtatacatgatatattttttagtattttaaattttttaatacgtagtatataaactttgcgcgcgcgcatatatatatatatatatatatatatataattatagtagtagtactagtattaatagaactactattactactattactggtagtggtaatgtggtagtattagtagtagttgtagtatttgtagcagcagtagttatactaatggactaaggcgggcaaaactgaccgtgcgggtgcagccccgcgcggctggtcaccgaccaatcacacccgggggaggggggtctggtccggcaccacgcggtggagagaatggagtggggttcggcaggcggccgttctctccctcaaatttttattttattttttgaactttttaaatttttaattttaaaacaaactctttcaaaacttattttcaagatatgaaccttttggctacaccagttagattggcgtggtaaaataatactatcacattggtctggctagtatggcagcgttatttggtcacgtcggtctggctggcgtggcaacgttatttggtcacactattctcgctagtgtagtaggacaaaattattatgctcgctatgtgtggggtgtcagtattgttttgccacgccagactagttgatatggccaaaggtttagattctgtaataagttttagaatggtctgtttttataatttaaaaataaaaaagttcaaaaaaaaatcctccccctgtaaggtgatgccatcatttgagtggatggccagcgcctttgccgtggccagtcaaaatgggtcggctgtggtggtggcgccgatgctgccggagctagcaaggccggtgccgtcggggttgccaacgaagatgcaagcatgggcggcaccaaatttctccgtgcaatatcggaccaaagacccactactacgactggcccataggtaccagtttatttaaaaccgatacctataccccttttctcacctctgccacaatgaaaaaaatatagaaccggcacctttaaacacataggtgtcagttttagggaaaaaactggtaccaatactacatgtgtcggttttttagaagaatcgacacctacacttacattacaggtatcaattttagagaaaaacaggtaccaatactacaggtgttggacttttaaaaaaaccaacacctataatataactataggtaccggcacctattaaaaaaaataggccatcatccttcctctccgtccttatattttcgagactgcctcctctccatctctctcacactggtctcctcctctccaccgtcctctccatccgccacccctcctccccccttctcctccgcgtgccggcggcggtggcccctcctcccctggcacccgcctacttcacgtcgcacgcgtgtggtggtgaaggtggcggcaacggtggtataggtgccggttccaaatctggcacctataagacctttggagccagcaccaatgagtattttttttagcagtgaccatggcatggcaacaccattgcggcatcttgcgaaaggttttggggaagagccactcgatgccgatggcaaaggtagaagaatgaaattgattcatgttcttaccttggaagaaatcgaccaatctcctgttgacgaagaacgtattcttggccttctatcgttaagtggaacaactaacgtgcgtgataacatgttagaagtaaagaactctagagatgaatgattcttgtatttacttttcacttgtacatggcattactggggaagggctctttagtctcggtttataaccccttttagtcccaggttgtaaaccgggacgaccaatccgggactaaagatactcaatggatttttagtcccattttagtccggttggttaggcttttttctttcctttatttttttttgcttcttgcatttattgtcaccctcatccccacaaatcatccccaaaccacacaaatcatcaccaaatcatgcacaacaaatcatccacagttcttagcccatccacaaaatcatccacatccacgagtcattcacaaaatcatcccaaaatctaaaataatctacaacaaaaattacaaatcattccaaaaataaaattttcacaaaacacgccgtccggccg

SEQ ID NO: 61752 - DNA, 1284 bp, Oryza sativa
cctacgattcaatatagtgtcacagtttgagatctcaaattcaaatatgtttggtgcattaattaatgtaattcaatatggtatcagcacaaaagacctcgaattcgaatccagctaagtccttagctgcgatgcaattagataaaaacataaaacctattaccgtttcacacttcaggttttaggaggcgtatataagtgaattctccacagtttgttaaaaataaatgataataaatttatctgctctaaactatgaaggtatagtatcaagttaattattgatgtccacaatattgataggtgaaaaaaaagatggaagccctatttttagccttttctcttagtaatatcagatttgatttgtacgtcaaaagaaacaaataaacaagcaataaaattgacaaaagacatgtttcaactaattagtttgtacagctacaaattgaagaaaaaccaacaaataaggaacaaagagattaacaaaggttgggcttctatatatttgcccagctgcaggtttgatccgatcctacgatcataatatctatttaatttttttttcaggaggtatatatatagacctacacgactgatccatctcaataagtaaaacttatcagaatgtttctgtatcactaaaaaaagaaaaagaaattaattgaaaaaaaattcgtttccaattttttttcttttccaaatatttttctctgatcactcggtgtcgtcggccgccgcattcaggtcaatcttgggcttcttcccgctgccgtcgccggcgccggcggaggcttcccggggcttcccggcgagcggcgggacgttgccggcgcaacgcgggcaccgggggtccgcctcggcgatgagcacgtaggtgaggcaggacgggcaggcggccgcacgcatggacgggctcgcgggcgtcgcggcggcgccgcctgagggcggcgagcggtggcgcttgccgatggaggaggaggacgaggaggtggacgccgacgacgacgacgacgtggccggggagccacgcgcggcggcggcggcggccgacctcccggccgtggcgcgctcgagcgcggagcggaccatgtcgagcgtgcagaccgcggccgacgtagacgcggccgcggcggcggaggacggcggcggaggcaggttgaggtcttggtggccgacatggacgccctggagccgaggagtcaagaacgtcttccctgactgcaagaagaacaaaaaaaaaatcagtaaactccatttcttcaagatcaaaccaagaacatggca

SEQ ID NO: 61753 - DNA, 4415 bp, Oryza sativa
ttgagaatggcacaatgtcaattttctcccgcccccaagccgccgcccccagaccgccgccgcgccggccgccgtcgcccccaggccgccgccgccgccctctgcgccgcctccgccgcgcgccgtcccaccgccgctcgccgctacgggaggcttagacggcgcctgccccgtcgcgcagccgtcgccctccgcccaccccgtcgttcgccgcagccgcggccttcgctcgctgcagccgtcgcgcagcctccgcccggcccgccgcagcccggcgcctccgctcgtcgcaaccgcggcattcgctcgccgtggccgtcgccccgcctccgcccgccccgccgtggcctttgctcgccacagccgccggccttcgctcgccttcgcctgccccgccggtcgccgcagtcgtcgccccgcctcagctcgccccgccgctcgctgaggcactgcccgtcgccccgcctccgcccgtcggcacgcaagtcgtcgtcgccgttgccgtccgccgtcgccgcaccgagataggtgcgccagtggggaaggggaagtagtactggagggagaagggagatgtaatatggccatgggtggggaaaaaaaagatggaagaaggtatgttgaggctgacatatgggttttatttgtcattgacttgtaatggaaatgatagatggagaggctgttcgagtaaacaagagtttgacttgccaaattagatggagagttggccaaatagacatttggagagtcaaaattggagaggctgttggagatgctcttagtgatggtgatgactgatgaaacatactccctccgtaaaaaaaaaatctggacagatatatattcagattcgttatactagatgtgtcatatctattactaggttgattttttatattcactactaggttagttttttatgggacgaagggagcaaggctcttggaaatgcagaatcgtcaatacccggaaaagaaaaaaaacgttaaaatagatgccatgtttattggatttttatgaaatttagaaacatagaaaagtttcaaaaatgttgtttgataatcacaccgaaaaacctaggaattcaagaccagaaaacatgaggtaagacctcatactaattttcctacaaaatttccgtataatagtccattcctaagaatttcaaactgaataaaataattataatgcacgggcatataagtagttgctgaaaaataggacaaagcaaaatagagagtataaaagtgagaaaaaagaaaagagaaaaactatagagaaaatattatagttcatatattacaatgttagcttttatatatgggcttatagccagcatttagctctactattaaacttgctccatgggtgtgtttagatgagcaattggaatttgcttttcctcgtacacaaaacgaaatggattattggtgtatgattaattaaatattagctaatttttttaaaaaaatattaatatgatttgtttttttgaacttagttatggtgatgcacggagttagtataaaatttcctatctctctactactttaaaaaaaagacatatttccgttaatatctacttagtgattgagaagggtctattatgtgctctcatgcgattagccccctcactgttaatatctattcacgcatttacattgaactgataatcggacaaaattgcaacttggcctctttttcttagcaagattttatttatttttattatgcagacaaatctggcacttaatttagggtgtgtttagataatgggaaatggggggtggggttgtgatttggaaatgaatgaagggttagtattaaatggaaaagggagaatgaatggttacgatttaaagcggcgcatcgagcttgtcaacgacggaccgacctcggagttgcggatgaagctcccgtaccaaacgatggcgccgctgagctctcgccatatccgtcggctctggccttggacggaggtgacatctcggcagcggtggcggcacatcgtcggtggcagcccgaatacggcgtctcggcagcatagcagctcgaccgtcgccatcttcccttccttccttctcatctgacacacacatagcctcagagataacgcaaagctccgacacactaacgagggtgctttgtttggctccgcgttcttcacttggtagcgggcggagcatacgtggcagggaatctggcagggaatctttgatgtggaagcccaacgagattgcgaatgggcgaacagtcgcgcgccccctcccctgcgcgactggacgcgtgtcgcatgcggagagggggcgcgcgggcggcggcacagcgcacggtttttcttctttttttcccacaattccgcacggtttcctctcttttagttttttttgtttttttctttccgcggtttttttgtttgtttttttgccgcacggtttctttttttacttttctttccgtatattttttattgttttattttttaatacgtacatatacatatacaaagtttgtatatgtgtatttttatatgtacatgtataaactttgtatatatacgtatataaagttggcatattttgtatacatacatatacaaactttgtatactacgtatataaacttaatatatgtgtatatattttttataatatacatatgtcggtgatatgggaccgggagtatcatgaccagaggcttgaggcagacgcaattgcccacgtggcctggcaccttcggggacgtcgggcccgagggtgaggtgtccgccctcctcctgatttcccccgagggggggggggggttgcgcttgccccggccccgagggccgaggcaccccgaccccttaaggaagtctgcgacacatatatgggataagtgagcacagctgtgctcacctaacagcatttattgcagtctggtcaagcgtgtcacgctgcatgcgacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccagtcagacgctggtcgcgtcagcaacgggcagccacgatcccacgttgcgcctgtctccgccgggagtggaggtaggtgtgggctgtcccatcgaagtgtcattcggacagcgaccataccaatctccgtccataaagagaagaaaagtccagtttggaaagggaagggtgcatgtggtatccccttgaagtataaaaggaggaccttgcccatagagaaggggttgattcttttcgagattgagagcctagaacgggggagaagtcggctcacactttgtagctccttcatacacagatccaccaaaacacaggagtagggtattacgcttctcagcggcccgaacctgtatacatcgccggtgtctcgcgttctcttgctagcagacaatctttccacaaacagagagagcttgagatctcaccctaagcccccggccgaaccggcaaaggggggcccgcgcggtctcccggtgaggagccacgagctccgtcatctggcgcgccaggtagggggctcagtgtgtgttttctgagctctcagactcttccgtgtgcgccaagtttttcttgttcagcctaatggccgagcaaggaaaagcgcacgatctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctagcgcgctcctacgtcacccacccgtcgtccatgaccctgagtctccagctcagcgatggctggacgacgtggccaacttggtcgtgacggcccagcagcgcctgggtgctggttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaatgcattaacaggatttttagtggaattttcagagctctagaaataattttaaccaattaaaaatcactaaagtg

SEQ ID NO: 61754 - DNA, 23640 bp, Oryza sativa
cgctgtttttcgttgtctttgtgtgctgggccgttgttgcccgtgtaataattttatatacgcttccgcttgttaaactctgatttgtatcaacttttggtgtaccttgcctcctgggacaaggaataatacacgcacgtcaggaacgcctgttgggtgatttccggtcgtgacaattgtatcgtgcgcgcgttaattatgctcgccgaccgaagcggcgttaccgtatctccgggcgagacaaatctactcacccagattcgcgcgctgctcaattggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaattgcccacgtggcctggcaccttcggggacgtcgggcccgagggtgaggtgtccgccctcctcctgatttcccccgagggggggggttgcgcttgccccggccccgagggccgaggcaccccgaccccttaaggaagtctgcgacacatatatgggataagtgagcacagctgtgctcacctaacagcatttattgcagtctggtcaagcgtgtcacgctgcatgcgacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccagtcagacgctggtcgcgtcagcaacgggcagccacgatcccacgttgcgcctgtctccgccgggagtggaggtaggtgtgggctgtcccatcgaagtgtcattcggacagcgaccatacatctccgtccataaagagaagaaaagtccagtttggaaagggaagggtgcatgtggtatccccttgaagtataaaaggaggaccttgcccatagagaaggggttgattcttttcgagattgagagcctagaacgggggagaagtcggctcacactttgtagctccttcatacacagatccaccaaaacacaggagtagggtattacgcttctcagcggcccgaacctgtatacatcgccggtgtctcgcgttctcttgctagcagacaatctttccacaaacagagagagcttgagatctcaccctaagcccccggccgaaccggcaaaggggggcccgcgcggtctcccggtgaggagccacgagctccgtcaacatacatacatacatacatacatacatacatacatacatacatacatatatatatatatatatatatatatagacacacactttatatacatacatataaactttgtatacgtgtctatataaagtatatgcatatacatgcactgtacagagagactaaaacgtgagaaactgatcgaacggcacgcgaggggcgcgactgatcgccaatcagtgcctcccgaatcctgaggctgaatgacataagtgtgcattgtgagaattgtatccaatgtgtagctttgttctagatggcatagctttttcaagtgaagcactatggatggccttgggaggtcagtcgcccccccccccccccccttctagtctctcttacagtatacaatgtatatagtatatccatacgtgtgtgtatatatatagtaatatatttttaatgcataaaaaatatatacacacaaaatttatataggacgtatacaaattttgtatacatacgaatacaaacttagtatacatacatgttaaaaacacccggaaaaaacggaccataaaagaaacaggaaaaaaaagaaaaaaccaaccgaagagaaaaaaaaaacagaaaaaaaccaaaaaaagggaaaacccgctcctccctcatcccgcacggcacgtctaccgtcctctctctccacgcgcgacatgtgtccagtcgcgcggggaggggcgcgcgactgatcgcatatactagcaatctcgcttggagcaggtacaatagcaggctataaggcagctacaaacatattttaatgagataaaagatgagagagaagagcagcaggttacagatctgtagccagctgcagcacggacttcaagacacagtgtgtgtatgataggtgggaccatatattaatagtatagtaaagcatctattgtataaattggctattagattggctataaacgaattagagctagtagtgggctatactatactattaaacttgctcttagagagggcggcgaacttatcgcactggcacgcgaccacccgcgcatcagccagcccccacatgcattgtgtccgagcgtgacactgacaactacgtctcatgtaggggtggaaaaaaaagctcgggctcgtgagctcagctcggacttggctcgagcttggttggcttggctcagctcgtaagtcaaacaagccaagcccaagcctcctttttagctcgttgctgaaatgagccgagccgagctagctcgcgagccgcttgttttggctcgtaagcctaggccatcgtgtgtttatattgattattttactttatatagtgttattatttgtcaacttgaaatttatcattaagattttgaagaattgaatataaaaacttatttaaattttacatgttgatgatttgtttttacttttttttaataattattaaatatatatgaagaggtgtttcaacagaaaggcttgcaagccagctcgagctggctcgagccaggaaacgagccgagccgagcttaagttttagcttgtttttctaaccaagccgagccaagccaagcctagttttttgcgagccactacaagccaagccgagccaggcttgactcggctcgtttccacccctaatctcatgtatagttggccatgtgggccgcccggcacggcacggcccaggcccggccgtgcctgggccgaggcttgtcgggccggcacggcccgaccgacgcaccgggccgtgccgtgccagcccacgtgccgcactcacggcccaggaccggcccaacacgcctcgggccgtgccgggccggcccgaaggcacgatgggccgtcgtgcttttcctcagaataagtttaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactataatctcatggcatacgtacgtactcccgagtcggacatctctctgtcggccgttggttctatcccgagtcggacatctccctggcctcccggtgcatatatacgcttcgctccatataaggtacgagagagcggccgcccggcgtgatcgatcgatatcaaagtatagctagtagaacaccatggatcagaacggtgctctttcaggagctggaagatcaatctcatcaacgacaacgaagaaggccgaggcggcgtcgcggtcgccgcagcagcagcagccggatcacgacgtggaggcgatggaaccagatgcggagtgggaaatactacgcccgttgtcaccggaccctcctgagttggaggaggcgctgcgacggctagcggaagccgagcgtatcacgggcgacgagagagctgctgccgccgcccgcgcgaggcccggggagaagaggtccgtgtccgagctgccggcgggctggaagtaggagtgggacgactccgtcgcgatggccaagcgctacaagtgcaactactgggacgaccctgcgtacgatggcgtgctccaggatatcggtcctctcctggctcgtggcgccgccgtcatcaactacgccgaccgcgacccctaactaagccttgcattccttgagggaaaaaaaaacagattttctttctttctgtgtttgtttgatcaattagtttttatttgcacatgcaccgtggtgcatatatataagatgtacatttcgctaagaaatactccctccgtttcacaatgtaagtcattctagcatttcccacatttatattgatgttaaggaatctatataaatatatatgtctagatttattaacatcaatattaatttgaaaaatactaaaatgacttacattttaaaacggatgaagtagttgtcagtcgataataaaagaagtaaataactcgatggttaccgaccctctcattctcttttgcactacccctcctacaagaacatgctcagaactggctcgtggctgtttttttttctcttttctttttctagttttttttaacaaaaatatattaatataagatatatccactatataaacatgtaaaattcaaatttagatttatacatgttgtaataaaaataacaaattgtataagttaaatttgaccttgtatacaatttgcgaggtgatatatcacatattatttatcttataaaaaaatttaagtttttttatgaccatttagatggtatgtaagagaatgacggaatgtcgtctactgaaacgaccaaaaaccatctccggaagatagagattatattatgtggcaacactgaattagcacaggtcaacagtacgtgagcacgatcacaaagaagaatgttgtcaaccaacatgcatattaagtatcaatttgcaaacaccctaggcttgcccaagtaatagtctataacagagaggcaggcaggagttatcaagctaatactaataagagagcaaagtgctaaggagaagaaaccgatatctagtaggaacaaaccgaagatgaagtcaaaatagttggagctagcagaaagaggagggagggaggacgggcgaagtagaagaagatcgagtagttagcctcctttgcgaggcaaaagatgagacgggtgtcgacgcagccgggggggaggggagatgggtctcgtctgcaagttcaccatcttcaaccgcagttcggacgcccgtctcgaatgagaatcatattgcttgatcagatcgtcaatcttggcctcgctgcgttttgtggaatcaattgcagatgcccagtcccgcgtcttcttggctatttctctgttctttcttcgttcttcaacctctcgctcgatcttaacccatacggcctccatttgctggtacaccactcccagttcaattgacgccgactcccgcgcggctgacttgtcgtccgcgaccgcgacgacgacggcctcgccaccctgcgccgcgtcgccgactcccgccaccaaggcctgcggctcagcgccgacgcccacgccaccctccacaaccgctgggcgaacacgcagcggcagagccccgccaccctcgacgtcctcaacagctccctcgaccgctgggcgaacatgcagctgcagcggcagcggcggagccccgccaccctcggcgtcctcaaccgctgggcgaacacgcggcagtcgagcctggtcaccctcgaccgctgggcgaacatgcagcggcagagccccgccaccatcggccgctggcggaccacgcagcgacagcaaagcctcgccaccgcgcctgccgcgcgcctcgacgcgacgaagcggggccccgacccgaccacggactcgccaacgcggcgaacgcagacgagcaggtccttgtcgccgccgccgcaaatctgggcgtagagctcccttcgaccactgcggtctggcaccaggaagccccgaactgctgcgcccggtgagtacgcgcgcttgctgtccgtgacttccaaaacgggaagccagaatggcccgtcggtgttggcgccgatcttgggcaaccacactggagtatgaaggggtggaggaggaggaggaggagaagcgacggcaacctggctaccgtgctggcgtcctctctccacgtccacgacttcgccacgcacggcccgagagggagcagcgtgcccacctcctagtgcgtggccacgagcgacgggatggagatcgccgccgcggcgtggctgctggcgcggaccagcaatccattgggcgggatcgcgcccggcgccgcctcgtgccccagcaccatcgagctccagctcctccaggacgccgcgtcgcggttgccgtggttcccccgcgacgaggccgtggccgccgtggcgtggctgaggacgtggtggaggagcctcattccacgcggcgcggtggggaccgacccgatgaggagggcgctcgtggtcgtggaggccgccaaaccgccgcggagaagcatggcgaccaccgccctggccgtggcggttgccgaagggaagccggccgcgggcgcggcggcgtggctgtggcggagcagccgccacccatggcgcgcggcgcggctcggccgcctgttgattccgcatgttgcgtgttgcgcttgcggttgcggaggaggaaggcggttgcgaatgcggcggtgggtgggtgagggaagggcggcgattggggtaatcgtggatgggagccgtggcggaggggattttattgaccggcacgcgctgcacttgcacgagcgcgcggcggcaagcggctcgatctatcgacgaggatgagaggaatggagaggcaggtgggcccagcctctctgcttccagaagcttcgatacaaagctctgctctctgcttagcttccgctgcaagccagagccgagagggaagggaagaagaagaagaagaaggccgttgcatcgctgcttgtcgatttctctgatttatacctcgtccaatcagtagtgtacactgcacgtttccttccttggccttgccaccctaccactcgcgccttcctcgccgccgtcagcgataccttcgccgtgctcctcgccaacctgtcatccagcggtggtggtggcggcggagccactcgccgacgcgccggcgttggccatggcgtagtgccgcccgtacgtcgcgggagcggactgcgtcgcgtgcttcgacgccggccgccgcgtcgcgcctccgcgccaggtgcggcgccgccaacagcgggcgcgccatcctcgacggctgcgtcgtgaggtacgagagcgccgcctgcctcgacggcccggccacgctgcctgagaacacgcaggtgtgcaacggctccgccgacgtcgccgacggcgggttcgtggacgcagcgcgtgggctggtcggcgagctcgcggccgcggcgcctcgcgcctcgtggctcgcggcgtcccagtgagtggagactgttggggagggcgggtgcacgcagtgccaggaggtggcggcgaggaacatcgacgggcggccgccggactccgacgggcgcgccatggacgccggctgcttcatgaggttctccgacaagccgttcttcccggcgaacgcgacaatagaccgtggcggttgccaaatgggagccgaccgtcgcggcgcattgtggtggtcacgccgatgcggggaaaccagcatctccggccgcttcgctggcggcgatatcggaagggtggagccacgtcgtgcggcggcggaaacagccatcgaggcgacgagcggcatcagcgcccgttctcttcttctcctcttcccgcacgacgcggtggcgcgcgatggtaatccgcatcgagctcgggactcaggagggcaggtacgtggagagccctcggtatcgaggagccccgtggcgtcgccaccggacgaggcgcaagtcacggcgaccttcgacttcgacgtcgctgatttcgacggcatcaagcactcgctgcactctctcgtgcgggtgatttcatcagtgtggtgccgactgccgacagccacggcgtgcggctcaatgcaatctgcctatctcgccgcttgacatggcatcccgacgccggtggcgattcgtgggttcgctgcctgccttccgccgccggtggccaccccgtaacgcatagagccgccggtcacctcctcggcgcgggcgaggcggtcgcagtgcttctcctccgctacgcaacggccggcctccacgaggttcctcctgttcgggtccgggccccgcacgtcagcggctccaaggggagggcacacggtggaccaagtccaccgcggcctaggcggcgccgtggactaggagcacgggcggtccacgggcagcgcccaaaatcggcaacggagggagctgactcgccaggcgtcggcggcacacggccggacggccaccggcggcggcggcgcgacgcggcggcgaaaagaggggaaagggagaggagacggagggggtcctcaccgaggggcgccggcgacggaacgacgacggaaggcggccggcggagcccggcggagtgggggcggcggcgttccggcgacgggcggcgccaacagaggggcagccaaggggcgccgtgacgtgaggaaggtgatggatgggttaggcgagcgcagggtggccgggaaccacgaggaagggtagttggaggcaacaagcacggcgatggagctcacctcgcgcggggcagatggcgttccggctggagccaagggactcctcgtccttgcagagccgaaggaggcgacgacgcatcgcgaggtggtctgggacggcagcaggaggcggccggaggcggaaaatgcggcagcggcctaaggttggcggtggggatggtttttcggtggtggttgaagggagaggagcggctgccggggtggagctcagcatggcgatgctgacggcggcggcggcgcagcgcagcggccactagggcggtagtggtggccggctggacgcgacgggaggcagtggtggctcggatgcacggtggaatggcgttttggtggtggttttgtggatttggagtggaggccggggtggagcttgatgtggcgaagccgtcggtggaaacggtgcagcacggcggcgacgggaacggcggtggtgggcggctgaatgatgccggcaagcggcggaggttggtggcacggtggggcggctttccggtggctattggggaaaatggagcagctgccggggtgcggcaaagagcggcgaacgcgatggcgcaagcggcgcggcgcggggacagcggcagcggcggcagcggccggctggagggtcgctggtgagcggcggcgcttgggctcacgtggggagcacgggagagggcgcgatgagctcggggaggaagggtaaacgaaagaggagagcacggggaggctttttatagagcgagggagcaacggggaggccggggagtggcgaatttggagcggcaacggccggcgacgtgggtgacatcgtgggcgaagtggagctcgatcccggcgcgattttctggggaaacgtggggagagtgttgagcaggtggaggggaaccgatttcactcggtttgggcgcgagggcacgagtgggagggctggaatcggcggcgacgtgggcggcaacaggcggcatggcggcttcgggcggttgctggccgggatggaggaaggttcgggatggacctgacaagtgggtcccgcagtcccacttgtcggcctgagggagagagggagcagggggttatttagacttcaagggcgagcgggccgagggggggagatagaggcccgagagggggaggggcgcgcgggccgcgggggaggggaaggattcttgggccgaaaatggcccaaggaggaggggagtttttaatttgtttcctttttatttaattgattcaatgaactttgtactattaaaattacttcttgagctccgaaaattcacggaaaattccggagagtatattagggcacaaaaaatattacaaaatattcttggccaatgatttttaaaggaaattttaatttcctccataatttcacttgattaaattgatttatcttttatttaatttctagacaatgcaatattaaatgatttttaatcccgaccgaaaatcggggcattacagctgtgaatgccctcacagtgcaagtagctctcccagtgaggttcgcaggttactggctgtgttgggtgggctccacgagccaacattttgatgtggttcacgtggccttgcgaagacccgagaggcatagcagaggtggggcccgcgtcacatgtagtgctcggggaaatgtttgttttggagcaacaagtgttagccacaagtaaaatcaacttgaacatgtggctcataggattttaccgttgcaattatcacctcatgagctatctctaccctgacatgataatctacaaggttctcatgagaacacaaaagttcatcatgtgtttcttgtaaatccatatacttgttagtgatctcaccaagtttggaatttggagcacataaaaaaccaatgtcatctcggtaacatgtatcgatattgatttatcttgtatttaaccttgtgtaggttgtattgtattctcatagcatttaagaatttacattccttgcatatgtgaaagtcatcatttatgcatttttgagcaagataggttgtggcatacgagtgtttagtactcaatcatattcatgcatatcacatccctcatatgtgctcaagttggctaagtgctagttggtaatttcaaaataaaccatttagccaaaagtgaaaattttgaacaagtatagcttttctatgagaatatatttggaaatgattttaaagtatgtttgaaatgtctctcaatacttttgtatttcaaagaagagctaattttcaaagaaaatgaattcaacaaaaatgtagctctaagtatcttgttttagcttttaacttaaatgttttgtatacttaattctaaaaggaatttgtgaatggtttcaaaatgaaaaagatagtttggctaattcaaacatttttggtattcaaaatttctccaagaagccaatcaatcaaaagaaatttaaatctcaatcttatccaaaacattatcttgaccataaacggccacctactagcacttagatgagttctcattgttgggttgcataaatgcatcattctagctcaaatgggtacataagattcattcatactcatttctctccaaaaccatctcatttgcttcttttcgcttttttagagaaaggtatttgagaagagagcttttgtagtcttttgtaaaaaaaaatggcctttactatcaaatcttgaattcatggagcaaaaatgagggatgcatcaatggggagcaatctgaatcaaatccatattcctcttgctctcaaatttgaattttccgaaaagttgcatctatagtctttcaaaagagcctattttggtcaaaagtcaaaaatcttatttaaatagcccaaatttgtgaaaatcctttcaaaagtatcctaatatgtatttcaaatgttttgcaaggcttttgaagtaaaaattttcatttgtgaaacaaaatagcaaaattggtctcaatagtatcttttatgatcttgtttttgctcaaaatgatctatctccctaaatcaaaatctattgcattttttaaaatatttctaatataaaagtttgagggttggtcattccaaacatttctctaattcaaagtttccccaaaagaccaattattcaaactctataaccttttgagtttcagccaaaaccttgacttgaccatttttgccaaaacttgcatatggtgtgttaagccttttgagccaaagttctttgtgagtcttggcttagaagtgtttctataaccctcctaaggtcttacaaatgtcaaactccacagatttaaaatttgaatgtgatttgaactctcaactcaaattttatcaatctaaaggcctacaatgctccttttgtattttcttttgatagaaaaaagatttttaagaaattctttttggaaaagttactcacaagtataaagatcataactgcacggcttcaactcatttggatttgatttgaaattattttgactttttctctttttgctcagcttactgaaattttcagaacaagggctgatttgtgatttttgtatctccaaatagattgcaaatttggaagagatcaccatatgacttttgttcctctgtagttgagctcgattgccaaatttacccagaatagttagaggtcatttgggtgctttttcaatgttgttttataagctaatatggagttatcaaaaatctgaaaaatctgaaacttccagtttattgaaactttgagatgtttttatctataaatgggatgcaaactagaagtaacttacataacaacttttgatcctcaatagttgaagtttacttccaaatttactcaaaattttcagtggtcatttggatgccttttcaactccttttcagtctcaaaagtctgaaaaaaatcagaatgttttagttggctgaaagattttgagcttcatttctacatttcggttgagatctaggaaatggtcccaaaataaaacttgtgtattctttcatgatctagctccagaatttatggcatatttttttgatctcgtttccacatgtttccattgccaaaagttgccacctttgctatatgcttttcagcaaaacatggattcaagtgcatatcacttcttgttgattatttgagcatggtggtgaaatataagatatttcaagtaatgagacctttctttttagaaaaacttcatgaattcttgaactcttttggatgtgttccttgcttgaactcttttggtttttgaaatgcccatgatatatgaatccaccgaaactcaaaagtcatttttatacttttcagaaccaagcctccatgggtagactccaaattctaatctttgccaccaaatacaagttgatccttgctatcaaagccaactaccatttcttgattccaaatttacacttgcatacacaagtagtgtccatataaaatggtagtatcttttgatcatcttgaactcggtatttactaatctttgtcattccattaccgggattacacacttgaccaaaaatctctcaagtatctttgatcaaactcctctcacagagaaaataattgatgagtacatttcgagagaaagttcaaatgctcacaatcactccctcctacaaataaaatccattctaattcttcttatctaagtgacaagactccgagagtaagggggagcatttcttacatggatcttttctcaaatttttgctttgcactttcatctaatttttttatttggtcttatgaatgtttgttcttgttttgcttgagcaaaattgtttctctttcggttccatgcaaatctttttgtgattaatgccaaaagggggagaatatttgaggatcccatgtttgatatgatcgttgatatacagggggaaaatattctaggatcccacaattggtgcatatcatcacttatcaaagcatccagcatgcactatatgcacaagcatcgcatgcatagcatacaacatgcaccatatgcacaagcatcacatgcatggatataaatcaattgccattttctcatatcatgttgatatcatgttaatttatatcattgatttcacccttcatatccaaatgtggtcattattaatggatttgtcgtaaatcaccaaaaagggggagattgaaagttcaagtgccattaatttggttttggtgattaatgacaaatccaattacacgagactaacattgttataagcatatctttatctactagtctcatatatgaatatatgaaagtggaatacattagtgagataagagaacaaacaccaccagccgacatttctgctcctcaaagaactccatcacctccagcacatcccacttacaaaccgagggtatgcatttattttctatctattgctccaatcctttatgccgattctcaacttgtactattgtagaaaaagaagctagcttccaagaaaccaagagcactagccccatcggtaaactaaacttgaaatctttctttttaagtttccaaataactgatgctaatccaaacttatttcttttcagcctcctcgttctccaactcctattcctcatgaatcaagcgaacgcactccatcagctgcaggtagccatcatgtggaggaagaagtagcaccagcccctgccatccctgtaagtgcctcttttgaatccacaaatcatatcggctatcatgttacttctactaatcagtaacctcaatattcccctttttcatgttctagccgatatgttttcttttgacatcaggtagtttatggatgaagaggaagaaactacaagtaaagccttggtgcctctagccgataatgtgaaaacaaccttgctggatatctcaaagtggcttgaaggctccctagaaactctggtggtcagttgtggatcaatcagagatagattccttgtaatctacgaccaactcccagatgaactagccgatgttatcaccccagcggcatacctcgaacagcatcagctcaagcttgaaaaggctaaacaaagggttgctgatcgccgtgaaagaaaagatcttgaggccaccatccaggctagtaggacttctattaatgaagaaaaggcaaaacttgatgagttggaagctggtccaaggtccactcaagccaacatagatcggctgaatactcggaagatagaactcctagccgaattggagcagtgcaatgcacatattgctattgaagaacataaacttgccgatctgcccaaagctactgaggatcagagatcatagctcaaatcttctgtcaaacatctagctgatctaatcaagtccctgaaagtaattcttggatctgatgcagtcgatacccagatcattgatgaggtagaacagattaggcaacgaattatatcggctatccaaaaatatgtatgtggatgagctaaacatgtaacatgtgaatgtatttagtttgttaccaaacattgttaatgcctagagaattttgacaacaacatatttagtctatcgctctatcctatcaaaatttagtaatattgtcaacttgacaaaattttggtattgctaaaatttgaaaaatgtttattttggcagtataatactctctccatctacttttgatagttatattttcaaatttgaaaaatttatttttgataggcatatttcaatccaacaacttatcatcttaatgactttctcagatttaatgcatgactctccattcttccacacaagattggttgcatgggcatcgagaaatgtaaatattaatgaatcgcttgtttacgagaaatgactagtagcatgtttaaatggatgataagtagaattatttatccttgatctgtgtgtcaagataaaatatgactatcaaaagcagatggaggaggagtaataagaaggctaaaaaaaaattggtgtctaaacggggaagatgcattcttaatggcagcaatcccccacgtcgacacgcagcccaagcgaccgtggccctccaggccccgactcccgagcacgagtatgcggcaacgagccggacaccagcaccacccaccaccgtggagcccaaccgaacccgaaacccactctccccactacaatcccacaaaacacagagaatatcaccgaggcgaacgaaaccgaaaagaaagcgaaaccccgatcccccaaaccctagcgcgtactagccccccgggcaaatcgccggcggcgatggcgatggacgcggagcggcggcaggcggagctgatcgagcagttttccgcgcaggcggccgccctctccttgtcggcgccgcagctgtcggcgctcgtgctagaggccacctcccacccggcccttttcgccttctccgagctcctttccctccccgccctctccaaggtataagggaccccccgcctctcgctccgcctgcgccccgccgcgccgcgcgtgtttagggttagggttttgggggtggaccacctctcctcccccctctgatttcgatctaatgtcagttcgttgatgcagctcactggaacgcagtatgcgtcgtctctggacgtgctccgcctcttcgcctatgggacattgaaggactacaagagtaagatcaccccctcccgttgcgattcgtacattacattgcccttatgtatgtgttgtcatgcgtcatatgtgtatgcttatttggtgcgtgagtctagtgcattgtcttgttgttgtgtgttaggggtacgccctatgaaatagccgcttaccatggacgcgattggcatgtgagggccatagcccatatgtttaatggttaacaatagtgctgatttgtgttaatgttaattcacactttttttttgtgttatattgttataggttaattttttgatgggattcacatactaattaatcataattcatctttgtcttatggtttatattctgcaacaatatgtggatagaattatcacatttctgtgcttgaaatcataatttgagctgtgacaatcaatttgccttttcacccaccaatatgatcagtgtgtgtcaggctgtggttgctagaattttgttgtttcctctctcatcggcatgtcattaaaacggtctgcagtttgtggtattctctgtttatagtaatatcagataagtgcagaacatgaacatttactgtttcattaattgtttttaattttcatacatgtaggtaattctggcaatctccctgcattgttacctgatcaagtccggaagctgaagcaactcagcgtgctaactttggctgagtcaaccaaggtgcaaatttaggctgatactgtctaatatgctatgcatttttttttttgcttatcctgtgtacataaagttactaagggagcgtttagatccttggcaatggggattttagccttgcatagcaaggggagttatcatttggtagtaaaagaaaacaaatctaactttctctgtcaatctagcttaacaattgtcagaaaaaacttgctgtcaaaggagagaaaaaatggccccatcttcatcgacaagcatgtgagcatgaactgttgatggcaccaaatatcgtgcctcgctgccttgcttatgtgggccatagatgaaatgagcaggtttatgccaggctgagcaaagataatttaagatccaaatgtatcctcacagttgtttcatcaaataatagctggtctgcatgtttattatctaggtttttcattcttctttctttacgtatgatgggaaatagttctatgcagttatatgtgttaagtgatagtgattctctgaacagataacaaccaatgccagaaacaagcttcttccatcctattatgtgtgcccaatttagctttacactatctgtgaatactatcttattctttatgtgcatagcctgtttgagtgtgcactggaagtcaagttcatgtagtattatcttttaccttaaaactctgttctatgtttttgctttagacaatactaaatgtgcttggtttttattatcatttctattcaggtgctaccatatgatcaactcatgcaagaattggatgtttccaatgtaagagaactcgaagatttcctcatcaatgagtgcatgtactcggtgagaatttttttgccttaggcacttaaatctctattttccatcttctaacctccctaacaaaaaccatgtcattacaaatatatcttgtgtggattattgctcttgtaagctctctagcctttaggatcatcggtttgtttcttgaacttttacaccatagatgctagtattctagtcaaatattaacgtttaattgcttccctagggtattgtcaggggcaaattggatcagctgcggaggtgttttgaggtcagatgcttgttcttacaagtacattgttcatggtttcattgtttagctggcaaatgatccccctaaattctgtctgtacttgacaggtacaatttgcaactggaagggatcttacacctgatcagctgaacaatatgatagatacattatctgactggtgtgtacctttacttgagtgattgttgcatcccatccctattttttgttcacagaagttttaatgtttgcatttatatatggttctccctcatatctgatatgaccttctgaaagatacattgaggtcatgtgttatgggaactgcggctgggttattttgctatgtttatttgttctagactccatgtgtgttgtcccttcaggctactattgtagatggtatggttttggttgttttttgtagttgggtgctgtagggataatgtgaaattgtgtcttctcttgccaacccactctgtctgccttttaacctttttaagttttaattatacactatccattgtttttattgtcagttcatagctttatgttttaaatcatatagaagtgtttccttgaatttgttaaaagatgaataacctctgaggtttttcatttagacaatagtgtatatgcatcatttggtgctgatattgtgcttttgacatttcacaagtaatcagtttatatgctcgtgctttgacatttttactcggtccattttatgttgaagcattatgaggtgcatgttaacgggaccaatggaagtttattggtaccaactcatgctgatgtaaattgcacaggctggaacatcggataatttattgcatcagattcaggagaaaattaagtgggctgatacaatgagtgaagtgaacaagaagcaccagaaagagttcgaagacaaggtagaagaagccaaaaaatcaatcaaggtgagttggatcaatttgaagcaccaactatactgtagtttttcagatattgaatgatgaacagtaaaaaaggaaaaaaaacttgcatctgttttgttttttctagcgaacatcaggcttttgcataattcttatgatgtttttctatgttcctcattcttctgatgacctgttgacccatgtccatttactgtcatgtgttccattctgattttagtattaaatgcttttaagtattcatatagtattaaatagtggaattgccggaccatgtttcttacttgatggcagaagttgaacaatttaagcaggcagacatcgacttacgggggcatgacgactttctctctgaacctggaggaataatggattttgaagaggaccgcatccgaccaaaaaggtaatatattttttctctctcttgtgggtttggatttgcttaccttacataatatttttaaattttgtttagtatagcctgttaaaaatgtaaggcagtttgctgtcaagttgttagggacagctatcagagttatgttgtcaagcaacttttactagtgaaacaattggtggtgttaatggaaccgcagttgtagttcgtagccttatttggctaaggattgcctagtaaccttcagctatttttaaattggttgtcaacatgtttaataatacggatgtatctttaccttgtggtgtatacaatgcttttcattgtataaaattgctctattaccacagctacgaataattttttaaaatctgattgcaggaggcgacaaccaatggcatagtttcaatggcatacttacctgcctccccacttgtggaagtgctgacgccctaccttgagacattttggcaccagagctgaggaaacttccccacatcaatttatttatggtgcttccttttgaagcgagtatccgttatcattgtctcttctggagaaaatattcgttttggtacgagatgtacaaggttgacacttaccgtagcatttgtttgctggtaaaaaaaaatacaggtggctggcttagcgttgtaaagatcatggttctgaaagtattttttggtgacttaaagttcgctctgtttgcattttggctgtgtttgtagctgtgattcatcagccacgctcatcaagttgaaacttgaaagctatcaacttacgaaattattttataggaattagttcatatcctacggtcatctggaagaactgccgtattgtaaaggagccctaaattgttttgggtcgtacttagcaaatgattttaactattaattcatatgatcctttggacaccacaagttttatcgaccttgttgaatggtgcctcatgcttccagatccacgttccagcttggaatgtgaggcctactcttgtaaaaagaacaaccttaaaatgcccaggattgtctgagagtctgataaaatgctaggttgtctacggacatgttgaaacattagagtcgttaatttggctacacaaaattgaaagcatgaaaatactgtaggatttggtggtaaggcagacagaaaactgtgatatttacaaatattggtttcactgagaactaaaccacccacacgcgtacagaaatagtcaaggttgtccatctaaaaaagggaaaacaaattgtcctctcaaaagaaaaaaaaggttgtcccctaaaaaaccaaggctatcactaacatgatgttgacatcactcattgcttgcagttactgaggttagcatagctgcttgggtaaaatttgctgccatctactctgcaacaagagagcaattttggttaagtggtttaaaaaaaaaggctgcagacttgatctgcacatctaggtgttgagacaaaattcaggtttgcacattctatacttataatatacccatgcagtgtaattcacatattgaatacgaaacctacatcacatttcacgccacagaacggcagacatgtagttgaagtgtgcactatgttgtgctcacatagacagtaaaaatgcacagctcctgaatcagtgatcacagtccaccagttttagctcacacttaaatactgaaatcagtgatactaaccatgctgaaagtgcattgactaaatacatcaagctaattttttaatgtcaaagttgaatccagtgagaatccaaatgaaattttatgctcatggttcacataaatcataaacactgcagtttatgagattcacttttctccaataaagagtgaaagaacaaagatctaaagcagccactttcataaattatggaagggcacatcaatgttaaattcaatttgcattgttggtaaaagaaactatgctacactatgctaaccacacaagattatgtatctgatccaagcaaatataagtaacagaaagaggcatacattcagaactctgatttcacttgtcttctttattcccgctatgatcagcaatcatcttctccttggtattaatgcgcaactggacacttccaacctgattcatttggctttcatagtatttcttcctcttcaagcactgcattgctgcttgcttatttcctgattttgtgaactccttggcacgttccatctcctgagagatcttcttttgcagaactgcctcttttgccacgaagacatcacgggcctatagagccatagtaacataagcaattaactcacaaggtaataaaacgatgcgttcatagagttgccaacagtcctgaatatcatacaattgtttagctaagtaaaacactttcagattatttagctcagaaaggcaaaaataaaaacaaaacgagataaaggggaaatagctcttaaaaaaccagagctttgccctgtttttttaattcagcagtcaagcaggcacaaatgcagcaacttactgaacttaccctatttatgtaacttaaaagggaaaagaaacagcaatttcaaagagacctttttttttcccatcaacagtagtaagcctaacaaatccatggcaggtgctaccccccttttttcttaatcctcttatttgaatatgaacatgaaagttgcattcaaagggtgtttccctttaatttcttactgtgcttttcacattataatttggcatcgctactaaagcccacattgacactaaaagcaccccaaaaccagcatctgtttttctctttcacaactccctgcatcagcaacaggtgagaaaaaaaaaacataatttgatctaaccaaaagaactagtaattcaattaacagatactacatccattcagtgccatcaggaggcctcggtaggagggtagggcactaggcagcaactggggtctgaaccatgaacaactcgcattgtacgcccgcgatacagagtcctagaagatcactgtggacaagaaagtcatgaacaccactgaagaaaaaaaaaaaagaaaaacacacgaatcgctcgctccatctcctcctcccaccgggggcgcagggacgaaacaagcacgcactcatcgattcacccactgggggcatgacaaaccgtagcatctccctctcttgagtcgacaaacgcaaaaaaaaaaaaaaaaaaaaaaaaaaaaaaaaaaacgcattccgcccccttttctttttgctcactatcgcattcaaattggtgggagagaagattcttgggggatgagatgggagaggaaggagacggacctgcttgagctggtcggaggcggagcactcgtcgcggcagccgcggaggagccaggcgaacatcaccgcggaatcgctcgccggcggcggcagcggctactggcaggaggagagagagagagagagagagaaagatggtggggagcaacggcaacggcaacggccgaggaggaaaggggaaaaattagagcaggaaaaataaaggaaaaagcatatggggatggcaagtgggcctctccgttttgatttttttaagagataatccattatatgccactgactttgtcgcacgtctacgatttgccactgactttgtcacgttctacaatatgccatcgacttttgcttaacttctacgatttaccatcaccgtccggttagccaccgttagtactgtacaaatttgtcgaaatgaccaaaataccatatgacaaaaacttccaaaatttggataaaattatcaaaatattatattataaacataagattgtaaacatccaaaatttgaccaaaaacttgaaatatgatatttcataatttttatccaaattttgaaaccttttctcccaggggtattttggtcattttgacaaatttgtacagtactaacggagactaaccggacggcgatgataaattgtagaagttaagcaaaagtcgatggcatattgtagaacatgataaagtcagtggcaaatcgtagacgtgtgataaagtcagtggtaaataattgattctctctttttttaaagtgaatt

SEQ ID NO: 61755 - DNA, 1559 bp, Oryza sativa
ttcaaaatcttttagtcaaacttccaactttttcgtcacatcaaatatttggatatatgcatggagcattaaatgtggacgaaaaaaaaccaattatacaatttgcatgtaaattgcgagacgaatcttttgagcctaattacaccatcatttgataatataatgctatactagccatttactactaatagattaattagatttaataaattcgtttgcagtttagaacggaatctgtagtttaacacagcctcagtcggtttactgatttctctgaacctctctctcctcttctccctcgtgtggactctcctcttctctctctcctctctctctcgcgcgcgcgtcgcagccatggtggaggcgacgcggcagcggaggaagccgctggtgctggcctccacgcaggcgctgctcgactcgctgccgggggaccgccgcgggtcggcccttccgccgccgccgccgccggagccggtgcgcatcagggccggggtgctccgcttccccaactcctcctcctcctcgtcttccgcgggcggaggcgagttcggggaggccgcctccttcgtcgccctcccctcgtccgcgctccgccggctcgccgtcgtcaccggcacgccggtaagtggactggtcccctccccgcgccttctcggatcaaatatcccattatctcgtctcagttagatcgttatgattgagtaattcggtggaaaatctggtcagtgaattggattttagtcgattttggatggtcacatatggggtttacctgtacactgttctgaattctgattagttggatgggaattgatgattagcttagccaaattgagctgtaataagtacaatggcaagtgatgcatagagcaatggtgctacaaaatttacctttgtgagcatacgattgcatttatgttacacttgattcaggcaatctaaatgatgatagaagtgcgctagtgtatactcctagcataaggttgggcagtatataggaatctattgtgctgaaagtaataaagggctttcaatctgcaggtgcttgtgaagaatgctgacaataatgtcggaaggattgccaaagcagtagtacttgatcacccatgccttgatgattccctgacagaacatactgagcctgtggacgcagcctctcccttggataatgccatgggtatcttaccctgtcgctcttttccaacaaacggctttccgcccttggatgaagaggtcgcttatgttagcccacttctggcattcaatctgggagtccatgtctcttgtctcaagcttcttgttcaaaaaggagagaaacctttcaagttctgttctaaagttgaagatagtgatctggctgctggtgaagaaagtaatcctattcttcacttagagattcttccatcccctcaagtgccgaaacatgctttgcatttgcgggtttctgttgtgaggattcctgaatgtggtgtgtttgcttctctaaaggcaaattcagccatggaggaagtgactaccaagatatgattgatcaagctctgaatgagcactttaag

SEQ ID NO: 61756 - DNA, 7709 bp, Oryza sativa
acaataatctctacatggcagtagccatatgttatcccggttgttttgaccattcaaatgtttgctttctaggcctcctttggaggacttcttgtgggatctgtgcaaatttcatatttgctacagcaatcatgtattccaaaaggaagctcaatccatacagtagacatcagaactagaaattttacaggagttccacgtgaagtctaagggcttgtttggcacagctccagctccacccctcctggagctggagctcggtcaaatagtttcagctccaccaaaactaggagtggagtaaactaggagtggagttgggtggagctctctcacaaaataaactagagtcatttccacaactccactccagacccaatttctggaactaaatttaggagttggagctataccaaacagaccctaaattctcacaaaattgcactcgctcctgctccggctctggctccggatctcctccccctcgccgccttcctccaatcgagggcgcttgctgcgcgcgccgtcgtgaccaccagaggagctgcgccatctgctcgtgcggcccttgcccgggatctcaatccctcagatgggccaaccctaaggccctgtttgtttaggcttatgtttagctgggcttttctagttaggacttattttcttcctggctttaaaagtagctgtttggtggatggcttactattgaatggtaaaaaacacccatcaggtttgggtttcttgtttacaagccgaggacattgtaggagtaattttctcacgtaataatattacttttttttcttgatgtatcgcttttaacactttaattgtttccttatttttaatatatacgaattagagatacaaataaatatccgttcctaaatccgattgaggaataatatgggatagatacgagatgagtgacatgttacctggcaccgtccgtaccaggttccaaatttgaagaaaaatatgttaggatatgggaatatcgtgatccgaccgaacccgcccgttttcacccataccattaccttggcagtagtatattagtgaaataatacaatcacaaatatttcatgataatatacaagtaaaataatataagcacatatccttcttctgtaaaaaaaaactggatgtttttaaggtttctcaccaaaattagtaactactaaaaatgatttaccccatgattcaggtgtcattttaataagtgtatatatacactcaggtactggagaatatttactgattgcaaaaggtaatgaatgctttcacagcttgttgccacatggtacatgacttacacattgcgccatggccataaaaattagggataagtccatttttcacccttcaactcttcgctttatcttaaaagggttaattggaatcattccattgcaacttcggctatttggaaatatgccattataattagcgaaaccggctaggtgccatcgcaatttcttccaaattggaaccatgccattatgtacgtctgaatcgccatccatgccgtttgtcctcgtacgtatttccgtatggacgcttgtgcccctggctgagacgatacaagccagccagccatcccggtccggcttaaccatctctgttccccattccccattgtctgcaaaccctagctcgccgacggcgatctcgacggcgacgacgacccacgatgtagaagttcccctgaagatcgcaagctcccctacgacatcatcgtgcgcagcgaaattgccgatggaggggatggatctgggaggctcgattcctcctatttcgtcgataccatgagtaacttgaactcgaatatactccttggatatctaaagtagaagtgcattgggtatttcatcgtatttacatgtagattttcagttgatgttctctcctttcatggtaggcactggttttcagtagaggttagggttggtgcttatgtcacgatagaaacagagcgaccaccgccactggtatagctcgcctccatcgccgcctccaacctcgttgccacgttgatccatctgcgccgggagaagctatcggtacagctgccgccgtatccctagcccccgtcgtcgtcgccggcgccgtatccctagcccccgtcgttgtcaccggcgctgcaccaaacgccgccgagatctctatcggcgagctagggtttgcagacaatggggaatagggaatggggaatggggaacagagatggttaagccggaccgggatggctggcttgtatcgtctcagccaggggcacaagcgtccatatagaaatacgtacaaggacaaatggcatggatggtgattcagacgtacataatggcatggttccaatttggaagaaattgcgatggcacctagccgatttcactaattgtaatggcatatttccaaatagctgaagttgcaatgacatggttccaattaaccctatttaaaatacaccagagcatttctagcagggaccctaaatatagcccctaaacagattttgggtgttgaggcttaaaaaactcaatccagcagagcccctatcaaggatcctaaattaggcaggcacccaaataacctttccaagcccccaggggctctactgcacagcccccatccacggttggaaaagcgcgggagctgcccgacgtggtcttggtccgtcggcacctcccctgcccagtgcggcagtgcttatccccggccggtgcggctcctccctgcctaccgtgtcctccttcaggtgccctcctctacccgacgctcctccccggccgacgcgtttgccgtgcctggagtctcctccagcctgcactctccacctgaactcgatgaaaaacatggcccagtgaccgagtcatgcgatggcgtcaaggcactggatggtccaagtgctgctgcgggctgcgaaattgagacagtagtagcagggtagcactagcaactgcgattgtgggacgaaagaagaatggggaaagtgatacatgcgatgtgctatgcagcttttttgttgctttgcttggttgttgcttcgtgagagaagtagcaggtctattggtggatgagaggacaggaaaaatcagcacatgtgagaaactgcatggaagcgcgacagcagcagaagctcgtttcacccgagctatgaatacaggctactaggatttgtatttccattttaatttttttttaaaaaatcgaatttgaattgtgatgttttgaattgtgaatttaaatatggttggattattatggttttatactaggagtagcgtagagtatataactatagattagtactttaaagtatatgttaaaatagaagatgaaatgaaataaggggtgagaaaagggactgttgttggagttaaaaggtattttttaggtactcagaaaatggggaagcccccattatacttttaggggttgtaaaataggagctattgctggagatgatattttacactctcaaactttctatactgtgtagattatcccctttgacggtttctagcatggtttttgcaattaattatggggatatgcaatacagggaagaaatcgtacgaattcatcagttatttaatttattgatgtgtttcgctgtgcaattgcacgccgctggaacagctagatgacggagcgcgctgcgagcaggtcggcgacgatacgtgcgcgtgacgagccgtgatcagcggtcggcaagcggtttcgccatagatggtccgtgcgtggatgatggatcggtggtgctctagaggcggccgagaagtgcctcgtgtgctagcttctgatcatcgatcctggcgtcctgcggcggccatggctgttcaacgttcgccggcggcgcgcggggcggcatcgacggcgaccagtcgaccaccatggcagcggcaccgacgtccgcattccgcccagcgcgcgtgctcctcctatgtggcgcgcgcgcaccacaccgtcctgagagtgaaaacggtcggaaataattaatcatatttatcatttaaactgtacggggccaccattaatacgatgcagaaagaaattaaaaaatcagaatatataaatagccaataatgttgcggtcggaaacgataacctttatatggaaatggggtgctcgatcgattgggaattttcttgacctttttcaccccactgcagatcgattcgagggaggttggggaggctacctacctccgctagttgccagtggaaggaaatcccaggctcgaggtggaaatggagcttgtggaagggtcgacggcagcaatgtaggaatcgtagttagccagcagtttttcccgccggcgagcccctgcaaagttgcgcatttaccgtataaaggtcggtgtcagatgacaccgatgactttcggtaaaacctatgagaatttttacggtacaatatactatcattatatactaccaatatataaaagggtatattcggaacttaaaaaaaattgaataagggatttttagtaattcgtcagatctgatggggagcaggggcggatccaacgtgagtgcaggggggttcgagtccccctgcacccacaagatctatggatacccctggagcacccccttcaattttttcaccatgaatgataaattaaaggtccttatatggctggagattgaagaaactgtgtaattgagcactctcaattttttgtttctatatctgccccctgatggggagtaatcggtcttggatctcatcatgcatcgcgagcgcgattagattatggcgcgtgtggcggctgcatggtttgatgagcaacgagaagccgaggagacgctggacgcaggccccaagcattcgcggtggcctgtggcctgccttccggctgagcctcaccggccacggcaagaaactgcgacgagctgattcatagtgtacattgagcgatcttgttagttcaatgtagattctactcaaaattgttggctagtacggacaacgtgaggcaaataaatcaggtactgatttagtgctcttgggcttgtcttgcgttcagtaccagatcggcagatgaacatggaagttcataaaaccgactgtgtacattgcccttacaattttatactggaatctcattaagtggggaggagaatgaatctacaccattggatcatttatgctagcagtgtatactggcagtatagtgtaccgtctaaacataattagcatactatgacatcgataaatacgttatgacaccaacgaatcgattttctatatccgccaccactgcaaacctcacacaaacgctacagcgtaacaacttgcttttctgatgcattatatatatcccctctacttaaaggaaattacatgcaatgcgcgcgagccgcgcacgactgaactcctgctgtcctgcacttgccgcgcagacccacgactcaaaaaagaaaagatgccaccgcatgaactcggatacttaggcctatagctgtgcacatgaacgtgttcgtgcagatcctaagaaggatactgtggtacatagcgtgactcgcctgaaatatgtcaacaattctcagtacgggcccacctctgacggtccacaaactatgagccaaagtgctcaaggatgttcacagctttgatgaatccattgagagatcgtaacaggtgaagccaccggccgaggctcgtcccaggtatctagacacatgtgacgggccggcacccacacctaccagaaggatacctctgtcaggtgccagtgcaagcccatcacaggtgaccaaatacctgtgacgagcctcgcaattacgtctcgtttgaggtgagtataactcatatctaacgggcttaaaccctaacccgttggagttgtcttgtcgtctataaatacccccaaccactatatgtttttcatcccaatcctacgcactgttcacattttgggcgggagaataaggggggtgaatttttgttgcaagaaaacgtgtgataattatttgatgacgaatattatgtattttgtctgatacttgtcatcttattgtttgcagatggaccaaagttggatgtacggtattgatagttggtcccaagagtatagggatggggtcgctgaattcctaagaattgtagataatgataggataattaggatgagcgaatattagaggatgttctctgatagttcatgggtgcattctgtaacatcctgaaaattcctgacattaaaaatcactaaaatttcaaactttttaaaactttttgcatcatgctggaagttatggttgttattgcttgccaaaccataaatcgacgcaatggaaaaaaaatcaatctaaagatttacacccgagcaatagttacgatttacaacgatacgatatttattatcaatcccataaatatttatgcacatggaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatataagtacacatgaaatgatgatcacatcaatggccccatctataatagagtatctcactagaatatataattaatatttgaaacaccttatcaagctcctcatagcatgaaaatcactcatataaaataatggtcatataaataaattaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaatttttgatttaaacctcatttaaataatacaataggaaaatatataaaatatgggtaatattaaattttggtcaactttcatctaaaataaaacatatattgggtaaaactctaattgtgtgaaatctagaaattatgggacaagttttaataggaaataggcctcaaaagtggataattaggaaaaagtcactgttcattatggcctaggtgtttgatgtggttccctagcccttcccccctccactgccgcgctccccctcgcgccccgtgcccctgcacgcgccgcgccgcgccgctgccgcccactgctgcgcgccgcctcgcgccccgcgccgctctcgccgccgcgcgccgtcgcgccgcctcgcgccccgcgcgccgtcaccgtcgccgtcacgttgccatcaacaccgcgccgcgcgccgtcgacatcgccgtcgcatcgtcatgatcgcctgtcaccgtcggctgcgcagcgccgagccccgcgccactcccgtcgccgcgttgcgtcgcccgtcgcgtcgccatcgccatgcgccgcgagccgtagccgtcggccttgcaccccgagccgccgcacgcccgtcctctcgctgcctcgcgcctgcgccccgccgcgcggccgtcctgtcgccgtcgccctgagccgctgccgcgccccgagccccgtgccgctaccacgccttcgcgtcaccgccgtcgccatcagcgcctcgagcccgcccgcgccggcactgtcgccgttgcgccgcgtcgtcccgccgccgcacgtc

SEQ ID NO: 61757 - DNA, 1296 bp, Oryza sativa
gtggatccccccttttgtggattttcagctcttaattcaaaattggagtgttagaaatagatgatttaaagaagagacatgacgattataccttgcaaaacatacctgcttgcgttaatgggcctactggactggactcaatcctagtgcaccaaagaaaagatttagccatttataagggcttatttttaccgaaaatcaagaccttcatcaatagtcatacactactccctctatttttaaatatagaaaaaaagttcatttcactctcccgaactatttcattggatcacttaaccccctaaattatttttttcttatttcacccccaaactattagaaatggttcatcttaatccttaattaacagtatctatcaatcctacaaattaaattccattacaaaatatgacttataaagcgaggaaaaaaggagatgccattaaagattaagatgaaccgttttcaatagttcagagtgtaaaatgagctgagaaattgtttaggggttaagtgccctggcgaaatagttcgagtgagtaaaatagactattttcttaaataaatgatgatgttgaccattcatattgtataaaaaaatgtagcatcacttattttgttgtgattttgtttatcatcaaagatattttaagtatgacttgcattttgcatatttgcactaagttcttaatacaataaatgaccatgctcaaatattgacaacgcgatgtaattaaaaactaaaaaaacggagatactagtactcctatgtcatataaaaaattttaataatagctataaatctgaatatgtgtagattaaattttttatgggacgcagggtgtaaattggatattatatagttgaaatatctagtactaacacacatacacccatctgatcaaagagtagatatatctgttcatttccaatacataaaaaaaaaagaagagaaattggtccatatatctccaagctagcatttcgtagcttctagctagcatgatcacttcaccgatagctagacggatggatggaacccatccgtatgaacatgacggggcaggtgagaagagatgggatcgatcgtcgtcgtcgtcgcttgctcgaagccgctctgcgctattcatccccgttcatcagttcaggtcacagacgacgacgacgacgacggcgaggaggagaacatttatgggcgggtgatgtgtgcaccgaaactgggttatgccttgcaatttattgcaagcgctagcagtacgctcgcctacgtcctcctcctcctactgccgccgctag

SEQ ID NO: 61758 - DNA, 3766 bp, Oryza sativa
ttttgagaggatgtggttttggaagatttatattgagtaaagagagtgtggatgacttgatatgcaacttgaaaattgttctgaaggaatgtgcgtcaggcaaggcttacatagggaaatctcgcggcacaccactgatggcgataaagatgtcaactgcagttacagagaaatggaaagacatgcttgggaatgaaatagctgtccaatctagaattaagcacatgaatgttgccaagcttatcggttactgcttagatcattcggatggtacagtgcttatatacgagtacggtgcaattagcttgtatgatgttctttttggtgatgcggggaagatatatcgtcccttcacttgtgacctgcgcctgaagattgcgattggtgctgcagagggcattgctcacctgcattcacttggcgtcgtgcatggcgatgtcagcattaacgacatactgctggatcatgtctcttcgtccctggtaaagattgctggctatgggacatcagggctccctgacatcgacaaggctctggattcgcttgaaaccggtcatgggaagaaggagcatgatgtgtacagttttgggcttgttctcctaaccctcttcacgtggaagaaggtgtcactgccacatgatctcaagtccgagcctgacaaacctgtgctactgcaccaggaagccatccgtgggcgtagatgcaatcatcttgagatgatcaagggcttggcttcacggtgtctgacgtccgaggcgacgaagagaccatccatggtggaagtagcaaaacatctcaacttcatacttatttttcctgaaaggaggaaaacttgccatgacctggcgatttatcaatctcgaatgctttcggactaggctaggctgcaagaactagcagtcgtacatgggttttttttttagtaaaggtgccgtatacgttgtagatgctatatataattcaagcaacatgtgtattttatatcctgacaaaaaaaaacaatgactcttgcttcttctcaggtttggtggctctttcttgtttctaattcttattcagtgcatttgtctttttttttaagataatggagtataattcagtgcatttgtctacatctggccctttggcctttctttcttgtggccgattttgctcggtcaaatttttgtgtaacagaagaaattaagccgcatcagtttactttggatgttgcttggattggtactgtttcttgttttcatgtttttttgtgaaactttatgtaggatcgaacataaataatcaagcctacgagggggggtgaatggtaaggaaaaccaaaaacccaaaaacttttagcggaaataaaagttaccctcaaatcgatggaaatctcgacgtagtcctgtcgccgccggtcggactgctcgtacgccgccggtctaaccgccgctttgtagccggttgaaccgtcggtatgtcaccggttagaccaccgaacccgataaaacacaaatcgaagaactcttaaaataaatgacaactttattgcttctctctgtgtttacaaagtgcaacaacatcactccttacaaaaatctcgactaaacttaaaactaactaaattatcaactccatgctctgaaaagcgatacaggaaacctcacgctccctctctatttataccacaaaaaccctctattcaaagtaggtgaagaactcctatacacaatatgactcgatacttcaatttcctttttctccaaaatccgcagccgcacccaagtcagactcctccttccctagctgctgctgctgcttgccgcctgagccgagtcggcttgtcaccaccgagcccaactcggtcgcccaggccagaccaattgctgctgcttttggaccacgtgcacagcacctgcgcacacccaagcccatatgcatgacagccttccatccaatcggccacacacacgtgcccaaccaatctcagcacatacacacacatgcatgtactgatcacacacgtacaacacacgtacatgtatcatacacgctacagtacatcaagtactgtagcaaccatgcactccaccatacatgaacatctctatcttctctcattcctcttcgcgaacaccaacgcttgcacacacacctcgtgaagcccgttgcgaagatctttcccacactatgtccatccgccgtgtgccatctcgtattcaacttcgtcacccggtatccttgaccgtctggacctcaactcctccctgagtttagttccgatccccaccgttgaccgaagttgacctccaagaatcctgactctagtcaccttctcacatggtatcccgatcgcactagacctctgttcctccctgaacatagtcctggtcctcaccattgaccaaggctgacctcaagtcacctgcacacaatcagacaaaacaaccgtttctgggcatagatatcacaacctgacccacattagtcacacgcactcacaccaacatccacacatcttttcaaaccaattcattgattaaatcatttgcatagccaattgttcatcacaaatattaatcatgacagtgatttcacactttccagtttttacctctctcgtgggctccaggtggatgtgtgttttggccaaaaaaaaaagatcttctgaaaggttctgccttaaaagagtttccaattttcatttccaaatgtggagggatgatggtcctgattgtaaatttgttattggtgcacataatttgctatccgtacaatggcaccgttgcaacttgcaatctaaagagaattggctttcctacgcagatgatgttgaaacagcacaaaacaagtatcacaatgcacagaggggaaacagaaatgaaaaaagttcagacgcgccagcacagtcttcttcttcatcttcagatctctagcctcttaacgttgggtctccagccaaaccttgattgataaacttcacttgcaactcgccttatgagcctggcccccagtagcaagtttcttcggcttgtttcctgtttctgcaaagttgtccaggtttcaacccaataacaagcgagaaagatcagatcagtaggatcatgtggaagtttttttttcaaaacaagctttatttctaatcttccaaatagcccagatcatagcagcaaggccaaccacaaccagattcccagtcaatctgtcaattttgtttagccattgtccaaacaagtgctgaaaattaaggataggttttatgttgagagcacaacaaacaacattccataacaattcttccaaatgacagaattggccattttttatcacccttcctccaaccttttttaaacaagttatctttagtcagaatcttgttcttagcaaacaaccaaataaaaatcttaattttcaaaggtattttgaatttccagactttcttaaaagggaacaccacctgtttcattttgagagctttataaaaagttctcacactgaacttgccatctttactaatactaagttcccaccaaactttatctctacaatgtgcattgataaccagggagtcccaaccagccttgattttgttctagtccctaagtttttcactatgctaatgctatcaatccccttttggttaatatttgcaattgtcaccattttttttcacaactatattataagagcaattttatggtccttgaggaggtactatgaagtaccattttttctattataaatttggtacctcatggtatctaagtactatgaggtaccatgaggt

SEQ ID NO: 61759 - DNA, 23685 bp, Oryza sativa
cccttactgccaaattatcaatttataatccttggttctattaacattttaaaacatgaaaattactggtaccttttcaaattaatactttagttgttgctgaccataatttttctgtgtatatgatatgaagcattgatttggtaaacacaagtgcactatcatctataattattcaagaaaccaaccatgcaggctgattttgtttttttcaccaaattattttgggaatgttctgtgttattatatggtgtattgtgggggccaagggtcttattagtttttgaccataaagtttgtttggttgctgatcgtagtttccttcttttctagttttttcttcgttgtgtttaaccctggcccttaagggcctgtacgagtctttctagactcactcccctatcttcttaatataatgatgcacagctctcttgcacgttcgagaaaaaaaaggtggtattatggaccggatagggtaagggtcaaaagactgagggataactcaccctctaatagtgccagcaaggcttctccttgctgagttaagagaggctttgaggcttagagctaacttaagaatttatatattgattgattcataatggagtacatgtggtccctttatatataggtaggactcaggactgacttgacatctaaggagctaatctctaatattgtatgaaccaatccatctctatctcttgtttacaaacctcgccactttcctaactagataatctcctatctttatttgacctattccttatttataatgcctaaactgtttcagggcctggccaatgcccataacataacatgtggactgagcttcttgacattatttcttttagggtttagcaaaaatacatgtttgccttgtgaacaaaaggagcattctgattattttactcattgtttacaattacttggaacttggtagaaagtaacaaccctcttcatgctgttagttctgtaagtgcaacaatttaagtgctttaccatgtaactatttcaggttatcaaagcaattatggccatacttaaaactacattaccaggctgtgatgatgatgccccatggcatcaagccttcaaggccattcttcctggtgacaaggaagaaaaaaagaaggttcagttttacctgattatattctattttttgtatttgttacattacatttgcttatatttaataaattatcgtaattcccagattatacatcatattgaaaagatttcattggctagaaagtgtagcttcatatcggctgctactgacatcttcagtgcaaaggtctctggtaccttcaaaaggttgttatcttccgtgtttacttaccgttctacagtccatgtttattttttgtttctgcagggttctttattgctatcttccaatgctcatggtgcaaatataatgtgatgctatgctgagtgtcccattctgttggttgtagggcccagattactcaaggaagaaaggttttatcagccttggatagcctatcaaaacttgttgaaagggtatgacaaatggtctggccattatatctgtatttctgcaaactaatgaacatgtttcaaacttttaatttatttgatatatacaataatgtttaggaataatattatcacaaataccatctttggaaagggtgcaatactcacatacatagacaaaagtgttaagataataaatttatgaaactttgatctcgtttaccttgtctgtcaacagaaaataggattctaatttctgtgtatgactattgactcatcccctagtatacatcaatcataccatttctgttttctgcactggtagttagtcattaactagtaaataggattctaatttctgcatatcacccacaacctactgacaatacatcactggtacaattttttgctttccaaaatgagttgctaatagccttgagctatcttgtgtcatcaattcaataaatatatttggtaagctatgctttttgtacgatcaattgagcaatgatatagtattacttttacaattttctgtatctctcattgaacctcaagagctacaatttattacttctttgtgatacaggaacaatcagtttcagtggtcatttcttctgctggagatatgctacctcaggttcaattaatttgttgcagttgtatttaatgagctttgccttcatgtatgatctgttagaagtagatttagaaacgcgccatttttttttcttatggtgcaagtgctgcactattcactgttctctggttcacttcaaggtattttgtttcatcctagaaaataaatcaacaatttatcggcgccatacatttgtatgtgcatcatgacttcttgaggtcctattagcatgttgtggtcataaaaagtattaatatccctgatgaccatctaagcagtattctgttgtatggttcatggcaagaaaagctacaaagccatgctttaggccctaatgcacttttgcagtacaaactacaaagatatgctatattttacgtattttggatcaaaatagtgatgcacattcaaacttattgagtctgttaggtttactagtactgagcttcattaaacgtttaatatcactgtgcttgattctgttcaatttctttaattacagctactttatcattttttgacagaaatacctacttgaaaagcgtgcgattgttgatgctgatgggggtaaattattaaatgaagataatgacatcagatcagtaagtacagttcatacacctttgatgctcttagtgttttgcacattgatcctcgagaaagactaaactttgaatgcaccaagaatcaattttggattatactgtctcaagcattcagaacttgaagaaattatggcaacagagcttgaaggatacaaagatgcatttatatttacatatttgtactgtagtagcctgctgctttgggtcagtcagaagcatccatcggaagacacttattcttgataaaaatgacttaaaattgcttttttttttgtcaatcaccatggttggacactcaatgtcaattgtctatttccaggacttaaaaccatggactatgtctaatttaccataccatcaccaattttattgatgaaacaatagtgtgttacacaaggttatgaatagttaattctagcttagtttcccatattgtttggactccttgttgattatgtttataacttcctgtcccctattacttgactcggtgttttggcgataattaaaatggttgctttggtatgtattaagaaccagtacatgtagatggaaatcataatcttcgtctgcagcaacttgcacgaggtgtttggtttgcatgtgcagctccacctaaggttttcagtagggaatacttaagaataaaatgcaccctaacatgacataagaggataggagaggtcggggggcgggggagctatattccaccaaagttcttttttgttctgattgggcgttgcaatatatatcaaacccaagtacgctaattgttgttgatattaccgatatttgatttggtttgttagactcatatgaggtctctttatgaactttcttttttggattttgaacattttttgtttggatggtttatatttgacatacattttgtatacagagaggtggtgttaacttatcctaaatcaaactgcaggtccttcagtttttaatggatgatgtgtctgacttcttatcaacacatttttctagttcagtggatacaagcaagactgaggagaaaggctgtgcttctacacttaaagcctttattgattatatctctttgagagaaactgaaaacttcagatcacgaaaggaggaaaataaaaactctatcacattaacaactatccaccaggttctttattcccttaactgcaataaatttatttgtgccatttggcaattctgacactaaaagatgtatattcccttctatgattcgcagtcaaaaggtttagagtgggatgttgtgtttatcgtgcaggtattgtactttaatcagtagggaatttacggtttgttcatctttctatgtgttataaaatcatagaatttagccgtaatgttttctcattttttatcagaagtatgctgttttatgttgtgacgataaaaaaatgtgcaagctgggaatggtatatggtagacatacattaaaattcagaaaggttatgatatatagagctgtggataatgaattatgaggaatttgaaatattgacttgattcagagtaactttgtactattcttgcctgtgacaacatgagtgccatcatagaggactggtcttgttatatgcctttgtttttctttgatttgtaatggagagtctaaacactgcaaaatttatggatgggtaacatattttggttcatgtgtttgttttattctgatattatgcaactacgttaatttttccaaaggagtattttcttgcttttgttcacttcagtccttttgctcaggcaaatgattcagaaattcctttgttgcatgagtacaatggcactgtgaaagaagctggaagcacactggaggtttgttcaaattttttttctttccctgaggtggttttctgtatgtattctgcaacttggttgtaattacaggaggagagaaggctattctatgttgcaatgacacgagctcgaaagaaactgtacatcttacatgtcacggttgactctaatcgccaggcaggtgattttatattgtattcatccttataaagtatctagatttcactgacttaaactattactggcgtctagctgctgcaaccttcacgcttcctcagggagattcctgctcaccttcttgaggtacaggtgagcactattttgagatcctgttttgaatggtatcgagacctgaagaatggtatctctatcccatattgttgtgtattccaccatacaatctgcttggagcattttaaaaaattgtaaattttagatggtatacagctatatatcaatctagaaagtcatttatatgagtaatataatctattatagcaatagtagcttaacataattttctcttttcaataatgtgaagggtgagggaactgtgagaagaactcctgaacagccggtgaacattccatttgatcaacctgaaggagatacatcagttgaaaggcctatggtggtacggaatgaaacttcacctttcccagaaatggatcagccatgtcttgctaatgatttcttgaagaggtaaatcagcgtgatatgatctatttcccttgtgagttgtttttgtgcaagcagttatttttcctgcacaatgtatttaaagaacagataatttgcatctataacaaacacttgctattttatgttatgtcatttgctgtattttgtttctcccctgaccaaaacaaattcgttcttctctttttgcaggtttgaaattgaggatagagcaataatttcacatatatttcatcaatgggcgaagaaacaggcatttcaaaatccaaaaaggctgcttgataaggtactgaatatttcattttacattggatggatgccatatgccattgattcgttcctataaggagaagtagttttttttttttgtacaaggaaaatatggtcagcagctcactggcggactgaatgaagtcggtagtatcagcaaattacatttatgccatgtctgttgctgtattatttttgctaggagtcaggatctgagacatgttagttctgaaacagtcattggtattgcattgctactgtacatttcatgttcagtctatctatgcttgccttttcagattggttttgttattgatgaacgtttacgaggtaaaggatacaagcgcaaggttggttgctttgttccattgattccactatctccctttctgtcacatcttttatttcatgattgtttattatattgatgttctttatatcatcttgttcgtagtcagtgttatacataggtaatcagtgatattttgatcatacaaattgttatttctcattcaggagattttaccctgacatattaacatgtgagttctttttttccaggatgtattgtgcaagctgaaatcattcttaagtggtgatgaagcgtttggttatgcacaatatgtgagttaagctaaaacgatgaaaattttggcagtctcttgaccttgagcgttgattctctttaataaattatttttttgagaactttaataaattattaatttcatattgtgaactcttaggttatcaagtgggaacagattcctatcgacaagcggagccatttgatgagagagagacaggcaagttcctgaattacgatctgttatgaattaacttagaatttcttttctttttaatattaacaaggcatctacatgatggacacctgtccccaagattctcacatgtttgtgatcttccaggaacatttccaaaagcagaggatagagaactccatgggttcctcagaacctacacctaagcaggtcagttatctttgccaatgctctcatatctttacctactttgactagctggttcatctgacaatcacattgccattatggtgcccgttattgacaatagaaagcccatagttttttttttggcagaaaatagttttactggtttccttcgctttatatgctattcccacctgaatggattatcattcaaacactttgctcatcctttggtgcagatatcgtacctccggaacctggggtgcaccatcacacccacgtctcgcctgcacgcgtcgcatcttatcgagaagtacaaatctctatgacttttcactgcttgaacctgcaggggacacatgatttcaagctcagtctcagaattgggaccatatatacagcaacgctggtgaaagttcctcatattaactgtacatgctgtacatatcgatgtacttttcccgtggacatggtgtggttagagcaaacgtcttgttacattaccaggctgttcttgggccacaagggccaaccaagaaacgaaccgggccttctctttggggaatctggctcggcccacaaaataaccagctatgggagactcagtcacatccctcatgcaacgtacatcctccgtcttgtaaaaaaaatatcaacttctagctatgtactttatgggatggattgagtacgggttatgtgatcattgcctcttgtttttgcgatgatccttgtacgctagtgcctagtggtataaaatgagctttgtatataatttggtccattttttttaaaaaaataaacctgcaataaaacgttttctagaaactggacctacaatatggggccgtgatattcaatgtgatgtgcatacagcatggtgttgtataatttggacgtcgatgtaggatattttgtgagaccattatacgcggttgcctacatagcctcaaattatgtgacacggtgccaatgtgccataaacatctctatctctaaaatgctaccgacggtctagaatatatatgatgtttaggagaaccaaaattgacttaaatgttgttatatttttctgtcctaaacgtcgtatatgatcatgattggatggagtattttattagaggcccacatgtaaaagatatttaagaaaaaaaaagactaaattaccaaaactaccccgctatgtactcctatactgcccagtctgccctacaagaaactcgtgcgtgaacttctactgtcactgcactcttcctctgcacacacgtttcagtctctcatcagcccgacgtttctgctgcaaaaccacggcctgattccgattcacgcaaatcgcggccaaatctcgcaaaccaaaaccaaaatcgccacctgtaatgtaaagaaaagaaaaacaaaaacaaacaaaagtgaaaaacagccaaaccgacggcccaaaaagaagccgcagcggtgcgtttccatgtggcgaatatttccaggatgattccaatcggcgcacggcacctcagcacatcacaccagatatataattaaccaccccgtctctttcacgacccactccgcctcgcctccactcctctcctctccgcatcctcctcatcgcctccgcttctgcttttttttttcttttttctcgttgatcggtttgttcgatcagatcggttctttggagagatggagcagtccttcatcatgatcaagcctgacggcgtccagagaggcctggtaatctgacttctttttttcttttaatgttcttcttgtcgttttggccatcgattttcgagaggaattttgcggtttcggatcggttaaatagcgtagttgattggtgtttgtttgtgagattttgagttgttttggtaactttttgtaccgttttgcgtggtttttaatggggaattttgattttctgttctgcagattggagacatcatcagcaggttcgagaagaaaggattctacctgaggggtatggctgatccttttcccctctcgatttgatcgtatggattcatttttcataactttcttttgtatttttattgatctaattttgggttgacctacccgtttttttcaacacatattatgaaaagcagaggctgacgatatcataatactctgtttcatatgggtaggttggggttgtgagttgtgacatggagaatttgatgggtttaatacatgattcaaaagcaagatttttttatataatttatatgttgatgattggccatttttaactggggacaacagactgacacagtaatattcaatttagtatatcaactgattcgttgtcaagtctaattttgcattacatgacatgggcaacttatttattattatagcagagatcgtcaaagcctcaaagatgtagtctactatttgtacttgtaatcatggaaatatctttctgaaaagaaaacatcatttgtacttgcaatagagttcaactaatatctttggcatgcatttaacgtgctcttttccattttttgttccttattaaaagttgttgtactttagtggaaaccaaaatgttttataaagcattacagaacaacaaaaacagctgtcttaaggaacagcaacaaagaacagaagtaaaggactttcatttaacttcccctgtttataacaactgtgtagccatgtattggttgatgtggcgattataacaactgtgaagcccatttttatgagaattattcgaaatgcacgcaaaacatcatccaaaaacttaatttcatttaacttcccctgtttaagaaatatacttcctccattccaaactataagcatttatgcgtgttattcacaatgaatctcgatcttgagattcattctgaaaaacaagtataaatgctttttattttggaacggaggtaatattcggttgagggatgatggtgcttacgaattactttttgaactgcaatgatccagggatgaagttcatgaatgtggagaggtcctttgcacagcagcactatgccgacctttccgacaagcccttcttccctgggttggtggagtacatcatctctggccccgtcgttgcgatggtttgggaagggaaggatgttgttgccactggccgcaggatcattggggccaccaggccctgggaggcagcccccggcaccatccgtgctgactatgccgtggaagttggcaggtgagtcattcttgtctgtcttggtcatcagctcattattgcttgaattttcagtcagttcttgtgatccttttaatcatgtaaggatcctgagcgatggatggttctttatttgttttgctgctagcatcaaacgatgattttgtttgaaaatgggtggttaagtggcttttattttgatctatataaatgtgtgaacctctgttttttaccagtcagaaggtatcagatagtgaatgtgctgtgatatgatttacaaaaacttttgcatgcattatgatgttcatcttttctatatgttacgatgttagtgtatttagacataataactacttggattatgttaaactatgttcaattctagcttttgtttttgaaaataaaaatcataatgcttcctgcttatcgatgcctaagctcaagctgttgtttcttgtgtaggaatgtcatccatgggagcgactccgtggacaacgggaagaaggagatcgctctctggttccctgaaggtttagctgagtggaggagcaaccttcacccttggatctatgagtcttagagcttcgcgcctataatcgatcacctcttggtggctagttctcgttaaatatttgagttttgtttcagagttgtcatctggctgcctcctgagtcaccattataattctgctgtgatacaatcacagttatatgttgcctgaacttatatggctttttaagtttctggattggatgtgatgggaaaataatactagcagtcagtttttgcttataaatgtcgtaatatcttaatcatgctctttccctaggttcatccaagataagcagatggtgttgcctgattttcttgtggcacataaagctcttagatttgcaagcaacctgctgttctggactttgttggaaaatttactagaactaaccaaatacccgtgctttgctatgtattaaaacaaattaacagtaagatttttagcacaattttgtcatgtagagatgtggagatgaaatatgatagaatcctatatatagagggattattttataacaacatgatagagtaggtgataaataaataaataaaaacttggtgagctgttggtaggttcattatcaccagcattgttctcttttaaaaggagtatagataatgttgaatgcttcaagtttaaaatggcaaaataacacagctgattcttacatgagaaccttatctattcaaatgtacagatgattttgcttagaattggggagaaaatgaatattgcaaatgaagtctggtactctgattggcattgatgagttgattcacaagtttcctgaagaatttctagtcgtgaagtttctgaaatgacaggagagtttcagcctgtctagcaggattgttttttcaattaaaaaaacataaaacagaaccattcttaaaactttcgaaataaatttgaaaactttttctgtgggaaattattttgatgcattgaggggatgttttctcttatttgcatgtcactaaaattgttacgaaaaaaatttaaaaaaaattgagaagatgtattaacatgtgatatattattacacaaacatacaagctcaaaatcaatttctacatcttgcaacgaaaaaacaattaatcgttgcaagatgtagaagttgaatttaaacttacacatgtttgtatagtgatatattaaatgttaatatatattcttaattttttttataaccatatgtaaacaacgagaatccactcacactgtctgctttggtgagtgactctcaaccaggtgcggacgtgtcctgtgcatcatcttcaaggtaagtgtggctcccgatcgtccacctctccaaaccatccatcgcacaaaaaccaccaccacactgtccgcgcatggcgcccagctctccatctcgtgtcgtgtccaagaaacgcttccggctgccatcgccatggcgctcgccaccacctcctctcacgcgctcagctgctacctgcatccccgacggcgccgccgcggcaatgtcgccgtgtcgccgcggtctgagggcggcggtgcccggaggaaggaggaggtggagatcgtcatcgtgggcgccggcgtggcgggcctcgccacggcagcctcgctgcgccggctcggcgtgggcgccaccgtgcttgagcagggcgcgtcgctgcgcgccgggggcacgtcgctgacgcttttcaagaacgggtggcgcgtgctcgacgccatcggcgtcgccgacgagctccgcgccaagcacctccgcatccaagggtacgtctctctcgctccctcccctgtatctccatggatgatctccgagcttctcccgtcgcgttctgagctccgttggtgacgttccagctgaccggccgcaggatgaagatgcggtcggcgtcgtctccggcgtcggcggcgggcggcgtcctccgcgagttctccttcgaggaggaggccccgggtcaggaggtccgcgcggtggagcggcgcgcgctcctcgaggcgctggcgtccaagctgccgccgggcgccatctccttctcgtcgaaggtgcggcgcgtcgccgtcgccgggcagcagcaggggcccggcggcgccaccgagctggagctcgaggacgggaggcggatcgtcgccaaggtggtggtcggctgcgacggcgtgaactcgccgatcgcgcggtggatgggcttctccgagccgaggtacgtcggccacatggcgttccgcgggctcgcgcgctacgacggcgacggcgggcagccgttcgaggcgaaggtgaactacatctacggccgcggcatgcgcgccggtttcgtccccgtctcacccacccgtgtctactggttcatctgcttcaatcgaccaagcccaggttcgcgaaatttgcttagtttataaaaacaaataaatatcatatgtagatttgctttcgaaagtattatcataataccatgaaattaaaacacgaatgttagggaagaactaatatcaaataattagaaagggcaaggcttcgaatccagatcatctagcccaccaccttgtgaagttagccggaagactcctaggagtttcatgaaattaattattagattttatgaacttattttgatataaaatcgattaacatcattgacttaggattcaagtttcaaaagtttaaccaaatgttatcctaaacatcgcgcatttacgaccaaacagattaacaagggaaacaagtgaaattttacatttgaaagttttttttaagaaaaaaactgttcaatgttgtatagcactctctaaatttgttagttattcttgcttgaaatcttagcatttttcgtagctgatgtgtttgaataatctttgactctactaacttagggccaaagatcacggacccggcggcgctcaagagggaggcgctggagctcgtccgcgggtggccggaggacctcctcgccgtgatgcgcgacaccccggacgacgccgtggtgaggacgccgctggtggaccggtggctgtggccggtccttgccccaccggcgtcgaggggcggcgtggtgctggccggagacgcgtggcaccccatgacgcccaacctcggccagggcgcctgttgcgcgctcgaggacgccgtcgtcctggcgcgccgcctcgccaccgccgccgcgagcgagggcggcgaggcgagctcgtacggcgaggctatgcgggcgtacgagcgagagcggtgggggcgggtgttcccgctgacggcgagggcggggctcgtcggcgcgctggtgcagtgggggaacccggcggtgtgcgcggcgcgcgacggcgtggtgatcccgaggctggtcaggctcggccccttcctcgagcacaccaacttcgactgtggcctgctcgagccgtcggcggcggcggcggcaccgtcgccatgacagagccaaagctgttgtctgaacagtggcgcaactgcagctttctcccacactcactctctcgcttcaatgtaactactgtattggatagtggatacaaatttcaatgctagcattttctaactattgttagacaaacatttgcaataatgtgagaaaagacattaccaaaattttgcaattgatacgaatgaatcaatatataaattgaacgtaaccccatatactaatgatgtttaaggactatctactgctcaactctttgctttatctaaaatacattctccaacttcaaaaccagatattatacgctccaaattatgaatacccgaaacatataaccattaaagtcagatttagtacaattggaagccatataagatgctacttataaaaatatttcaaaaaattagtagaccccacatgtcaggggtcaccctcttctttttctctatcttttctctccttcctcttcttcctctataaagactgagcaacaaaggagggaggagggtttatacgtcggcgctccggggagggaatgacggtgatggctgtggtaggacatgtccaacgtcacggagcagccagcagtggtggaggccgaaacgaaaactacgagagtagcggaacacatgcaacaagagcgcagagtttcaaaggagagattttaccaatattttaaaatatattttagccgtgacacgttttttaatgtctactaataaattacacttattttgggtgttttgtagtaaaatttacttttggacaaagctaagagttgagagggttgtaaaataggcttatccctgtagagtcatagatattttagcgcatggtaataggaaacgtataaacttaaactttgtgggggcaacatctcgtggcgggccagacgctgatatgcacgaggttgggctcaacgtgttggcgtcaccaattaaacccagccagctaagttccttcagggggattttgggtgacacgcgaaacaagaaaaaatatcgagtattagttatgataaatatatatatataatttaattatttttaattctttcaataaactttcatatagaatagagcttttttttaaatggaactgctagaaagctttcgcaagttttttgccgtccaaattttcggatttgtggccatcgcatcgtttaagtgtacatgaaagaaagaaaaatttctagaaacaaatttgtacagttttgctataagttacaatgcagttacagtacaactataatacatttacatctcaattatattatagttatattaagaaaacttgcgggaagcgtcgtaattatactataactaaatctgaaaaaaaaagaaaaaaaaacttgggggaagcaccataacagatacggaggaagaggaagcgtgataacggatggtgcggcttagcagagaggagcgatgtggtcgagctcgacggggaggccgtcgtgcggcgtcggcatcgggtccctgagaaacgtgttcttctcctccccgaggcagagcttccacctgaaatgcctcaccaggtagtgcgccgtcaccagcgtctccaccctcgcgagctccatcccggggcagatccgcggcccgccgccgaacggcacgaacgagtacgccgccgccgccgccgcgccgtcgaaccgcgacggctcgaacttggtcggctcgtggaagatggccggatccatgtgcgtcacgctcggcgaccagaagatctgccaccctctcgggatcgtgtagccctcgaactcgacgtcgacgggcgctctcctgaagctgcccaacaccggaggcaccatgcgcagcgtctcctgcgcgacgcgccacgacagcttcatcttggcaacgtcctcgcatgtcagcgcctcgccgtctcgcttgcccctggcgatctcctcatgctctgagtgttcgtcaggggaggggagagttgggtttcttgggcgagaggagaggaaagttagtgctactactacttgccttgggccatggcggcgagggtggccgggtcgttggcgaggtggcggagcatgaaggtgaggaggacggcggaggtgtcgtggccggcaacgagggcgagcacggagttgtcgacgatctcctcctcggtgagcagctgccggccgccgtctcggaggctgaggaggcagctgatgagatcgtcggatggggaagactcgccgtgctccagcttcgccgccttctctctcacggtcgcctcgaccagccggcgagccctcgcgctcgccatgaggcctctgcggaacggggtgaacggcaggtccaccggcaccgtccacaagccctcgtgcatgccgtcgaacgcgtcggcgagctgctcccggatggcgccgcggtcgaggccgaacagcagggtggcgatgacgtcgaacgccagcgtcttcatcagcgggaacacggcgacggtgcggcggccggcccacctggcggcgaggtggcgcctcacctcgctgtcgatcttgccgacgtaccgccgcaccatgtccggcctgaggaactgcaggatggcgccgcggacgcgccggtggtcgtcgccgacgagctccagtatgttcctcctcccgatgatcgccgccaggctccggggctgcttgggcgccagcgcctcgtggtggaacaccaccttgttcgccgccgggccggcgacgagcaccgtcggcgcgccgaacagcgacagcttggacaccgggccgtacctgtcgatcctgtcctgcagccaccggtcggcggtgttgcgccgcatggcgcgcagcagggaaaggctctgcccgatgagcggcaggccgagggagcccggcggcaggttgcgccgcggcggcggcggcggcgacgccctcctcgccaggtacacggccagcggcgtcaggaaggcggcgaggagcgcgatgacgacggcgacggcgacgactgccattgcaacaatagccaaaaagagtgtagctgtgagcctgtgaagctaaagcttaattggaatgagacttgaccaaagagatatcgagcgaacttcatttataagagcgtgagtaactcgtaggatcagtttgcgtacttcccatggtatagaattattcacattcaagcccctctaaactgaacaaggctttagttggtactccctctgtctcactgtctcactcactaaggtacggtcaaacttgataaagtcttcaaaactaatatttgattttaaatttctcatatgctataatgtttgtagaaataaaatcataattataggaaaataaatttaaatgacaatccaataacactatttttatcaaataaaattaaattaataatatataaactatttattggtcaaatatttaaaagttgactcttaaaacgtgcgcgtcttagtgagtaggacagagggagtagtaactttgacaaataaaaatgtttatgggagtatctaaaaaactactataaattttttttgagtataaaagattcagatgtaactataattgaattataattgtaactgcactataattgtattgaaactacaatataagttatataaaacttgcattcaactatggtttgggtaactagcaatggaatctaatgttgacatgtgtgaaaatttatttctatcatttttcgcttcatatacaaatctcaaggcgatccaatggccacaaatctaaaagtttcgagggtaaaaatcttgtgaaagttttctaacaaatccgattgtttatttataaacatatttcacaccgcgtagaaccaaatatatactaatctcgtgtacaaactttgacatcttatcctttttaattttttttttgaaaatatgtcatattttcatgtatttttcttgcaaaatataattatagtactttcatttatcaaaacataataatttaaaagtttttattggccaaagataaaattacactggttaaaataaaaaggaaaggaaggggtgtatttttaccattgcagccttatccttacaattataaatcatacttcctccgtttcacaatgtaaatcattctagcatttcctgtatatttatctagattcattaacatcaatatgaatgtgaaaaatgttagaataatttacattgtgaaacgggggagtactagctaaatatcaatgcgttgtaaggagcaggttgaatataatttatcccatcctccatagctaatgcctaatgggtggactattgtttagtggctcctaaatgtcaccttacgttaggagtagttggtaccaaatttaacaatctctatggtcccacatgtcaattagtgagataaattcactgctcatcaccgttaccactttatagctatatgtcaacatttttttagaaataatacgattttaatggaaaaatgaaaaaaatataggtataccagataaaattataagtttagcatcatatcaaacaactgaagtgtgacaggatatatatcagatagcctatcgaataacattggttcggaccataattgtttgataagatcattggtccgagaaaaaaatagtaaaaggtgcaggcatgcatgcacgcacgcaggaggcctctcgaacattcaacgttctataggtacctcatgcacattagcccatgcacacacgtacacacatgcatcataaagaattgcaaaaaaatcctaccgtctcgtcaaacaacctctatccaacaaccgttgtttgatgggtcatctatcgaagaatagttgttcgataggatgttaaacttatgattttgaatgatcgaactttatttgtacaattttttattaaaaatgtattatttctaaaacaaaaatcgctttatgtacactagaatcttctaggttatccatctacgtctatttgcaacactaaacatatggtctgagtggcctggaattaatggtcacgagtggtccttgagttattgtcaatgtagggttataatcacgtaggttcacaattgcgtcatctaatcactattaagatttggccgcacacagaaaagcaagcactgtgcacatgaatagtgatggtttgtgcccgtatgaacacacgagcatatcttttcatgatcgaaaactgagcttgcatattttaaaattaacaaaattatcataaacgtttttatggatccctgtatcattgtctagttattattataaaaataatttatcgtaaatatgagttgtcttgttaagcctaaaacttagacatattccatcgtaaacgaccttagcagctcggttgtggtcttcctcggcagccaatacggatttctctgcctcgtaaaaaaaaaaaagtaataccgacttctacctcacgtggcagaaaaaacaaaggacactgtttctgtttatgtttgtgtttgaaataaaatatcacaaaactgcaattgtttggtcgcaacttgtatcatctacttatatgccatcacaacccacaacatcatctagtgtctatagcatttaatatattgccgcataagtaaaaatctgatgtggcttaagagttaattaggagagaggtaaaaagatgaagaaaccatttctcatgaaaaaaatcatctctacacaagaaccaagattgaaaacagaaccaagattgaaaacagagtataggtggataaaaggagagagaagagaggtgaaaattacaataataacaaactgttttattaaaaatactccctccttccaaaagttttggaagtttctgttgatcagttcgtatttggcgtataaacatgcatgcatggatttgttaaacatgcatgcatgcaaatccatccgttgcctatttgcactgcagctacacctctttgtttttaagcaaagcttgatgcagctgccattgatcgatccatcctgtgtcgttctatccactacatggcctctgcttgcagcgatccactgcagtgatcaataggaaggatggaagaaaggctcgggcactgcgtgagctgggcaccggattccgccgaggccgacgatgagcatgatggcaaatagcggatccaatttgcatgcatgcaatttcgttcgagtgggagagggagggaaggctccacgcaattttggctgctggcgagggcgagcacgcacggacgcgcgcgacgggcgagggaggacgcgaacggttgcgctcgcgcgcgggcatggacggttgcgcacgcacgtatcgcgaatcaagcgaagcgtcgcttccccctaaatccatgcagatgcagcgatggttaaatgcatcggaggggttccttggtctcagtgcaaacgtaatacgactggtacttttggaaggagggagtaacagttgtgtttggttaggctatggtttttaataaagcaactctgggctatgactttttaaaaagtagctttgcaaaagtagctgtgagaaagccaaaagctatggcttttggaaaagcttcttcctaacgagtagaccccgcatgtcatgcacacaggtatttttctctttctcttgagtcttgacacaggaagccaggggaacgccgctcgtcgctggcaccgttcgcgtactccttgccgtttgccgcgccgccggcctcgtgctcctccgcgtggagagcgggaactcgcgggcgagcgtgccgagacggagcgactgggcggcggcggcggcttatcgaggcggcgcggcgttagacggggtcggcgtcgggcggggaggaaaaggggcggcgccggcgtcgggcggggagggcggcggccagccggccggagggcaggggcggcccacggcgccgggaagcgccgcttgatccccactgttgcgcccgtgtgagaagcgagaggagacgaatagattagcgaaccgttttttcataatggtataggtgggtaattttctcctccaaaaataggggtagaggtgcttttgatttgtactacgtcaaaaactagctttgggcaaaagtagctgtggcttttagactctttggttggtttctgacttttgcaaaagcaggttaaaaagcccaaccaaacatatgtcaatgaacccctatcttcattttaagcggactattggacgatgtaattaccgaatgatattaataaagctcgccattaagaccttcaaaaattcacagcaccttcgacgaattttaacctttttttttgtttttgcgaaaaagggtaaattttacctcagccgcaatgttgcagcaaatgcattcggataattatggattgtttcataatattacataacataaaggtagaaagccaatgattaccggtcaaatgtcctaggataggtaaaatgtacatcttccactttcacagattctgaatctatacctttgcaagtttaccgcatacattgtcgttgcaagtggacatttttccacaacgttctgtagtttcatcatgtatttacttactacaccaccatgatggtgcactctaccagtctatcactgtatcgtacgtgtgccctcgatcgtaacatatccacacccacaggatcgatattgcttgcaatatcactgtactattaaatacaacgaacaacaagaaataaccaaactaaggtacgtactttgccctcagctttgtgtaaagtactcactatttgccgggtccatgactcatgagctgctgctcctcagtctctgcagcctttccagatgagacttgagccaggcaaactcatgttgcatcatctccaggtgactctccgccatccgcatctcctcgcctaataggtttaatctcttctgtacccactctatgctctctttgctataggagaagccgcttggggaggtctcttggttaaccatatacaccttgggggatctgagtagtagaactatgatggttacctgcaatagatgtacagcgccaaatgagtttggtagaagataacaaaggatattgtgaattagtctactttgttttaatttcaaacctttttttgttcgggctattgagttctgcagtaactagcaagactaacagcatttggaccagggaatctaaactataatatgtatgtaatcaaataggtaaaggtacttgcctgcaatagaacgatgatggctaccagtgtcagtgctaacaccggcccgagctgacttgactgtatatatgacaagagtgaacgccaaagttcttgtgatgtggatattatggaatcccatactatactttgttggtgatcatgaatagaaggaacgatgcttctcacaacaggttcatcaggtgcagaactcgagcctggatctgtgttttccaaaggattctcactactgagagtagtccctgatggatcatcaacattagttgagctggaaggtcctgaaagaatggacagagaaaatgatcaatttactgtttcagagtttcgaatatttcatgcaaatgaggacgtaatttggatcaaacaagttagaactgtagggaaagagcaaaggactgatgcagtgaagtggacattcaattaacagacctctcgaatgacagctgctatcctgcttcaaaagatcatgaccctaaaaaacatgacagggaggatcacttaagattcaaattgtaaatagctttgtagtaataatgttctgtgatgagaaaacacatacgagcttgacccatagcccaaaaacatcacggcattcatcttttgttgattgatcaatcttccctgtaattttgatatttaaaaaatgaaaaagcagcagcaagttaagttgtggtagatgaaacaaactgatcttttaagggggtagaaataaacaaataacactgcccccagacatgcaagaatagctcagaaataacacaaataagtaaaattctaaatatggaatgaatttgagtcagaactaagcaaaatatggttgttcactaaatctgcatatatacatttaaaaatgccactataaagaatttaaacgtctcaaactgctggagcgttcaggaatcaggatatatggggtgtatcacctctaaatatggttttctttgagaaggctacattaatatataccctgaggtagcaactgctttcatccaggctgtcttgttcaacatcccagatcccctgtttgaagaataaggaacagtagaaacatcatttcagtatctctacaacatcatcttatggtttcataaaaaaaagtgatatgttcccattgtaaaatgtaaggaagctggaattcatttccatggcagtgctggtcacaaaacccgtgcctagttctcatatggtcaagcttttacgttaaatctgtaacttctgatgtttgattattttgatctaggcgcacatttgtgcttttattttgcttaattttgattcaaacccaccacaaattgacccttagttgggaacaaccagtttatatgaaaataaggagaacaaccagttctagagaatttaaaccatccatctatggatataacaggaatgattgtctgaaaagaagtaataatattttggagagcagatcatatactcatccacaaagaaaagccaccatacaaagtaccatatttccagttgaagtttagtagtgctatatgatttaaaatcccaaatacatccagtcaacagtagtttgttggggaaagtggatttcaagcaagatgaaccaatactgacaaccgagttcctcacctcaacagtaaaatggtccccatatggcgcatcaccaatttgctgagatgtctgaatcatgagatgcctttgaaaaggtaaacaagaaaattaaacatcaggagagtttagcatcaattattcttcagagaacatataatttcttttagcacacagtcaccaaggttgggcatttacattgccatttactgcaataaaccataaaggtatggctaatcaagctaacatataaatgagaaataagaacacacacgattattttgctatgaggctcagatatgatccaccaacaagtgagtgtgaccaacaaagggcgaaaatgaaacaaatgttagtgcatctcaatgacttcaaaatcctcaacattttcagaaaactccattactaggtgtaaccgtgcaaaaatagaggaag

SEQ ID NO: 61760 - DNA, 662 bp, Oryza sativa
aaaagaaacaaaagtttgggcaaataaatactgaattagagtattgatagactagcatgcttatgaatggcaaggtcagtgcaaaagagagcatctagttactgaggtagtgaggtcgatccatagaaagatgtctattacagatgtctccgtagttcataatgaattgatgatttggtagtaagcttcacaatactattctgaccagctcttattggtttccatttttgtcacataattttatacagttgttaacactgcatgtttcctctaatcttatgatgttgctccaaaaactaatttttcaaattttggcaggctgagagaccaacattatcaaacgtcaatctggatgtacctatgggcagtttggttgcaatagtaggaagcactggggaggggaagacttctcttatttctgcaatgcttggtgaaataccaccagtgtcaggatcgaatacatcggtggtccttcgtggaacagtggcttatgttcctcaagtttcatggatcttcaatgcaactgtgagacacaatatctccatttatgttgattgttatattgaaccttttatggcttctacagatataatgttatcatctctgcaggtccgggacaatatattgtttgggtctcccttccaacctccacgctacgagaa

SEQ ID NO: 61761 - DNA, 889 bp, Oryza sativa
aactaatagtctgttctgtgcttgcgatggttcagtgttcttcgaaggtgatgtccgtgatgagctgttgctgatgaccctcacacgattgtgagttcccagaagcttcatccttagctttgtcggagaaagtgcaccagcctacaggaacaacaaagcagccagtaagtctttctccatggaagttctattaattcaaagtactgtatctcaaattaaacttaaaattggtgattgcagaaagaacttgtagaattctttagaagttagaaccgctaacagaaaacacctgtatcctgccaagattttaatcatttctgagaagttagtagaaggttcaatttgttgctacttttactctggtctggaacaacttgtaacttgtaagggtattttttttttcaaaagtgaataattaagtagtcccatttagcatgtattcaacgataaattcttcagaatgaggttttgcactacctaagtgaagagttgttttttttttctgtagaaacaaacttcgttagcttcgctttcagtgagaatgacctaaaatgtactatccttcaatacttttctcattttatacccaagccgtcttatttcaacactatcttcttagaactttaagacaatagtttgaatcgagatacaacattcctaaatggtgtgcagccgaaatgggcatgccgaaatataatttctgaagaaacaaaaaaaaaaaagtgaattagaaatgagtcaagagtgactatatcaagaaaacgaaatctttcacgaaatcaatgggaaatgtcaattaagggatttaagaagagtcacttgtgagtgactaaaatgaagtgtggaggaatcgagcaaccagtaatgaagagctcggctaaaacgaact

SEQ ID NO: 61762 - DNA, 2737 bp, Oryza sativa
tgtcatatgtattctaggaaagaaaaacatgatttaaccctaaattaaccacatgaacagcaaatgacatattacaaatgcttagcccacggcatgcatagcaatttcaatatcatgagcaacaattgacatatttcgaaagcaataaaacaaacggaacagatttgaaccatcggggtttaccatgcgctgaccatcaggaccgaagtcctcttcgtcttcgtcgttgccgtcgtcctcagccacatatgtcccttgagacgacgacgcaccgactcccggtcctcctccgaagactccaaagtcgaaggcgggtggcccgctgtgcgacatggatgccgcatgacctcggaagcctccatcgccagatgctgagccagggggaacccatcctcagattcccctgccagatccaacgccattggtcaacgacctgccgtagcctcatcctcctcctctccctccacgacttctgccgcgtccccctccccccgctggaggacgcgacggggcgatggtggatctgctccctgcctgaatcggaggtaacccaaggctacccggttgaaggatctgttagtaggaggggaaatcagggaaggcgtcggcctgggagttcagatccaggccccccgatccccctcccccaaaatggatgccagcgccagatccagcatatcctgaagacccctgcgagaagccgtagtcggagccgtccatgtgggcggctggagcttcattgaacgactgggagaagaaatcgtgaggatttccccccgccattgctgatgcgcgattcgtgaggcttgcgcgagtggcagcggcttgcacgacgccagcgagccaatcggcgggcagaggacaagctagcgcgaagcagtggtggaggctagcgcagggagatggcggcgacggcgcggggtcgagaggagcaagagagagatgacacgaggaagagatgaggcgaggaagagagtgggcgaggaaatggatagggttggctaccgtgaaggggcagcgggtggaaaagaggcactttagtcccaataagcacctccatttgggacttctggactaatgcactttagtcccattttaatccctcctgtttgggactctagggacttaaagtgacttaaagtggaggaacttcttttttagaccctcaaagaaacagggccttagctttgcgcattgtaagttacagataaataataaatgcagtgctttgaataatgcaccggcttcacgaatttgcaggcacaatataaccacatcttctgtgtcactcatatgggagattggtatgataaactttcacaatcttttagggatactgcgaaggaagtattggcaaaagcggatattgatccaaatgttaggtgcttcacaagaagacagatgaaacgcatcacaaataactacagcactaccttgggaagaggagggttttctgtggtgtacaagggtatgctcgacgatggccattcagtggcagtgaaacaatataattggagaacacagaaaaaggagttcacaaaagaagtgatcatacagtcccagtgtagtcataggaacattgttagattattgggttgttgtgtggaggcagatgctccaatgctggtgactgagtttgtcccgaatggaaacctttctgaacttctgcatgggaacattggtcagcttcctgtctcattagagacacgcttccagattgcattggatgtagcagaagcagttgtatatatgcattactctcaaaatcatccaatccttcatggagacatcaaaccatcaaacatacttctaggcgacaagtatgtggcgaagctatgtgactttggaatatctaggcttctctgcatggacaatgatgaatacacggggtttgttataggaagtatgggatacatggatccagtgtaccgtgagactggacgactaagcccaaaatgtgatgtctacagttttggggttgttctgttggaactcatcaccagaagcaaagggattgatgatcagaacagaagtctagctagagtttttgctcactctagtatagatgaaagatataaactatttgacaacgaaattgtaaccaacgagaatgtggacttcatacaggaaatggcaaaccttgcacttgattgtttgaagtctgaaatagaagatcggcctcaaatgaaagaagtcttggaacatctttatagtctcaaaaggaaaatgttggaacaggagaggaagattgcagagttgatggaagagagaaggattgcagagttgacagagcgaagaactgtggcatttagggaaatcaaggccatattgcaagatattggttttgaaagactcgtcacaaaagaaaaaatagattccatcgtaggcaacccgaaacaggtatcaacctcagaggcattttcaggaaaaagtagtgttctcattcagcgtgccattggcaagatttgcatgggacatttgaaaaacattcgatttatcgtgataaagatgtctgttgaggctgatgagatttggaaagagatgtttctttatgagatgatcaagcaatctagaattgagcattgcaatgtcgccaagctttttggctgctgcctagatcatgtggatgccccagtattagtttataagtatggtgacataggcttgcatgatgctcttttcggtaacgcgtggcagcagtttgattgtcctttcgcttgcgaaatacgtctagaga

SEQ ID NO: 61763 - DNA, 1649 bp, Oryza sativa
atgtggacaaaaagaaaaaccaattgcacagtttagctataaatcgcgagacgaatcttttgagactaattaggccatgattagccataagtgctacagtaacccacatgtgctaatgacggcttaagtaggctcaaaagattcgtctcgcggtttccaggcgagttctgaaattagttttttcattcgtgtccgaaaaccccttccgacatccggtcaaacgtctgatgtgacacccaaaaatttccttttccccaactaaacacagccttaggagttaggatgcctactgtagttgagtggagtagtagtattgatgtagattttggttttttttattcactctgctggatacttgatgtcgacttgttaacaacactataatggtaacaacatgcaagctttcattgtgatgagggcgataagcaattgcattagctagagtagtgttttatgtgtaaaagtagtataaatgcagatgatggtagggaaaatcaccactgtagagtcaagaaaatgatgtttgctttagtcattaggacaaattagaaaacgaaattcttaccaataaaacaaaattattatcaagtctttcagcaagctttgtacatgtagcgcaaactaacttcattagtaagagttaacatagtttagaacattcttttttcacaattccagcaaaaatcaaatccattcccctgtggaattaatgatttcaagtaactactatgctttactctactcccttcgtcccataaaaaatcaacttctagagatgaatctgtacaaatgcaaaggtaaggttttagaagtcaacaattaccttctccaattcctcacattgggccctactagtacagctaaaggtgctactttccctcctgagaagtggggactggagagagtggtgttctattctcttttgagagagagagagagagagagagagagagaaatttctctgttttttttttttgagagagagaatccagtcacattcccttgggtgtgaggtggtggtgggtcacatgcatggaggacttggagggtgaagcaacacatggccctgttccttccttcccaattcacattttgtgctgaatctgaatgccattgccatgctcacatgaatagctacccgatcactcttcagtctccacattgctggagttcattcaccactggcaatctggcattaggtgatgctgtgattggctgattgatgcgtcaggttaggtttgagagagagattggtggttcaagaagaatatggctttcagtgttgagatttatccttttatctttgatcatgcagtaacaaatgaaagcgatagccgttctgttatctgaaaatcaagtggtgttaggtgttcaaatgctgtcaatgaatttcatttcatggtaaagacagtgtcagttgttcaccgacacaagtaaattcacaaggagagagtgataagtagaggccaaattgctgccgacacatggatttcagagaggggaaaaaaaatgacgccgacgcatagtatggatgccccagaacaagattttccaacctctcccatcaattattactatgcaaattttttaagcatcttaaagcaaagataaagacttgcacctgtcaagtccaaccaaaacgcagtttg

SEQ ID NO: 61764 - DNA, 14346 bp, Oryza sativa
ttgctcacctgcactcacttaatgtggttcacggcgatgtcagaactgccaatgtagtactggatgtttattctaaatctaagctcgaaatgcctgggataactgcatttatggcaaagattgcaggttatggaacacaaaggctcctttccttggataaggccaagcatgaaatatttctaacagagaacatccattacaaggatccacacttcctcaagactgggctcatggctaaggaatatgatgtatatggttttggcgtggttcttgtggagctcttcgcacagaacatggtgcaaatgcatgacgtaaacatggtgctcaaagaacttgatggcattcctgctagatgccatcatcttaaggaaattaagaaacttgcttcttggtgtcttgcatccaaggtgacggagaggccagcaatggacaaggtagtacgatgccttcgagctgtcttgacaaacctgcaaaatcttcatgatccctgcaactgcaagtcaatgtataataagtctgcgatgcagtccgagcaaattaccagtgccaagtctgccagtagctgatagctccacaattgtgatataggaagttaatacaagttcccaattaatgtgacctaaatgtaatattaatatatattggtatatatgtgtttgtagaactatttgctggtcaaatatagggcaaagccataaacagtaataatatttcttgctggattttctgctgggatccagcgattggagagacagaaaatgtactgttagtagtagagatggcaataatgacaacacaaacccttctaattgtgtttccagcagatatccagatcttaagatgctgtttatatatgtgtaacattatccaattttacaataaccctcgtgatcgacaatacgggggttaaattcatctcactagagcttttttggttgttttgttgtttgttctgaggtttggttgttgcatgtttgcggaattgcatgcgccacagatagcaagtagcaaccgctgtatttagttctactagttagcgtgcacgtgcaaggcacatcgaattatatctaatggagtacaccatgttggttttttacactaacaatgaagaggagaaatatcaattcaaaaaaaacacattgcttgaaccaatcgagatacaatttatgttgtcaatcatgttcgaagaacgtgcggaagcattaggaacacagagccacctaggagtgttcaaccctagcacatgtggtggttagtgggggtgtggcgtcacaacgctccatatttaaggttagaggacttttacggtacattctacttcaagtattcaagtatatactgttagtatataatagggtaggttcggtatttgttaaaaatctgaaaagggttgtttagtcatttaaaatagagattattttggtttttttaatcatgaatagtgataaactttcccgtggttttttttctgttgtggatatcgtcatccgcgtgtagcgcttcttttcatttcatccggcgtccccggcgacggaagctcccggcgcacctcgctcccgccccggcccagcgcctccatcccgatattacctccggcgccgggagaagccgatcttccatgcgcccggcgtcttccgccgttccgcatccccggtgccttgtctctagccctagcctgttctcccccttatccgacctcccacagcttctgtcttccccaaaccacggcggcgagggttgatggttttggagtctaaacatggtttatatcgtataaagttcgaaacgatgttaatggttttggagtctgaacattcttctttcacggccttctctggaagactggaacgtgggagttgaatggatagtagtcacagaactgttcatacattagttatattggcatataaccatgctaattatacattagttatgctaattatgccgccctgccgctgccacctgccgccgccgggctgcccttgccgctgcgagctgccgcagctgcacgccttcttcccggcgcccttctgtagctccgcctgcccgccgcctcccgcagacagggcgtatgtcattgaactccgagttgaggatggtgtcgaactcaacgacgaagaggtggttggtcgcgttaacgtcgccatgccatcaaagctgagattcgcgccagtgaacccgttgaagacgaactgctcgtggccaccgcctttcgcagcccgccggcgccgcctcccgcaaacctgacgaattggggattttcggaagaactaggttttgggtgaggaaagggggagggaaattgaatcgattcccgatggcagcgacgccggttgtggttgtcgacggcggtgcggcgcggcgtgctcgcagaggcagtcagcgacagtggtcgcccacgcgcggcttcgagaaaaattcgctttgcctgtgcacctaaaggccagatctgactaagtgagaaacacgaatttacaaaattacccccacgcaaatagataaaaaagacaaatatgccccattcaatttatactgcagaataattgggagaaagatcagatgaatttacaccgttagatcaaatatattggtagtatatacttcaagtagaatgtatcttaaaagtcctctaacggcttgtttggttggagggagttttgaataaggaaatgggagtttaggagattgagctttttaatctctagtttgattagaggacttgggaattttagagggactggcatagagaattaatctatccaactcccaccgatcccatccctggggacctgttaattcacgagacttggtgggaattaaacagcagaagtccgaaatacccctctcccgcacactccgccgtccattgccgcgaaaaggaataaaaacgcgcgaaaaatcctgttcactgccgcgaggaggagtaaaaacgcgcgaaaaatccccatctcagcgccactttcctcgcccactccgttggccaccacgagaagcaataaatcctgtgaaatatcaccagcgattctccccattcacacgcgaaaccacagccaaggttaggttctgacgcaagtttgttgtgttcttgaaaactctccctctttctccctctctcctgtacagatcgagaccacagcctcatgaggtctggattctctctttccccatctttctgcagtacatgactgagaaatttgtgtctttctcctgtacagatcgatggaagcagctttgtaaggggaaaaggtggggggggggggggaaaaggtggttctgatctgctgttcgtacttctacgtctgttgttgctcaaggctgatttttttgtagttttgctctgcagtttatcacaccaaaagctgtaggtactgatgttattctgttctctatttttttttcatcagtcgattgccttgtttgattttccaagacagatcaatcagatttggtattttagtattaatggtagtaggcattttcccagtgtatagagtagacctgttcttaatttttttttcatcagtcgattgcctttatagattttccaatatagatcaattcgatttcatattttagtattaatggtagtaggcatttaatctgctatagaatgacacatagtgtattcgtcaatttcatacgtgatacatacagaatggagggggatatgatcagtatcaaaattcatcatgggggatctttttcaaaggagggtcaactttgctatgttggaggccaagtctctatttttcgcaattgtgacagcgaaaggatgtcatacttttgtctagtagacatggctaaagatgtaggtttcaagggtggagatgaactattctatgctatccctggttatagtcttgaaaatggaatcgacaaacttcatgatgatcattcagttcgtaaaatgttgaattttgcaaagaaaggcaagtcaatggaaatttatattaagcatcttgaataaggtgtaagtgctactccaatatttggacaggatgttgaagataatcatgtggaggaggtactgtacttagaaacaacttttcttttccttccgtattttttttctgatgtgctgacgtgtgatactgtgtcatttcgctatgtttttttttgttgtttgtgctgcttgtgcattttttttcctcatgagcatggtaccttgataaagtatagttagtacttgatcttgacctatttaaaatcctaataaatttgcaatataattttgttgacagacatggctcgccctccaaccaatcgagatattgtaatcttttggaacagaatgagaacacgtagagtgaaaatagtgatgacattgtatttattgatccatagcggactgtggagactaactgtggtgttgttcaaggccaccagcatcattgaggcccctggactggcagcggcagcgagaggtctcagcggcctagggtcgagtgaggattgatgtgcatagatgtaaatccaaacgatatcgtttcaatgacaatgtgagaataaaaaataaaataaatagaatatatagattatttgacaaagcagagataaccgttctttcgtttacaactatgccgtaggttgccttcaatatgaaataatcattctagtgctgcgctgttttaaagctaaacaggttgaatagagaattgacaagcataacaagtcataatagtgtcagtaatcagttacaaaaattgtcatatatcatgaactgaacatacaggaagcaaacacattctgtcagttagaaaaaaatgaaaagttatcaaaaaaactttcattgattttcagcctacaaatcataagaactctcattgattttagcgattccagttttcaattgtttcaatcgatctctagatcttgatggtactaacaacccattcaatataacttgattgtttctaggaagggatgatcatggacgtaagtaatacatacacttgattgtgaatcaatgagagtttcttttgttgaacgactgaaaaatttctactgcacttttgagtgaaatgatggcgaaaagaacacagtgaaatcaagaacggcctgctgctcaccgagtcaaggaggatgttggatgccttgaagacgctagatgaccggtgtgtcggcgtagtgaaggaaggcgagccccttcaccgcaccaatggcagtctacatcctcctcatccatggtacaggactatcgagaccttcacacaattacagttcaggtcagcttctacaagtctttccggaattgacacagaggtggtggtgacaaactgacggtgaaggtagcttttgtagcgtgaggttcagaatgaataaatgacattgcagactattaatatactgatggaaaacattgcaagatgtgtctagacaatgaactcaggagataacgataaactccagagcaaaacatggctgtccaaggttatgaaagattacaacgtagcccatattaatttggtaaatgttcagaattaggattataaatttagatacgttatatgaactataatccattgttttccataacagaacaaagatacaagtccaacgtagcccatattaatttggtaaatgttcagaattaggattataaatttagatacattatatgaactataatccattgttttccataacaatacagtaattcacaatccaaaatgcagattcaagtttagtttatggactgaaaaaaataatgtatgacaaggttcagaatcatttaatcaataataaatactgtcaaattttcaaaataatcaattcacgttcagtttcatcaaaacagtacatgtaaaaatgcaacattcaaataatgctgtacaagcatcaattgcatcgttccctcggcctctgccaagtgccaagtgaccaacatggctaaagagatcaatcatacagcattaatgtttcattgttggcctgataccgtaatgatacaacatgaaatattcatgaagtgaaaaatttctcaaaggtataaaataaaaaggaatttagtccatctaaaggcactcttagttttatatgcagagcatgctcaaaaccaggaatgacatggcaagctcgatgtttacataaaaatctctagaaagtttagaatgcgaatatacttaaacaaacttcaaagttttaataccaaaatatattaaatgaagggattttgtgaatctaaaggaaaaggtatcatcaagcagagtagcaagtcatatatatgggattagcatcatttacctctctcctgaaccccagttgttctcttatttgctgctggaccaatgcattccattcattccagttattgcatcaacttctgctacaggatcactaacaaatttcacaattccataaacctattaacacacccttaactgaaaggcaatggaccctaaatgcctcttgtagcatgtagtctgcaatatctgcagccagatcccaactacaatggcccaattcaatcgaaagaccatctcaacattcagcatcatttgtgcagtgtccactatatgtctgatgaagaacttgatcagcagctgcctgcaacgcttgtaatctcaacaaagtcataaccctgaagttgtccactttgtttatcccagataagcttcacagattgaacctgcaaatcaatgcaaacatcacaatatggtcaggcaaaaacacaaagttgacagcagtagttgttgtcattcatccattatcactggagcaaaaaaaccaagtcacatatagcagctatgtaactgttatatggtctgcaaacttttttttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgtctgcaaacttagcacccatgtggaaacatgtggaaacaatagataagtagaaacaatcaaacaaaaccttccaaagcccataaattagaggaagtaacctgttcatatttcatgggcacagctctagaaaaaaataatcagagatcagattgaacaaatatctgctgctgctaacaggtcaacatctatctagccaaaagcaaaagggttgcaataaagttaagtggaacctgtatcataaagattatttattcttcgttaagcaaaatataaaatgcaactattgaattgcagtgtgataagacactgcgcatgttatgaataaattagactttgtacacctttgcaatcagtattattatgatcaaatcctttccaaattgctctaaaaaaattgtatctcatcagtattgctccgatagaaatatatttccaatcagcattgctcctatcaaaattaattgagatacatgccctgaaaaagtatataatcacatccaaagtttaattacaacgataatataatcatgtgtttgcagaaacctcaaaaatatggattatacataaattgagctgtaagaagcatgcatgaactaaaagtaaaaatatagttagaatatgtatgcctattgcaaactaaaatgcaatcttaaaaataaaatcatgtttaccttgaagccaatgtcacatggattgaaattcaatctttaagctcaaaatagggtggtaggctgaggcgaggagatgattgacctaaatacctacaggcgcacaactcaaataactcccaccttagtacctgataatatcactggcttatttggagcagcacacatctgttctacttcctccgtttcacaatgtaagtcattctaacattttccacattcatattaatgttaataaatctagatagatatatatgtctagattcattatcattaatatgaatgtgagaaatgctagaatgacttacattatgaaacggagggagtaacttctaaatcaccttgcggtggctgtcattaatcaacccagtaatattaccctccactttaagtgtttacttccagaggctcacatgaagtagtcacattcaaaaataaatataaacattacttaactgaacctaacaaacacgttcacatattttactgttcaccaaaagaaaatgcaattattttgcctggtgatgttacaaagagtgcagaagacaaggaaaaatctgaaactaaataagcaaatatctgctactgctactaacatgtgacatcaattcactcaaaaggaaaagattagacattaagtgggattggaaatttttactacatgtgttcgtaacgatttaaatgccaatactaaaaattaaactttgatgaaaaaactttaaaattaagttttaaaatttaaattttggcagcggctgattttgtatagaggaaacgaggggagagtgttcggatcaccttttggttttacttttattgggacttgcatgttgttctggaactgaatttggcaagggcactaattgggtcagatatatgaacctgaaacaatgcacatgtgaattttcaaggctgaaaactcttaccttggtatattttgattccatggtataataatatgtgagaatgtaccaaaattagataaagcctttatctcagcatgacacgacaatgaatcaacagcttcgcagtcctggccgggagcaactcaatgagaccctgctcctacctacccgctggcagatttactgctccacaagcttcatactgcaggccaaacaattgtccggctggaactcaacataaattcacctttgtcttagacaggagcagcgagggagacgtgatccggatgagtttgcgtagggggggcagcgaggaatcgcggtggcggcgcagtggacaccggacatcgagggatcgacggcgaccggacagcaggagatccggtgccggcgcgaggctaatgcggggatcgacgatggccggactgcgtgggatcgacggcgaggtgcgatgcagacacaagggcgaagcggctcgacggagactagatgacgatatatcgacggcgccctgacagcggggatccggcaacggcgcgaggcggcgagggagaggcagcggggtggtgctgggaggatccaacacttcgtataagccgttggatgaatatatctaaggataaaaaaatatatataggtgtttgatgaagtcgtactttttgtgtgacaccttgaaaacctcaaatttgtaaaaatcaagtctaatttgatatatattaacaaataggtagaaccgagtctaatttgatcaattagcataggatttaggatttagttttagatttatttttcgagcctacttaagagtttatccgacggactttaatttgaaaaatgtgagccatattgtttgatcaaatttacttttggcccaggtcttcccaagcaggcccaaacttgggctggcccatcatcggcgagttgagtcaattcgacggcccttaagctgagcggctgagcacggcccacatatgcggggacggtccgatgcacttccgcggcccattgggcgcagcgtaatcaatagcagcgacggcccaacgctaggcaaatctgagccgtccaatctaatggacggctccaatcgtccccaaatccctctctcctgattccatttctctccggcgacgagcgccgagcggcctggacctcgtcggcggtaggggcgacgccaagccgacgcttcccgtcttcagcaaaggacggtggaggggtgcaccaggacagtgcgtgcgcagggacacgactgcgaggaggtgaaggtgcggcggtgccgcttcccggaaagctccggtgagctcaggggcttcaagtccgataagtaacccgaaccctcaggggcttcaagtccgataagtaacccgaaccctcagcttaattgatttggatttgactcttatggttattacctgaaattagggttcttcgaattcagagaattttgtcgagaaatttcaatatattttattcccccttttcgagttaggagagtttcattatcgtttatcctcttttaattttaggaacttcaatcaagtttatccctttgctcaattttgttttttttttctttggctggcgtttcatcgcgcggatggggacggagggcgccgctcgtccccttggaaagattgagattaagataagattttcacggacaacggaagtaaattgaatcgatctttttttttgttttaatgtttttttcgctattttttcgttattacggacaacggaaacatttttaattttttttaagtagtagagatagagaagatagagatatatagtaccgtgtcaaatataataggattcgatttttttttttccgcgtcacatataattcttcttttttttattccgacagatttgtttttttaattttttttttgctctttttttaccacgtccacgcggattcgtttttttctcgccgatcttttttgtcacctgtttttttttcgcccgttttttaggaatcggacagattccttttttatttctttcgccttttttttaccgtggaatcggattccttttttttttccctttttttttgccccttttttgatcggacgttcttttcttttttttcccccttttttgatcggacgttcttttctttttatgcccggttattttcgttcggtttttttcccgttttgttttggatcggacagattttttttcgcccggtttttttcgacagacgacagaagcaactcttattttttaagtagtagagaatagagattaatatcaatataaaaaaaactacatactacatctcatccatttggcatagacccaaactgattcgatgtaagctgcataaatcatctattcaccgatttcactcgtttgacaggtgccaaattctggtgcctggaatatgatgcagagaagtgtgctcactgctctgttttatcgtcaaggtaggtagcaagttattaaatctgtcaaatcccctttgaacattatatgaatatagtatatcaagttatcaaatgtacattacatcaaaattgttagtggagaaaaaaatacagcagggctggtctgctagcagtaacaggtaactgggtcctcttatttgtcaaaaaaaaaaaaaactcctaatattgccgtgtcacaggtatagcggttcttttccactggatctttcattagaaaatcaaacaatcctaggacaagttgattgaaaagatttatgggtaccgcacgatgcctctagtagtctagtagttaattggttagatgcgaccaacgtgcacaggtttctataactttcagcttatatggtttcatttcacatgttgtaaagaactactttcagattctttggagatatcgaaatacatttatcaataaaaatgttacttatgtgtatcctcttgaactcccatggtatgattcctcctctccacagaccactttaccattgtacacctaacatagtaagttgattagaaaatacacccatgactgtacattgatgtgatttgctaaattgttctcagcaaacctgtagcaccaaaataatttccagatgtgaatgtttgattggatcgcttgaacgttcaaactttagctattagggaaaaaaagattgctttaaaattcaaactttagctatgacaaaaaagaataaactgaaatagatggggttggcaattttttcttattagccaattaaaaccttataattgacaacatgctggagaacaagccagattaactaaaagtaaaagtagcacagtagtatcagattcagaaatgccacacaatcatgtcttggttgctcctttgatgtgaataaatcaaacgttgagaacaacaggaaaatattatggtccccttaatcaagatcaaccactcatcccccctaatcaaacgccatacaccaccaacagcaggtaaaatttggttagagaagaggaggaaacaggaggggaaccaccacacctggactcctagagacgagaaaatggacatttcgccatgttcaaaacgcggtttcgctagaatgccatctcaaaaacatgattcgataaaatgccaatatagagcgtgcgtctaccgccactttgccatttttgccattttattcattttcgaaaagattttctctcctctactaggtgatgagacaaaattgccccttatcaactcagagaacacggtgaaagatgagacagaataggcaaggagacagagagaaggggcggcgacgccgttgctgcccacaactactctaccggccggtgcgccacctctccccattcctcaacctcgccgctccccgccacaccccacgccgccaccacctgtgctcgccgccaactgaacagccaccccgccgacaactgccaccaactgtcatcgtcgtcggtcgcgccgggacctgcggcagcggcggcgaggaccgcatcagcaacctcccggacgaccagttgtgtctcgtcctacgctggctcgacacccacactgcggtcgccacgggggcgcttctcttttcttctcctcttcccctcggtttctcttcctgttccccttttctctcttccttcttagctagcgaggaggcgcagctggtgcagtggcgaggctgggtgcggcggcacggccgacgacccgaccaaggcgatggcggttggcccagcgcggcggcggcctaagggcggccaggcggcgtcgggtggatggggagagaaggccggtgcggcgaggaggtgccggggcggcaccggttagaggaggcagaggtggaggtgctgggtggtcacggaggcagaggcggcgcgcaaggaggcggtgctccacacggcgcggcggtgtcccagcgcccatgaagacggccatgggggcgctcgcgttgctcggccggcaagctcggtcttgccccatctcacaccaccgtcgacgccctcgtcagcaacggtgaccacctcgccatgctcgatctcgatcccctttcaaccgacaaggaggggcaatttagtctcatcaagccgaattccagtgaaaatggatttgaaaatgacaaaaatggagaaaatggtaaagtgactgtgatcacgcgcttcatattggcattttagcgaaacatgttttcggaatagcattccggcgaaatcgctttttgaaagtggccaaatgtccatttctccctggagacggcaaggtcatccattgtgtagatgaagtcaaagccctggatcttctatcggtcggcactgtcaccacgaggagagcgggcggggccatgggggcgtccaagcagcgcaccgccactgctgcccttgcgttcacgcgaatcaccagcacctcctacacccgatgcagcggcgcgcaccgtgggagtcgagctcaatggcggtgcttgaggtgccgaggggtggccctggttcctcctcctgatgcgacgcgcaacgtgggggtggctgcgactgcagctgtgcaccgaaaccggtcctctccaccgtcggctcggctgcctccctaagcagtccgtcgccacgtttttcctgatgtccgccatcgccggagctccatccctccgtggctgtcaacgaatgtggctggacacggtcacagagaaggggaaccgaagatgggaggccgccctgggatgggagtggtgggaggacgggatttagggggtggatggagacgggaggtgaggcggtggatcggcggcgagggtgaggtggcgtgggagggcgaggtcgggcacgacgattggggcgaacacgtgatggacgaggagcgggagtgcgggcacgatgacgttctggcgggggagatcgtcggcaacgtgtgaaacgacgagagggagagaggattagggtggcgtggaggtggaggagacgcagggcggggtggtggggttgagatctgagcgaagggcgtggggcggtgggcggaggagcgaggccatgaggggcgtgaagggatcgatgtggagcactggatgtcgcgatcgtatcattaatatcacgcgtgtctatcacgttagtgtcaccaataccattataaattttttaagtagtaataactaatatctctatttctatctctatctctatctctactactccctccgtctacttttaataggcatatttcatcttagcacaatgaccaagaataagtaattctacttatcatccatttaaacatgctactctctccgtctacttttgatagacatatttctaaatctaaaaaaaatatttttgatagacatatttcaattgaaccacttatcatcttaatgactttctcggatttaa

SEQ ID NO: 61765 - DNA, 1197 bp, Oryza sativa
ctccagattctgccacatcgcaaaccatgaatccaccaacggccgacatgagcgcggcatggcgcggcgagctagaacgcaacgtaccgtacctggaggaggttgttgggagggaagcgagcggcggcgggtgggcgtgcgggcggcggggcgagcggctggatggggcagtggagcgcgacgtgcacggcgagcgacacgaagacggcggcgaggaggcccagctgctgcgccatgccgccgatcgacccaccaatgtgtagccgacgacgagctcgatcgatcgatcacgctatcggcgtcgactcgactcgccctgtagataagctggaggtgtcaggcatggcatacacgtgacgagtgggcacacacctgttatcgttagcccaagccacgtctgttttggacttgcccattattgcaccacataaaaggttctggtccaaacaaataaccgaaatttacttttctgaatacgtaaaaaattggaatccatagataccgtggtttaaacctgtaatgctcccctcgttccatttggaccatttagaagcctcaggtcactcatggattctgtaaaaggcaaaacgcttgtggactagagttaccaatccacttgttgactagccagttaaatgacatagctttatattccattcgtttcaaaatataaggtttctttgattcaaattcataacacaatataaacattactccctccatcccataatataagagattttagagggatgtgatatttttcaagcacttcgagtctgaataggcctgtccagattcgtagtactagaaaaatatcgtatccctctaaaatcccttatattatgaggcggaaggagtactacactaataactcatatggttcccatcatcatgaattccaaagcccagtcggatacttggaaaggtaatctaaacaattcaaaattcaaaaattgacaattgaagtgattaaactactgctaaacaactagaaacaatccttatattttagaatggctagaggaagtaattagtaccacctttgttcctttttacttgtcgttttggacaacacagttttcaatgcacaaaactgatcactactttttctaattatatgtttaaaaaagtattaaaattcatatataaaagtgttttcatgactattctactactaatagtcttttattgtgttaa

SEQ ID NO: 61766 - DNA, 22986 bp, Oryza sativa
aagacgaatggtcaaacatgtgagaaaaagtcaacggcgttatctattaaaaaacggaggtaatattaaactgtggtgttattttctcctgaagatgaagatgaagttttttttacgcaaaacgaggtggtattaccgtatgattgattgagttttaattattataaacttgaaaaatagattaatatgatattatagagcaacttttatatagacagttttcgtacgaaatacaccgtttagcagtttgaaaaagtgccactaaaattttaatcttaattcaactcttgttgaaaaaaaaacgagacctaagtaatataggaaacaagtgctttgtgctagcagcacgcattgaggatagatatcaactgtcaaccaaagatagtacatgactatgatttttctttgtattaagctgagttctttttaataacttgaaacggtttaattttctctttttcgttagcacttttttagaaatgctaaatggtacattgtatgtaaaagtttctatatatatatatatatatatatatatttttaaaaatcttcttaagtttaaaataatcgatacactattaagcatgaggtaatgactcttcgcattttcgtgcccggaaaatcaacgaccatccaacataatcaaaatagcccttaggctatgttcttcaatttctttcccaactcatttcattctttttaggcaaactttttatgtccacacgcttctcaaactactaaatgtgtgtttttttaaaaaaaaaattatgtaaaaaagttgcttttaatattataagactttttagcattgcccacattcatatatatatatatatatatatatatatatatatatatatatatatatatatgcgcgcgcgtgcgtgcttagattcattaacatttatatgaatgttggcaatgctagaaagttttataaactgaagcggaggtattacttaattaatcatgcgttaatgaggaacacccttttttcgtgcgggaaggtggagtttcgcaaactcagccttagtcgttgtttgctgtattaacgtgcactaaaatactgtaggagacattttcacgcaaaatgtagccggagttggttcttttcttgaaactggtcacatggctaggtttttttattttcaagcagaatcaacatactatttttcttcttttagttgacaagttcaaccagatggtttgatcggaattttcgaaaccatagatgttatatttttaatgtgacaccgcttacaagaatactatatcaatatattattaccattccaattagttccttaccatcgtatcatttccatccctataataatctaaggttgcgttcgtttgaggggttgttaaacaaaacggagctgtgaattagtatataactaattaaatattataaaaaacctaataaataaattaatataatttttaaaagcattttcctacatagatttttcaaaaaaaaacacacagtttaactgtttaggaaacgtccacgtgaaaaacgagacacatacacagtatacactaattcaaacaatatttcactcatgataataaaaattcaaatcacaaactgcacttcccctcaaataatatcgaaattgatgcttgaccagtcaacactacttaatcacacacaccacccagagccaaaccagattaaatcaaggtcgggggttgccttgcctaaaccaatacaaacaagctgctaatccaaaatcaatgtcccgtccgatcgcgagatcgcgatcgcaaactggcaaaatcgcacccgcaaaaatatctcggcacgagtcgacgcgacattccaatagcagcagcagcaagcagcattcgcattggccttcgcgcgcttttgcgtttacacccctcgcgccccctcaaaattgcagacgcccccctcccctcccctctcgtgctctcctctcctctcctcttcctcctcgcctcgcgtcgcctcctccgcggcgtaccctaaccctagcctcgccttccccccaatggcgcgtcacgcgtgaggagccgccgccggagcagcaggagcgggagcgggagggagggaggaggagatgtacaagcaggggggaggagggggagggggagggggaggcggaggcggcgcggggctggaccggaagcgaatcagcgacgcgctcgacaagcacctcgagaaggcggtcgcggcggcggcggcggccgcgtcgccctcgacgtcgagggggtcggcgggggggaggggcggtggtgaccaccagcgcctcgtcgtgccgtcctccgcgtcgtccatgcccaagggacggtgctccgaaggtgacgtcacgcgcgacgcgacgcgaccgactcgccttccccctcctcttttttttttattggccgtctcgcgtggcgcgtcgtgcctgagattgagaaatccgtcgtttgcgtggtgcgctgatgcggttgcggccatgggaggggatagattgcgctgcggcagcagggaactggttctggattggtattccgttgtgtttgatatgattagtgattgcatatattcgtctttatggggattcaggcggctgcggtagaaatttattgtttgattttaaacgttaggattaggatgtctgcggagctttcctaagagggaaccattcgtcacatgtggtgtttgatcgatggcatgagcttatgaacctgtttggaactatagaacttaacagggaataactaatttgacgtaggaatgtaattgattgttgattgtggattttcattagcggcgaagttgttggagcgttggaggtattgtgactggtttgcaatgatctgtttaatgtatcctaaatgtgttgaagactatgaaagttgatttatttgttctatatgtgtgtagagatgtcagtttaagtttttttggaggtgtttcagggttgtgttaattgggctgttgttttgatgatgtttgaagatgctgatgtaggatcttattgaggaagtgtttgcttgttgtatccgatttaccatctgcttgtttcaggcatagacgcatagttaatgttgtgtaaaagcacacaaatgccttaaatggccttacctcccattgggctttccatatgtgcaccgcaaaaaagattaacggcattgtctaacatcacttatcttcatgattttatatgcaaatacaacgcgtggcttaattacgtacaagaataacaaaaacaactccaaggacaacaaaaataaaaacaatcctgaaattttttgcatgtgttgttgatttaaaggttaattgaaattacattcctggagtggtctccgttaccaaaaccaaaaatcaagtggcccatacgatcagtaatatcttatttttatgcttcattgattgcttaaatttggttccattgcccagttctttgcatgaatgttgccagtcgggttgaggagtccattagtttaattcatctatgctattgcgggtctaactggagtataacttttaagttttttgaggtgttgattaagcatgctatgttttatttcagatttgatactgtgtttacaggtatgctgcatttgcatcattgtttgtaaaagcctttgcattgacaagtccatgcttgacattgcaggggagtctgaatctgatagtgaagcatcagatgttagtggttctgacggagaggatcactcatggatttcatggtactgcagtctaagagggaatgaattcttctgtgaggttgatgatgattatatacaagatgacttcaacctctgtgggcttagcagtcaagttccatattatgattatgctcttgatctcattttagatatcgaatcttctcacggtaaatgttccctgtatttacgtatgcaaatgaaacaaatggtggatgtatttgagcaaaaaatgtttcctgtatttcttccttgatctgcttaatagttgaaactggtatcttgtattgatgatgtccaaacagaggtcaacttagactttttaaacaaaagtacatacaattcttagatatttgttcaactcttaagctagatattagatattgtggagtaccatgactaatttaaggtacctctcctagaaagaacacaaaacatagatgttcctttttttctcctcgaattgatctctgttatcaacttctatgattatgaacaaataaccagtgcaggtcaaaaggccttttcttttactgttagttattgtgcttttgtattctggatgaccgtctcttttgcaactctgcatatggctgcaccatcatgcgttacttgtcgtttgctccttgatagtacccatagtacatgcttagaaactttctgttctattacatggaaaattaattctcactattattaaaccttgtgattttgttttgttcttggtcacctgtttaggtgccctaatgttattaagagtgatgttgctaatagattgctttaggtttctgtggcagtaaatggtgtggtagtaattagcaagcatggagaggatatgtgtgttgttttgtctgctattttaaatgccataacccatcagtaatgtaacacagccttctttatggcatcataatgcagtagctccctttaatccatgttctcttttctactgttctcattctttttgctaatgtttcttgattgtgtcaatatgtaggtgacatgttcaccgaagaacaaaacgagctagtggagtcagctgcagagatgttatatgggctgattcatgcacgatacattttgaccagtaaaggattggctgcaatggtacctttctttggtatttatattgttgtacttccgatttatgataaattgacagttgttaatattttttgtcacagctggagaagtacaaaaactatgattttggaagatgcccacgagtttattgctgtggtcaaccctgtttaccagttggacaatcagatatacaccgatctagtactgtgaagatatactgccccaagtgtgaagacatctactatccacggtccaagtaccaaggcagtatcctaaccactctcttatcatactgtctatatgagcgttccttttttgtttttctctggaagaaaatagaattcctttggatttccagcattactatattctaatagttttgccctaattcgctgataggagtggttggcaaatgctttgacaagttttaacaggcagacatatacagttgttaggacgactaatatcaatactaaggacataaacaattcagtaatctttaacgcatggtcttttgctttcttagtgttctcagtgccaatatatattatcgcttattagatgaagtccacacactctcatctgtgttacattgatatcatagttacatagaactgccattttgttgttatattctgctgttttcttgaccatgttcagacatcgacggcgcatactttgggacaacattcccgcacctgtttctgatgacgtacgagcacctcaagcctcagaaaccctcgcagcgctacgttcctcgtgtatttggattcaagctccacaagccatgaggcggagactggagttttgcagggcttggagacaccctggtggactactgcaagagtggggggcatttgccagcgatggtctctatcatgccgccactgccacctccacaggcctgccgcatgcatgcaccttggcaggcaggcccactccacattcgaagtgtagctataaaaagacatcaatcgatcaatgttgtaacgtaattccaattgttctttaattagcgaatctgtgggatcccgtaattctaaagtagccgatgttgtttgtgccttgattaaaatggtgtgctgccccaggcattggtttattttatcttgtaagttgtaagcaaggttcatgcctgcaattggaaggcgagggatgacaggggcaggccggtattctggtccatattgatctggtattctgttgcttgctcggagtatccacacaattcatcatcatggtggatggaagtgatgttcagtgctcggtattctggtaattctagtagaattttattttagaattattgtaatggttttaggcgccttccatttttcaatcctcggccttttgaactgctaaaataagagtagaagtgttataatcattcatttatttactttgctgctggtcatgaaccgtggctgtaaaaagacttccaaattccaaaaaggccttgtttagttggggaaaaaaaattttggtttggttgtcacatcagatatacggacacacatttgaagtattaaacgtagtctaataacaaaacaaattactgtagaattcaggaaactacgagacgaatttattaagcctaattaatccgttgttagcaaatgtttagtgtagcaccatattatcaaatcatgacgcaattaggcttaaacgattcgtcttgcaatttacacgcaatctgtgtaattgtttttttctacatttaatattctatgtatgtgttcaaacactcgatgtgattgcgtgaaaatttttgttttggggactaaatagggcctagcgataagcgataagcgattctcccaagtcatccaggccaaattatttggtctcatacaacttttcttgattaataaaaataagttatttggtcttgtactgtactaccagatagactttgtaaggagagccagccagcaactttagactgtgacagggactcgaagacacagggagaatgggaggctagtggcatgaatggttgctttcagtctgagagtcaggtaagctcaagctggaggcagtaccagctggtcatagcacagtacaaaaagtaccctttttttgttttttttctcccatcagttcgaccaggcaagcatatactcctaccagggaaacctagcaaactactccctccgtcaaaaaaaaaaaatctaaaactgaatatttattttttgcgagacgatgtttgttttttcgggacagagaaagtactcccttcgccgtagaattcggtctgcgcgtatacttcctgacttgttaaacaatgtctttttttaaaagagaagttctacgaaaacgttaaaaaatgcttttaaaaattatattaatcatttttaagtttgaaatacttaatactcaattaattatgtgctaatggttcacatcgttttgtgtatcttctcaatcttctcctttccctcctctcaaacacttcctaaggatgtgtttagatccagggggtaaaaatttttgccgtgtcacatcggatatatggacacacatttgaactattaaacatagtctaataacaaaacaaattacaaatttcgcctgtaaactgcgagacaaatttattaagcttaatcaatccgtcattagcaaatatttattgtagcaccacattatcaaatcatagagcaattaggcttaataaatccatctcgcaatttacacgcaatctgtgtaattagttttttttgtctatatttaatacttcatgcatgtgtccaaacattcgatgtgacagggtgaaaaaacttgccaggggaactaaacaggccctaagattttttttgtctttccctattgtcccaaaataagttatttttgagcaaccattgtaccgaagtttgtgaaaataggggataaatgtattgggaatagatagagagcaataattgcattggggtttgataaaatgaggatattgtagtcttttttttatattggtatatgtgggatatgtgaaaaataaacttatttgagacataactactaccttcgtccaaaatatagtaatttttagctatatatctgaatatgctcttatccagataaagatatatagctagaaagttgttatatttggggagtagtacaattttcgaccaacagagacattggtgcattgcttggacccatataattaggatgagtcagagacattggtgcattgcttggacccatataattaggatgagtcacattgtttacgatcgatgggtagcagatagggatggaaggagaatcaagatctaacaagtcaatggggtaggagataggtatggaaggagaattgagatctaacagcttacagctagtgggagaggaatggagacaactccgctgttaagagacgagaactagcgacacatccctaatcttactaaaaacatgttaaaagtctacttacatgtgcataatattcgtatgcatgaagatttgaaccttggtgggtgaagtcatgcacccacgactctacccgccggtgcttccacttggtgggatagtttttgctattctaagatcctcaatacaatgtttttaaaaaaatcctgagtaccatgaactttagaaagcaaatccttcatatttgccttaaaaaatatgatcccttattcactgcctcagatttcaaggaaggagacattgaggtaaataattagataaaatttcaggatatttttccttaaaatttgtgccagtgaatagacaatatcccctacggtaatttgagactaatgaagaggagtaatttcctcttaccaaaactgaagctccaaagatgtgggagatgataatacatggaaaatatatcgaagtcacatgaggttctggaggtaggattgactttgcttaatcatgcttaactttaaaaagagctgtttgatgctctcatatcccaagatcaatttacaccttcacctctcgtgggcatgccaattagcatagacttaaccattgtttaggatgaatagaaaaatactacctctatttttataaagatgatgccattgactttcagtgtaacgtttaaccattcgttttatttcaaattctagtgtaaatatgaaaaaaaagttattttaaagttatgttaatgataaaagaagccacaaaaaaataaatgatacttatatagtttttagtaagaaaatggtcaaacgccatgccaaaagttaatggcgttatctattgaacaacagagttaatataaagctaaaactcgttgagtcaaagataatgtttaagaaaggaactcttagtattcacaaattcaacagagacagtttatattgccgcagctttgctatctgcaaatttcagatccagaaatatgtaactcaacagagcaatatgtgtttcgatcagagatctgtttgacttacgaaaaaagaaactattcctagcatttaagacgatggggagacgttgataatggataccaggttccagtttaagctgacatgtcagttcttcagcagttacttcggaaataacagaaaacaataaacatgcagttcaatagtgtcagtggcacaaaacagggcatcattcctccatagtccttaatatatgagttgaattgatctttggagattttaaggacaaaaatattcactaaagaagcattttacttggtgtcctaagaagactccaaccaatattgtaagccatggacagctatgatcagaccatgctttgccattcttaattctaattgtatacttttagatcaatctaatgagctgtaatgaaggacagctaagaaactttacattgatactaagtttcacatgttgttctgaaacgaactgcttgatatccatgtccgttgctctcacattagcataatgtacatcagaagtagaatcctaccagattttttttttttgtaattcttatcaaaataaattcatacttaagagagggagatcatggaaaacaacgattgctgaatatcatttaatcatgtatgaattatttcaactagttattttttcaagattattagtaagtactaacaaggagaaaaagacataatttgctagacatgattgattagttttggaaatagtatcatttacgacatcaaaatgtggagattattctagttccacaaactaataactagattgtagatgtaaaacatgccaaaccttcagttactaaatgaaataaactgcatgggccagatatgtaacaagaagcagtccatgtgatgtaataattttagtaactaaattggcagaaaacattatggaactactacatgcaacaggtttgcaagtcccagctcccaaaggtcaaccaaatttactgaaaatgaaagcatcacaagagaatgataggggttgaaatcatcagtggggtcaataagtcaagagggttggtgtaacttgtaaggctatgtatttagtgctctagattaggttagtgaaaatacaattctaagctactagagaagagacagagaagaccagtatttcttccagagcttaccatgaaatcacactccagtctctctccaagcttcagaaccagacatctctcctcttctgtgcaatgaggtcttctaactttagtggttgaattttggcagtctccatgccttcttcacaagattatatatacatcagtttcaccggtcaaagtaagcacagccttccttgattctcttttgtgcgactttgtgatgccttcttgcattatatacactacatattaaagtcacacattcttggagcagagctatgtacctaaatcattcttagaagtaactaaccttcttcaacccttactttgtaaccatggctttctctactactgaaatctctctatgtagctccattggacttctaggaaaggaggtggtctttacatcttgagcgtccagaactgagctatttgaacagccttcacttgtttgtttttcttctggtgaaatattggcatcacctttctttgacaaagttgaacattcatgaattcttcttaacttttttttttatcctctcattttcctgagatcctacttccagctcttcagttggtcttgcaagttcatatgttccactgctttcttgcaaagaatccttgccttgtttacatgcctaagtttgttgctagcatcattctgcctatactttgattttctcttgttttctcttccttcttgcaatcgtgacaagatttacaattgtaatgctccactctgttctgaaaaaactaccatacttatccaaatcattctagcacaatcacaatgggctgcttcttctactcaagagagaagaacaagaataagaacaagaagcaatcaaggtcatcccctacactaaccgtagacaaagatgacttcagagatgaaatgtccaagaaggccaacagatcatgcagcctggttgttgcttcatcaccacggagcatactggagctatacgaggagcgtgcgcatgagctccgtgattttcgccttgccgagctgagaagtgctaccggtaacttcagtagagagctcaagataggggaaggagggtttgggagtgtgtacaagggcttcctaaaaacttcttgcggtcatttggggctcaggaatgacagtggcaatgtggtggtggctgtcaagaagctcaatcctaatggaatgcaggtattgattgtcttcgatagaccttatgaatgttagatgctataatcatgtttctatgtacactgcaattgttaaatggagttgaagcataccttttattatgaaacaaagggatgcagggagcctgggatcaaattgcataagtaaatatactgattctgcacatattggttactttcgaatcgtgccgagtatattatttaatgtaggattccaggctgtgtaacaatttttatacaaatcgcatttagtactctaaaaagttgggcaggatggtttggtcaaaattattatcacttatggaatggaatgtgaatgttagcctcaggatgactgatgacaaggattttagcaaaattattctcaaatgtagactactggtaaaatacatttttagttcatattttgcatttcccatgcataatactcagcaaatatataactgtcaaattatagctgcatgttatagaaaattatgcctcacgaatttcttgtgtcttatatgcaaaaaaggaaaatgaaccccccatggcttgtaagttttaacatctagaatgcagtaattacaacattttgaggaatcatgcacttggagtagcaatctgaaaaaacaaattcttccattaaatttgtttaaatgttatttatacttctacaattcttccagtatgaccatcaattcaaaaagttgatttattcctcaattacatcactttcagggtcataagcagtggctggctgaagttcagttccttgctgttgtggatcacccaaatcttgtcaaactcattggctactgcgggactgacgacggcgaacaaggtcctcagagacttcttgtgtatgagtttatgcctaacaagaccctagaatatcacttgttcaataaagcatacccaacacttccatggaaaacaaggcttagcatagccttgggcgttgctaaggggctgcagtacttgcatgaagggttggaaattcaggtattggtctaacaacttcgataatcgatatattgagtattgtcagttacaagttcagagaacaatgtaaatagcagtgctctttttttcctcctcttttcttctgctttttctgctgttttctttaatccttactattagttgttattagaagcttagggctctagagctatgttacattagtaaacaaataatacagctgtttcccattaatgctatctcaaaacccaagtgctcagagttaagtgacaactcccagttgttccagttttgcaatgatagtctcatagggatatgtatcaggagctatgattcagaaggctttctgatctataattctatacttgttagcgcaaattaacagagttttccagtgtttatattctgaactattgatgcttgtgttcacatgttgtagagttgtagacttgtagttatgacactctttatgttacaggtcatatatcgcgacttaaaatcatcaaacgtgctgttagatgaggaattcagaccaaaactttcagattttggattagcaagggagggcccagtggatggacaaactcacgtgtccacagcggtaagtcatttgtcatcagtactagcaagatggttaccatttaccttaagaactacttgcattcaatctgcacaaaaaaaaaagtagaattacagtattttcttgaataatttcatggttggttcgaatcgggcatcaaaacggtctagaaagtttggtaggcggccaaaccatcgtttcaggcatttgtcctgacatataatctgttttcacctggagagatgtgttttcacaaaaagattcatgcagttcaacgaatgcgaaacttccaccctttcaacaaaaataagctaaccaatgcaacccctagaaatttaagatctgagagttggcggtccaatttagttcaaagttcaaactaatggctaaacttttgcaaaaaaaataaaataaaattcgatcggagactaatggctactccctccgtttcataatgtaagtcattctagcatttctcatattcatagtgatgttaatgaatctagacatatacatctatctagattcatcaacatcaatataaatgtgggaaatgctagaatgacttacattgtgaaacggaggaagtacaattttaacattgggtgttatggttatcaaaagattggtacattagaaatcaattttagtgcgaagtaggacaggaataataggattattatgtattaatctgagcaatgcaagcatgaacaatcaacaacaacgtgtgatgtgtatgaaacgggcataaaatcaaacaggtgatgggcacgtacgggtacgcggcgccggactacgtggagacgggccgcctcacggcgaggagcgacgtctggagcttcggcgtcgtgctgctcgagctcctcaccggccaccgcgccttcgaccggagccggccacgccccgaccagaagctcgtcgactgggcgcgccgccaccccgcgggcacccggtggttctcgaggctccccgacccgcgactcgcggggaggtactcgcaccgcgccgcgcaggacgtcgcggcgctcgcgtggaggtgcctcgccgaccgcgccggggagcgcccgtccatggcggaggcggcgcgggccctggagcgcgcggcgcggcacggcgagctggatggtccccccgagccgccggaggagggatcgcccccgcctcctcgctgccacgccggctccggttcctcctccccggaggcgaagaaggcagcgacggcgaagcggcggcgaatggcgcacctggccaagctggcggctggcgcgagcgcggcgccggcggcgcggaggctggtgcacatgaagatgacgaaggcagcagctacatgcaacgcaggcacgcagcatggtgagacttgagacctccctgtgttcaaagttcaaacgcactactattctatcatgtaatctactcctcctattctatattacttcctccgtttcacaatgtaaatcattctaacatttttcacattcatattgatgtgctagaatttctcacgttcatattgatgtgaaacggagggaggataagttatttgattttcttttgttaaatttctttaaatttgatcaatttataaaaaaaatatagtagtatttacaaaacaaacatattatcaaaatatattcaatattagatttaatgaaactaatttgatatattagataaaaaaatatttttataacttggtcaaactaaataaagtttaactagaaaaaaaatcaaacaatttataatacgaaatgaaatggaaagagtactaatttttgggataattacgacctgattttgtttcgatgacttgctctcgcctgttctactaccattgcaagcctgtgctgtgcatatcatttttttttcaaaaaataagtgttttggtttctcttaagtacggcattgggatattcttcatttgaaaaacagcagcaatttctgatttcttaacatcaccacatagtttgaacacaggatgtgtaccgtaccaaaagtggattttaatcttgacgactacactctccacataagagaattcatcagaagctagaaacagaacggcttttgtgttttgtcatttgatccaagcgtaaactcaggatggaaaactggaaccagaaaacttcgactttgtaggctcggagaaaaatattcactattacaaaaatccatgcaggagtcaagttaaaagaagaaacagggttctgtctttgagatggagtataatttatttaagatcattccctccatcccatcatccatgagtttgcaaacttcagctcacattctaaaaatgaagatgcaaaagagagagagggacagcaacttaaaaacgtattgatcaaccagccaaagcggcattgagcgcactgtgaacatccactccaatctgagcttcggccttctccagttcagttgaggccgatccaagcttggcgttgaattccgcgagaccctgctggaccgcggctgggtcgatctggtccagggggacagcctcaacagccacgatatcagcgatggagtttgcatggacaaatgcaaagccactgctcacaaagtacttggtgatatcgtttccctcgtgtaccgagagaacaccaggcttgagctctgcgattgtggaaacgtggcctggcaaaacacccatctgaccagttgttgctggtacaattaccatgtcaacctgagtatagacaagcaaagacataagcaagggaaagaagcaacagaagacaatattgatgatgggggaagaattaattggtacattaacagtagtattgttgaatcaagcattgacatacaaaatctatgtgaatcaactgatagataatttgcctatcatctgttgaaatgcaacaacacaaacatagacaaccttcgaacaccatcaaccaattatatttcatacacaatagcaacaaaagaacatgacgctcagcaacatacttaaggaaaaattgatgatctgaaacttcttaatagtgccattaaccattaagtaaacagtaccaaaccatcaaggccaacaagcaagctaaaggaaacaacatgaaacaaagaaaatcaccacaaaactaaacaagtagtattagacttggttatcacagggcaaataacatatatcaaggacaaaagctataattggcgcacagtcaaaaaagaagctgcctatgcagcatagtaaaatataagtgaatagtaggctatattaatatgcagttttatttatagaacttcagaaggaaagattttctcaaccaaagaaatttacatcaggaacattgacagtgaatgttcagacacaaactctagttaatgtaaacaagagaaactgcaactataccgataaatccagacaatgcataaagccgcatagcactacaaacactagagataaacaggtctgaatacactgttgtagtcagaattaaaacttggcctggcacacagcaatcctagcaagagaaacttgaaatctataaataagaaacacccaaggagcgacctggaatcctcaatctgattaacaaaatgtaacggggtttccaaaagatacttcactagactactactacctctgtccccaaggagcggaccgtgtttattgaagattttgtttggttggttgtatgaatcacgaatttagccaggttcatagctaactaaaaacacagtcttttaaggcgaggaaatatcaatttatgaattctctatgctccttgcaattaaggcacacaagcaccccaaacaagaaaaaagaaatgcaatttgctaccaacactcaacagcaatcaaatgttgagcagaaattctatagtcatatgacatctagccacctggagaatcacgctacgttatgtttgtcccatgaaagaacatctccaactcatagcaacaaaacaaggaaatacctggtatgattcaacagccatgtacaaccgtaaaccgccacacattcgtgttaataggattgcaaatacgcacgcccaacaaatggccacatcacaaacattctgggcaaacgataaacggaggatagaagcattgaccatgatatattcctacggatgaagagtctggatgcgagacctctaccacaccagctcgacgaatcggatcgcgctgccttgacccacccaacccctatccctaatcgcacgacgcaaaccccagatcgcgcacatacccgaaaccctagcgacgccacacgcacagatctggggaccgaggaggacagaggagagggggaggggggggggggcaaacacggtccgcgcgtacctccttgttggcgatctcggacttgtaggggaggacgaagttgacggtgagcttggaggggatggccgccggcgtgggggggcggggctgcatgagcgacatgggcgtggcgggggcctcgatgttgggggccaccttcttccacgcctccgcgaaggcggagtcggtggccgcctcggccggcacctccgccgtcgagagcgccctgctgctgcggccggcggcggcggcggcgcgggtggtggccaggcggcgggcggcgtggcgcagcatttttctctttcttctttttctctctctcgtttctcctctcgtcgctgcggctgcgcgtgggtgggtggaatggggttccaggggtgtgggcgatttggagggcgaggtgaggtgaggagtgtgggtcagtgggagtggaggcgagtttgggctgggccgtttctatatttaggctaggtcgcctgccttcttttcatatcatttaggaataagttcacttgaggtcccttaactgatcaacgaatccgattttggtccttcaaccaaaaaaatagatataacggatcccacaactgtcaaaaccggcgcaatataggtcccatggcggtttggacggtggttttcgctgccatgtcgcttacatggctagtttgactcggtctttattctacgtggcattgccatgacaatttgatctgggaaataataaaaaccgtggacccatatgtcagctataataaaaataataattaaaaatggtgaggcccacgtgtcattctcactccctcctcttctctctcccggtcgttcttcttcctcctctgtcatctcttcatcatgtggaaagagagagagaaaggagcgaatgagaacacatttccatatcaaattgccactttaaacgtcacgtggatgctatatgggataaagatcaagtcaaactagccatgccagctaaaaccaccgttcaaaccattatgggacctatgttgcaccgggtatatggtttccggttgaaaggtgaaaatcagattcgttaacaagttaagggtctcaagtgaacttattcatattgtttattggattttttaaaatggattatttactccgcgtttctaagaatatgctttctaaaaaaagaatttttattggattgcttagaacaccttgttaaagttatttattaaaatgtttaatttatccatataatcaagtagataatccacagcacacatagttcttatatgttaaatggctactttttttcatgcttaatggacgaagcgttttgacaattattagaggatacaaacaaatgaattatctattatcaactcgaaaaatggatttaaaatggtattctaggaagttcatatataaaaatattttacaaaaattacatcggaaaacatgccaccgttccattcttctcctcttctaaattaaaaaaaaaaactcatttcttccttaaacattttctcattttttccggtaaagaaatatatttttttaatttatttatgggttataatacaaagcagaggtttgcaatgaggatgatcgcattctttctgaaccagactacacaaatagccacgttttggatgggaacaatcacaagttcatggcaaaatgatagtgcacccagaaagcatagacacatcataattgattatatttagcataagagcaaccaagctaggtatttcggaaagacacgatctacagaatgcacctgcttacatcaacctggtactagataaatactgtgacatagccatagtcctgcatttaactaaaattacaaagaaccaactgatcaatccaactatcctttgggttttataaacacagcacctgcagaaatccccaacaatgatgtcagccctaaagttaagaaagaagccaaaccaattacccgtgcttccaaagaggcaccgaatcaaataatgaacacaccaacagtaaagaaattgatatgtggaaacttagcatcagtttttaacgtgcaaagtcaaatgcaatatatgcttaaagcctaaaaactattagaagtaaaatatttcttgtaattgagcagctgatggacagctatgctcaactaaaaggaaaaacttcctaaaattagtattcatagcaatatggcatccttcaacatgtgagcgtttttaggtaaaagttggaatcattaagcacgaacatcaactgtgttattgaaacatttttcctgtttttgctctattatctgcacatatttaggaaatagagagtttccaggacttatgtcatatgactatattaaaaagaatatcacaattagaatatctgcctcaacttcataactgtgtcctctagaaccacagcaactagttaagcatgccaagttactgttcaagttcctctaaaaaaagttactgttcaagttgtgtaccccacatggtagtactggacaattctggtattagtgatggcaaaccttagtagccagtaaggtctggactgcaagtgctctatcaaactcccatcaggcctacaagttcatcagtttcattaaaaacttgaaatcggtaataaatgattgtcagagatgtcaaagtgtacaactgtttcaaaataataaataccatttgtggtctatgcaattgatcttgcttgtgacgtaaggtcaaggagtcggtttcccacaaaaataattacttgacaacttgaagcaacagcatgatcttctgtatcagcatagcctctttgtagaatatcacaagaaagaaacattactgttggtaagacagtagtctaagattgccacaaggccagtactacaataagattatcaataagattatcaatggtcaacatatttaaatgtaagaattagcaaccacctggaacctgaagaggaaatatgtgctgctatgagattcatgatccatgccaaaacagatgaaagaaaagacgggcaatttatataaaaaaaaaatcgatagttgaagccttgaaagttgatttagaagccttgaaagtggatttagaggtcaaagaagagaaaatccatgcatgtaagatgttacagtgagtactaaggaattggaactaaccatcaagaataaatggaaagacttgaaaggacaatacagaattatacaacagatgcggatgatgttacatcggaagaattctgtacagatgtgcatgcacaagaagagtgttctctaaatgcaaaaggattacagtgctgcagtcattttacctatttgacgcctgcccaggatctgaaagctctgacatcttctattcttttactctgttgttctgttttttcatgcagcaaattcaaatttctatacagattcttgtgtagctttagaaaaacttgcttgtatttccacttgtcacagtacattttacggtttgccatgtaacttaaaacctccatgactcttgcaaaatagccagcgtttaggaaattcaaaatcaagcagtcaagcaagtctctatccacagttagctctccatattcgagtctgcgctttatttctccccacagcatggcaatctccctatgcatgcctagtgaagaatatccacacagtatgtggcaaaaggtatgcagactgggtcttacattctgctctctcatccgcttatatgtgctcaaagcatcgtccatcatatttgccttgcagaagaaaagaattgaattattgaactcaaaagttaagtgctctcgagagctataatgttctatttcttgaaccaaactggaaagcaaagacgaatttctgaggggcatctcatccttgactattttggcaacatcctttatggtaaaggatggattggtatgaaaatcagccattgtatatgctttcttttgtatctgttggagaaacctattaacttcttccggtttattctccttctcatatgctctcaaaagagacatgtaagtacagattagaacaggaatctcagctgactctaaatcatccaggatatcatgagcagcatgcaaccatcccatcagaatgcatgcactaattacatctgaatgagatggcccctttagatcttccttgtgtaatgtaataagaaagctagacaatgcacgcactttacttgctttcaaacagccaacaatgaatttagcaagagccttctcactaggacgaatatttccatcaataacagcaagaaggccaaattgactttctgtatctaaaacgaaacctttgtccacttttatggggtcaaacattattctgaatccagttttcaggttgccagagcctatctgtattacaccttgtttatggacactatcaccaacaaaagcacgaggcttttgttgtcgatacagatcaaccaaaagctgagcagcggcatccatgtcattatatttgaaatgcaggttcagcagacttccataaaaatatagatagtgctgaatgaacggcaaagatgcaaaagaatcgatacttcttttcatgttcaccaattcaacttgctgcccaaccatctcaaagacaaggctagcgatagccactgtatttacatcggccacaaccccaaccagcgacataagctccattattctttgggccttgatcatgcatttgaaatcgacacatgacttcaaaaccatattaaacaaggtaacattactctttattggatccagttttttcagctgccttctatctccaatctgctccaagaaacactcgcaggtctcacacaaaacatcagcagcaagataggatcctacttgtgacttcaccatatgcaagtacaccatggtcagcatatcaacatcaggaagcttgccgctctccaatatgatcctcaccactgtggaggctggaatcggcatctgatctctggcaagcgccagagctagcttcatcagcgagccacaattaagaaggttgccattgcattggtaaactgacaagaccatgtcgaatgccctctgaagccatctcctgctagacgcataggacagcgacacgatcatcctgtccaacacccgcggctcaggaaggccatgcagggtcttgtaattggcaaatgcttgcagcacgtcgtcgacattgccgtcatcgagagcagcattgattgtcctcagtagggtctcacgagatggcgcttcccacggcagaatcttggctgcaatcgtgcccatgggaaggtgatgtatggccagagcggattgcctcctccatgacccgtagcaatcagcctaataacaagaaactatatgaactaaaggagaactattttcatttttttttacagattttagtaaaggaaaatatatccatttatcttatactccctctgtttcatattataagttgatttgtttttttcttagtcaaacttctataggtttgactaagtttataaaaaaattagcaacatctacaaaaccaaattagtttcattaaatataacacggaatatatttttataatatatttgttttatattggaaatgttgttatatttttctacaaacttgatcaaacttaaaaggaaaagttgaactaaaagaaacggagagagtagattttaggaaagcagcaagaaggctgcgccatacctgcttggagttggaggggaggatgaagaagtcaacggtgagcttggaatcggaggtggtggtggccggcgtgggcgagatggccattgtcgcaggggcttatgcccatcttcgaccccccccc

SEQ ID NO: 61767 - DNA, 1555 bp, Oryza sativa
gaatacatgacggccataacataaaaacgtagctaagactgatttagtcataatagtattagtgttgaaagagggcaatcccaaacgaaaaaaagttatttctcaatcccaagaatcaagctttcatcattttccgctatcgtcaagacaaaccttaaaacattccacctcaactatttcatccatagaagcgtatctgacaactatgtcatcatcgtttttttcttccaaaagctagaaagggcctacctagtgcttgcatttcggggtaaagtagctttccccagctcaataagagctacctacaaacatggaatgccaatgcaatgatcagaacttccttgccaagaacatcctgatttattatcaggctttaacctttgtaagtgtaagatgagacggtgagagtcttaggccctgtttgggggagcttaagattctgagaatctgttggttggtagccagcttctgagaatctgggttttccagcttctgggttctagttcattttctggattctacaactatatattctcataatctgggtgacaatttggactgttttggggagctggagattctgagagaagctgcagcaactagaagctccccaaacagacccatagattaaggagtctatcttaattgatgtatttaacatatagagcggttacatgggttgacaatttcagattatctagcaaacggcctaccagataatctatatccgccgaattttaaagataccacatccacacagaatccatatcacactatccgcatccacatccatatctatcggatttctataaactcgtaccatattctcgttttgagcggatttggaatggatcagataagatgttatccgattcgttttcacaccaactctaacccgataatgcccgagcattatagttgtgtttggtagaatttccacttcctatctattaagcgcagatgtaagcattgcgttcctttcgatcgtcgtctgtcctactagtaccgtaagtacgtgagcctctgttaattacgacggcgactaagatcgaatgtgagattttatacgaatcaacagactaggacgtctatggtgagtagggttagctaggcaggtcgtgcagcgttcgcagcaacacaaaaaatatgtatggcgtttgtgcacgtcgaaatggagtgtgatagctagttcgtcgtacgtggaagctcttgtcaaacatcgtagctgcttcatcggcaggcgtgatgttgagaggtagcgacgttgttgcttaaaggcccatttaagtttaagttttgcaggcccaaacttaacttttaaaactcaaaaatcatctctttggcaattagatccatcaaaacttccaaacaaaaaatttacttgtagcaaatcaaaccaaaacgaaactcccgaaacacatgaattttggcaaagtttgaaatttgagttttggttggggtgcgccaggctttggcggtagtgcaacgcctaagtgacgctcaagggctctaatggcagccactattgtgagccccttcctaaaaaccgggatcc

SEQ ID NO: 61768 - DNA, 2439 bp, Oryza sativa
  unsure (1)..(2439): unsure at all n locations
gcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaantcctccaatannttcggcaggggtattgtcnnccgnnnctcaagtctnngtccacaagtnngcagtccctagcnnccgtntccccgncnncgncnnaagtctcacaggcattcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagtgggggaattaagaaccgcccaattccaccccagttcaaattcccacccgtcccacgctactcgggcgaaactgacccgaaggagttcctatccatctatgagtccgcgatcgaggcggctcatggcgacgaaaataccaaggcaaaggtaattcacctcgctctggacggcatcgcccgttcttggtatttcaatctgccagccaatagcatttactcatgggagcaattgcgcgatgtttttgttcttaactttcgaggcacttatgaggagccgaagacgcagcagcatctgctcggcattcgccaaaggccgggagaatcgataagagaatacatgcgtcgcttctcgcaagcccggtgtcaagttcaagacataactgaggcgttagtcataaatgctgcttcggccggtttgctcgaaggcgaactcacaaggaaaatcgccaataaggaaccacaaacacttgagcatttgcttcgcatcattgacggttttgcaaggggtgaagaggattccaagcgacggcaagccatacaagctgagtacgataaagcttctattgccgccgcccaagctcaagcacaagttcaagttgccgaaccacctcccctcgcggttcgtcagcctcaaacggcgatccaagggcagccgccaagacaaggtcaagctcccataacctggaaaaagttcaggaccgaccgcgcgggcaaggctgtgatggccgtcgaagaagtgcaagccctccgcaaggagttcgacgcccagcaagcaagcaaccatcagccggtccgtaagaaggtccgaaaagacctttactgcgctttccatggacgctcttcgcataccacagagcaatgccgaaacatcaggcaacgtggcaacacgcaagatactagaccacagcaaggagcaaccgtcgaagcacctcgtgaagcagcccaagaacaacccccggtcgaacaacgtcaagatgcacagcgaagagtaatccaagtgat

SEQ ID NO: 61769 - DNA, 898 bp, Oryza sativa
atattttgatcactattcgtcgatcagtcagtgcgtgcaagctgctgcccagcatcgatgtgatgtacttagagcaagtttaatagcatagcccactactagcttcaattcatctataggcaatctaatagcttattcatataatagttacatatatactacactattaatatctggtcccacatggcatacacacactaagtcttggagtccatgctacagctggctacaaatctgtagcccgctgttcttctttctcctcatttatctttttaaaatatatttacagctggtttatagtatgctattggacatgctcttaatggtggcaaatggcggccaaaacgacgtttgtctgtgtgtgcaggtcgttgtcgattggtcatcgttgccaccactggaatccgggcatccagctgcgacctgcgactgcatctgcatgcaccatccagatgagaacaccttgctgggaatctgagttcacgacatcaacatggttatgaagttccaaatgtagcaaatgcagagttagatagtacagtatttgagagtattaattattttaaatttaaaatttagaataatttgatttttattcaactttcatatagaattcttttgaaagaaaaacgtactgtgtttagtagttcgggaaacgtgcacgtaaaaaacgagatattttttcatctctatcttctactctcaaaaccttacagttggtgcccagcaagtttaggagattgttggcttattagccgagccatagccatggtctatttttttagcattggttctagaaccattaatgatacaaatataaatgttttacctgtatttttttttagtttgcttgttcagttttttaggcataccaactatagctcaacaatcagagttg

SEQ ID NO: 61770 - DNA, 14383 bp, Oryza sativa
cgcggtacggtacggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaggctagcacaccacccgtgttgctagccactagaccccaagagtctcctcaatgtgctagttctgaataatgaattagagtttttttacggtcctttgttcctcctggtacgtacctagtatctcgtatgtccattaagctggatgcaaagacccaggtacttgccggtacagcttctaacaggaagtcacaggtggagggtataaccacacaaaggctaaaaaggtaacttcatgtaaagaatagatcaaggatttgactacatggaaagagattgcggcgttgatagacaagcgtgctgttcatcgtaagccctctccagtctccagtattgtttcacatcttttccaacagtgcccttgttgattgaacggttggatctcatttcatacttggtggtaccagtatggcagtagctagaggtaccaccttctggagcataacaaacctcaatgaattaagatactagtctgttggtagtaacaagtttggagaagatgtagtcttcgaatagcatcagttctctttcaagtttcaacaacctgttcaacttcaagattaagcgtgtcctaaagctacagccgcacacacattggacattgtacatttgtactctgtcgtgtttttgcaaaacaaatggtggggaaattgaactgaaatcgaaccctcgcaacctggagtgactgtgtgaatttccatgcgcatgtgctacatcttaaatccttgtaatgcgccattccattatgtaagaagaagaagcatatgatctagttcctaaagaaattaacatgatctcgctcttctgtcatgcaaaatgtgcaaataaatcaaaaatcaagctgcaacaagaaggtagaagagagtgaaatagcctgtgcacctgtagctgtagcttagtacttcacggacagtcggttcgccaggattgaagaaaccgtgttcttgaagaagagaaccaggcagatctgatgacgggagaaagagtgggcggacaaagaagtagggcgcacgtggtggttggggggagccgactagtcaaccatcaggtcaacccaaagcatttccctttctaaaaaaatatattgaaaaatcaacatctgcagctttctgagggctgaggcttggccgtacatttttttttccaggaagccgcaatcggcggcgggagggagcagggccgctccggccgccggcggccgctcggggccgtcgcgctggtgcgaccttcctgcctggcttgtcgatgcgccctcgaacggcacgtgtcccgggggcaagcaatctccgacgcgcggggacgagggagagaaaatgggcatttagccacttttaaaacacggttttgctataatactattctgaaaatgcgtttcgctaaaatgccaatatgaaatacgcactcaccaccactttgtcattttggccattttgtgcattttcgaaatcattttctctcctccaccggatgatgagatgaaattgcccttcctcgtgagcgcggcgagcaggggacaaaacaccatggcctcgccggcgtattgagtggcggcagtggcggcagctatggtcttctcccaactccgtcgccccatctcactctccaccctactgctgaccacatcgagagaacaagcatgggctgcctctttggtctcaatcccatcgccggacgagatgaagacgatgatcatattcaccaccaagccacggtcgtccttgtcccttttgcgttccatacttaactcatcttgccgaacaaactttcttttgacgccatcgcgtttgatccattgtagcaacgggaacaccgccgtgccatcgtcatgctggagcacgctctgaagtgccgccgcttcggcagcgtcgatgtccggttcctcatccatcctggagcaagccaccgcgccatcagctcctccttgaggtcctctttaaaacccctcaagaaccgagaagattggagcatcaaggagggagatcgacattgtcttctccaactttggctgccggcgtcaatcttcgattccctccgctccggtgaccccctcgttgattctttgcgcatgcaccatccctgggacctaaccaacctcatggatgcacatgcatggcttcacatcgaatggaatgagttgacgtcgtctcgccgaagctcggagccgccactgagacgttttcttgatcgctgccatcaaccaagccccatggcctttgctcggcctcgccctgtccaacaccgtcgtcgccaacttgttccaccgcatccccgacaggtcgacgcccttgtcagcaacgacgatgaccacctcgctgcgctcgaccatctccaccggcggcacaaaacgaagaaggagagaaagaaagagaagagatggaccttccattggccccaagggcatttatgtctaatcaccataaagaagaggcaaaatgattttggaattaagagaaaatgagaaaatggcaatccggcgagttgtgtggccttgatattggcattttatcggatcacgttttaaagatggcattctagcgaaaccgtgttttgaagatggctaaatgtccattttctcgatgagggatccctcgcccacttcggtaatgatgggcaacagaccgcctgatccgatccccggccggccgccggcggctgcttcagagagatcccccgaggcatgcgcgtgctggcaggatcacagccgcaactggcgctcgcccgcgccgcagccacaatcacccgacgaccgccattgctgcctttgaggtaaaggcaaaaccttgtttaccctcgccgctctcctctcccaatttcggtttttgcgcagatgaaagctttatgcacagtatagtgtcaaacttaaaattttgactaaacgacttatcatactctttttatattagaagaagacaaggatggtagcagtgaatctgtcaccactcaccaagtatagttgttttttttatttaccacctactttatcatattttctaccaactatccatgtactttaatgttataaaataattcctctaaatatatgattctatcatatttcacctgtacaatatagcacacatgggtacaaaattatcccaaaaatatcactattaatttgttttaatctattgcaaagcaggagtatttggctagtaatatgaaatagagggagtaacttactccgttgcattgtaggttctttttatcatcacttcatttagttcgactccgttgttgtatgttttttatgaacggcgtatatgtcatgctcacctagttaaatgtcatggagtgcttgctacatgtaactcaacatgcctgtaattttatatggcagcacaaagcaaataagattgagagagtgcattttagttagtcttaggaatataatggttaattttactgttatagcttatttagtgctactgtcgatcatttctacaagggtttatgttgagtgtacaaggcttatttggttccaccttttgagccttagactgatcgaactgttaaaacgggaagttaccacgtcaacgagatggctctcagtgttcgttgaggtgtagttacacaatttatcatgtttccctacctttcgaacttacattaatttttagtttatccaaattatttttttcctcgagtatcataaatcgacaatcatacatgagagtattcaataattattggtggactaaatttgttttttgatgtcatggtcggcatcacgtatgagcgcagacagcgtgcggcgaagaaggactagcagcgtgtcggatcagaaacagtaccgcgcgaattgctagagattggtttaagttgttttgctgttttgttatccctttgttttagcaagattagttcaatgtaaggctatttagagccacaaatttatggttaatctaagcaagattcaatcacacttctcatcccattttctctgctcccttcctctgttcttcccacttgccgtcacgggcagggtaaagtggttgccgaagcctcgccctccagtgacccattcatatccaatccgttcccttgccggtgctcgtaacaacttggtatcagagaccatggcaccagatcaatcctcctcctccacgcagccatcaccagatcaatcctcctccacgcagccatccactgatgccgacgcactggcaaagcttcaggaatccatggcgacggtgttgagcggcatttcgcttttggcctccaaaagtgacctcgccgatctcagtcgttctgtcgctgtcgcgacctcccgcatcaccgccttggagtagtcctcctccacttcctctggtccacgtctgaccggcggtggcctccttaaatcaccaccaccaccacccccccaccacctcccccaccacccccaccaccacctccgccgccacatgctagacacggcgcacagcacgacgccaactccggcaacgcagttcctcgcttttacaagctcgaatttccaaagttcgatggctctgacgatcatctcaattggcttaatcactgtgaacagttctttcatgcacagcgttcgccggatggggatcgcgtttggttggccacataccatctcactggtgccgctcaggagtggtatttccactacgagcaacacaaagggccgcctgattgggacacgttcaaggagctatgctacacccaatatggtccaccaatccgcaacaacccgctgggtgaactcaagcgcctctcacagtcgaccacggtggccacctaccagcagcgcttcctcgccttgtccagccgtgtgacggatctcctcaccgaacggcagcaagtccaactgttcacggcgggcctccgtgatgacatctgcatcgacgtggagctccatcagcctgaagatcttcgggaagccatggggttggcacgtgcatatgaacacaaagccaacttcagcccatcgcgcactatcagcaagcagttcgcgcgcacggctgcgtcatctccggccgctagcgcctccccggctccgacggcagtggccgccgtgcccgatgtgaactctcgccagtttcgtcatctgacaccggcggaactcgcagagcaccgcaaacaagggctctgttacaactgtgacaagaaatttgtccgcggccaccggtgcgcacggctctcctacatcgagtacgacgacacggcggatgatcccgatgacgactcggccgacaaagatgaggacaccgagccacacatatcgctgaacgcgatctcgggtgttgatggcgccaacacaatgcgcttggcaacctacctcgcggatgaagaggtggtggccctcgtcgactccggctccacccacaacttcatccacgctgaccttgcgttccacctcggcattccgctgtcgccggtccgcgatggtgtccgtgtggtggtggcaaacggagatcgcctcaccagccccggcattgcgcatggcctgcacctgcgtgttgccgacgaggtattcgacgtcgactgctacgcgctccaccttggatgcgtcgacatcatcctgggcacacagtggctacgcactctcagaccgatactgtgggacttcgtcaacatgcggatggcaatttgtcgcggctgccgggaggtcacgctatacggcgtcctcgacgaacgccccgcgtccacatgcgctgcgatccacactgacgatctccttccgtccctattggcggaattcgacgacctcttcgcgcttccaaccggtttgccgccggcccggaccgtcgaccaccgcattcacctcaagactggtgtgtcccctgtcgcggttcggccgtaccgctatccccagctacagaaggacgagctggagaagcaatgtgctgagatgctggcccagggcatcatccgtcccagcacatccccgttctcgtcgcagtcctactcgtccgcaagcacgacggttcttggcgcttctgcgtggactactgcgcgctcaacacggtcaccgccaaggacaaatttcccattccagtcgtcgacgagttacttgacgagctccacggcgcgcccttcttctccaagttggaccttcgttcggggtaccatcaagtcctcatgcacgccgatgatgtccacaagacggtgttccgcactcaccagggccacttcaagttcttggtcatgccattcggcctgacgaacgaacctgcgacgttccaggccctgatgaacactgtcctcacgccgttcttacgaaggttcgtccttgtgtttttcgacgacattctaatttacagcaggacatgggccgaacaccttcagcacatccggacagtgctcaccgtcgtctgcgccaacaaccttgtcctcaagtgctcgaagtgccacttcggtgaacaccagatcagctacttgggtcacgtcgtctctaccgacggagtggccatggatgcgcagaaggtttgcgcggtggccgactggccgcatccgcgttcgcgccgtacgcgggtttctcggcctcgtcgggtactaccgcaagttcatccgtaactacggcacgatcgcggctcttctgacggccctcctcaagcgcgacgcattccagtggacgccggatgcagcccgcgccttcaccgagctcaagcaggccctatcgacgcgcccgtactgcaactgccggacttcgccctgtcgttcgtcatcaaatgcgacgcgtcggggtccggcatcggcgccgttctgcaccagggggcgggtccgctcgctttcttcagccgggcactcgcgccacgccacgccggactcgccgcctacgagcgggaactgatcggcctcgtccaagcgatccgccattggtgcgcgtacctgtgggggagggcgttcctcgtccgcaccgaccactacagcttgaaatttctcctggatcagcgcctctcgacaattccacaacatcgatgggtaagcaagttgattggctttgatttcactgtggaatatcgcccagggcgcacgaacgttgtggccgacgccctgtcgcgtcgcatagaagacgccgaactcgccgccctggcgctctccggcccaacattctcgacattcgacgaccttcggaatgaggtggctaccgacggcgacctcatcaagatcaccgctgacatcaccagcggcaagctgagcgcgccttgggcactccgcgatggcctcatcctccgggatgaccgtgtctacatctcggcatcttccccgacaccgccggcattgctcgctcatgcccacaccgaccacgaaggagtcgaatgcacactccaccgattccgggcggacttcttcacgccccacgccaagcaagctgtccaggagttcgtacgcacgtgcgccacttgccagcggaacaagaccaaacacctgcacccggcgggcctactccagtcgcttccggtgccgacgcaggtctgggaagacatcgccatggattttatcgaaggtcttcctcgcgtgcacggcaagactgtgatcttcaccgtcgtcgaccgcctctccaagtacgcccatttcattccgctcgggcacccctacacagcgacgactgtggtgcgtgccttcttcgatgaggtggtccgcctccacggcatcccaagctcaatcgtcagcgatcgcgaccaggtcttcaccagctcattctggatggagctcttccgcctagcgaatgtcaagctcaacttgagctcagccttccaccccagagcgacggccagtcggaggcggccaaccgcgtcatcggcatgtatctacggtgcttgaccggtgatcgtccccggcattggctacgttggctgccctgggcggaatattgcttcaacatagcattccagagttccctgcattcgacgctgttccaggttgtctatggcaggccgcctctagcgctgcgggaatataatcgaggcttggcacgcgtccgcatagtcgaccaagccctcatcgagcgtgatgaatttttgggggaaatcagggagcgtctactccaagcacaagactactccaagctgtactacgacgacaagcatcgggacctcgcgttccaggttggcgactgggcgtgcgtgcgccttcttcaccgtcaggctgcgtccctgcccgggttccgtcgtggcaagctggcgccaaaatattacgggccgtactaggtcagcgaccgcataggtgatgtggcttatcgtctcaagctaccggccggcgcacggatccacgacgtcttccacattggcctgctcaaggaattcaaggctacaccgccggaccaaccgcctgctctgcctgcattgtccaatggcggtgttttgccaatgctggcgaaagctgttcgtgctcatttggcacgcggtgtgcgtcaggttctcatccagtgggaaggcaagccggctgcagacgcgacatgggaagacgaggcagaattcaggcacatgtatcctgcgttctagcttgaggacgagctgtttgcgaaggaggggagagatgtcatggtcggcatcacgtatgagcgcagacgtcgcgcggcgaagaaggacgagcagcgtgtcggatgagaaacagtaccgcgcgaattgctagcgattggtttcagtttgttttgctattttgttatccctttgttttagcaagattagttcaatgtaaggctatttagagccacgaatttatggttaatctaagcaagattcaatctacacttctcatcccattttctctgctcccttcctctgttcttcccactcgccgtcacgggcagggtaaagaggctgccgaagcctcgccctccagtgacccattcatatccaatccgttcccttgccagtgctcgtaacatttcatgtttgtgttcttggcagttcatgactttcaccaatttaattcatatatagtaccagttggttatttaacttgctttcgttgtattacgcaaccttttttcaactggtgaataagaccgcgaatcatagtaaagtgtttagcaagctagttagcgtgtggattggatgtgtcatgcgtgcatctaaatttacttaacacgagcgtgagattgaaaatcatgcaaataaaaccatttgcaattgcacatctacatctcggttgaaactacaaataatagatcggagggatcaattaaataaatagccaggaagagtatgccatagattctgaagtacaacttgcagtattattgcgcagaatctcaactagaatttgttactgcgcatgcagtacaaatttggtgttagattaatgggctaggcccaattaaatcttaataaattccaatggcccacatttaatgcaataggtaataataccaccttgaaaatctgaagtagtagagaggctctgttgaccggttgagatggagctagtagagagtctctgttcaccagttgagatggtgggcggacagccacacgcatgcgcgcgcgctccgagccggctaggccgaggtaggctgcttctctctctcataaattttgcaatggaggagaattgaatccaaggcaattgatacgatatcaatatgggcgcgattactcctgtaactcgtaaattctgcaacggatgagaattgagtccatcgcaattgatactatttcaatcaattgatacgatttcaatacatgtgtgattactcctataactcgtaaattttgcaatggactctcgtaaattttgcaacggacgagaattgaatccagcgcaattgatacgatttcaatacgggtgtgattactcctgtaactcgtaaattttgcaatggacgagaattgaatccagcacaattgatatgatttcaatacgggcgtgattactcctataacaaacaaatcaatctcgacttaaatcggattgattccgttgttactgcagtaacgattctccctcccgtacgctataaaaggcgaccaccaaggcagacagaagacacagcttgctggcctctgctctcctcctctcgcactcagatcttcctcagatcttccttggaaactccttgtgcctctattcctgtgctagctattgattccccggttctgtccacctgcgtgcacaagtgacaggatgagcgggcctccggaactccgtccgcttgtgtacctgcacgggtaggcggactatcaagtttttggggagcgtgcctgctctgcttctattcttctgcatcgcgatggcttccattggcaatggcgcaccaggagctggagcctggagggaacaatgccactcctggaggagggaacggcgggcgctgcaggagacaacaacaatgaaggcaatacaaatgccttaatctccactgcaccgttttttgggtatatggttctatctctaattgatgttcttcttgttatttacatattgatcatgctatccttaggattacaatcctatgtgaatgttgatgatgcttatgttataaaaagcatgcccatatttctgttaagcaccaccactagatcacttactatttgtgaatgtcatgtttattatcttcttattttggattaaaatatgcctaattatgaccaaataaccaacaattggttggaacttgttgtaaatttaaatcgtttttctaaaagatgctgcaagatctggcattctaactagatctcagcatctcggaggttcctggaatttatgcggatggagagcctggacaaaagcagcatggcttaatcgtatacacagtagacagccaaagaacattccatccaaaagatttacattgcaatgttcatcggtaactagcatttctgtaatcgagacacacttggtgatgcgtggatttgttgttggctacaaaaattggtcacaccattgagagatcccaagctgccacacgagttcccaaccaagagacacacgatgaagtgttcaagggtaggaatttcatggtagtagaagaatccgttgataatgagttggatgatgatgttggggtgacgatggtcatcacacaattgatgatgtcgatgatggtcatgtcacggtagatgatgccgatggaagagatattgcgtcatgctgaacctgaagttgtggctgggtctgctcgtggtttggataatttcaatgtattacaaaaggcagcaaagaaacttttgcatgatgaggcaaagggttgtggcaatgatttcacattattgcatacaatgcttgaacctaagattgaaagccagaaacggttggtccgacaatagttttaacaatttattggtcctgttgaaagaattgtttccggagcccaactccctgccaaccaacacctatgaagcgaagaggctgcatctttattggcctttaatctctggcgggcccttggaccaccagtgaaaacctgttttggccgccataaaaaaacctttttttagtagtgatacaatccttagctattgtccaacagagcatattagtgaaaccgataagcataatataacgcccaggacccaaaaaggtactggttcagcttatccagttaaaccacacctacactattaactctctcacgttttcatcctcgcttcacaaaaaggttcgaaccggagttaatagtcctcaggctcccatatttataagctagtgctgctctagctgaactagcgaggtgggtctaaattttctacagtaccgcgatgttacagtgcagcacagtactgggctgctgctttgctatttttctttttcctctaattatttgcggggcttcacacataacataataaattctcacaaaagcgatatgaggcttggttttgcggcggaaaactctatacgtacgaacaaatttgttatgaaataggtacgaagagcgaccatgggctgcttccttagcctgtatgttgtaatcttctcattagtatttaagcccataactaataaaggccacaacttcaggttcagcatgatgcaatatctctttcatcatgacgcaatatctcttcaggttcagcatgcctcattcttcatatcctcctcctcctgatcctcctgcacaattttcgcctaggagcaaacatgtatgttagagacacgcacaacaacactaaacaagatggaaagtagaatgaactcgatgtggattgggctccggagcacccattacggagacacggactcaccgggagactcatcccagctgactgttgcgcccgaagcatagtacctgatcaccttgccctcatgctccagcacaaagccgccatttccaacggggcacacatgctggaagaacacacggtagtcttctttgatgttggggccgtgacagtgcaatgcaggctccctagacgagctctccaccttcatccggcagcacttgcgcatccagccccgccatgggaggagatggaggcgctgtcgtttgtcgggggcttctcatactgtaggttgtaggaagggttggcgctgtcggcagggatgcggacactgtaggaatggccttcctcgcggacgttgggcagccggcagctgcggcggtggctggtagagcaggcacaacggattgacatttggcatcactaagggcatgagcaatgtatatggcccaagttgtccttaaggtgggccctgttgatgcgaaaaacacacactggtctaggagatctgcttagcttcagtgcaggtccaaatcttgatgagatacgggcgtgccagtcagtttgaccctgcaactgacaagatatacaaattgaagatcaatgagccgatcggctgacaagctgatggagtaattttagccgatgtcgataccagccgatgtcgatagggttttgatcagtcagctatatgtccaatacagataatgatataaaggcgatcggctgatgataatcaatataacaataatataatccagtataaaccaattggctagcaatataatataataaaagaaatactaatccgaaggttaaagcatacatcggctggaggtccgatgtcataaaatccacaagattagattaaacagtaaaacctttgttgccatcggctaaatccaatatgtatgcaatcccactacatgtttcatagcatacccgaaaactacttttataactacccaattacggagtagcgtttagcagtccctaagtaagctactacacatgttgggaaccatgataatatcaggtctaaggattcaacaccaatactaaatgagatcactgatgacacaacacatatggctcttacaatgtctcatgttgggtctatccaacaacatgttcaccaacatgtgtccacattattaatttggtatctctataccatgatccatgagacatgatcattaattaatacatgtgctgatcatataaacatatttgttccacatatgatatttgatcagggatcctttagaaatagtaacaaacaacataaagagtctcatgaaagaatcacatattcattaaccaataatgagttatctatttcaaggaacaatgtcggataaatatgtaaacatagtatgtgatacaatcatctctatgatttggcatatcactaacactgacatcatcagagaagtacaatcttgaagcaatccctggactctaagagtctaacggtcgctgccatggcggtttgaactttctttgcttgtacacttggaaaaccaacagatcctaaccgtaaagcatccaatatgtcaagatctagcacccttttgcacggctgttgcggtgttaatgtctatacatgaggagtatatagtgttccattgtgtcccttgcagaagaaaaggttaaatagcgcgcaccagtttattgcgtgcagattagaatttcttgaattgctcctatctcggcatttttttgtgcaattcgagtgtaagatactcacaataaaggagctaccgtaatagccacatgcgttaagtatagaccaatatgccttttgaatgtcagttttaaaatcataacaaaagtgatgatgaataggatcaatgacattatggcttacatcatctccaaatatcaaactgccttcttgaagagtcgtttcatcatgaagggtgttgttattttacatgagattcttaactcagtgcatcaaaacaaacaaattggattttattcaaagtagactttgaaaagcatatgacaaggtgaattggaccttcatttat

SEQ ID NO: 61771 - DNA, 19964 bp, Oryza sativa
cgcacccccccgtgtgtgcatggggcgcggccggatgggccgggcttcagactccgctacgctccggcccaagcctccggcttgggcctccgctccgcttcgtcagaagcccggccaatatcttgaagtgaatttggaacaactccaacactagcccgcccacattcgaatcctcccttgtacaaaaatattttggggctatcttctcctcaactctctctctttctttagaattagcacatcaaaactaaaggaaggatagaaaaaatctgagatccaccggttccacctcatgagtcaacttttctttttagaaagaatccaattgcttttttctgtaagtagctaagactaatataggttgatcttgttcattaattgaaagatttttttgggggagggggcacatgaagctacgctaaatggatggccttatataaagtggtggacccaataattttgactattagatgaaaacaaaatcccctgtcacccttcatcctggacccacatcatttcttttccttcatcttgatgtccagtgctgtttcggaaccattctcacatattttcaaaagcaataaaatttggtttaagagaacgtgaaaaatatttgccatgcatatacgtataatgattaggagaagaatgaaaaaaaggtactatgatcttaaaacagaggccaactgtgagaggaatgtttatgcatacaaggccatcattctttcatatatataaggatttttttagatctgtactgccataaataatttctaacatatagtatatttttgagacaacatgctaagattagctgtcttgacacatttgtatcttcaaaatagcattgaattgttgttgctccagtagggctttcaactactattttcgataaaattcagagtaaactggaaatcgtacacatgatctcctcggaaaagtattccatgcgttttattggctctccacactataaattacagaaaaacaatgaatatgttgctttgactaatctaccatcttcatgaatctgcaggcacaatataacaacatattctgtgccactcatatgggagactggtatgagaaactttcacaatcttttagggatactgcaaatgaagtattggcaaaagcagatattgatccaaatgttaggtgcttcacaagaaggcagatgaagcacatcacaaacaactacggcactgtcctgggaaaaggaggtttttctgtggtgtacaagggaaaacttgataatggccgttcagtggcagtgaaacaatataattggagaacacaggaaaaggagttcacaaaagaagcgatcatacagtcccagtgtagccataggaacattgttaggttattgggttgttgtgtggaggcagatgctccaatgctggtcactgagtttgtccccaatgggaacctttctgaacttctgcatgggaagagtggccagcttcctgtctcattagagacacgcttccagattgcattggatgtagcagaagcacttgtatatatgcattgctcccaaaatcatccaatccttcatggagacatcaaaccatcaaacatacttctaggtgacaagcatgtggcgaagctatgtgactttggaatatctaggcttctctgtatggacaatgatgaacacacgggctttgttataggaagtaaaggatacatggatccagtgtactgtgagactggacgactaagcccaaaatgtgatgtctacagttttggggttgttcttttggagctcatcaccagaaagaaagggattgatgaccagagcagaaatctagcgggaatgtttgctcgctcaagtagagataaaagacatgaactatttgacaaggaaattgcagccgatgagaatatagactttatagaggaaattgcaaatcttgcacttgattgtttaaagtctgaaatagaagatcggccgcaaatgaaagaagttttgaaacagctttggagtatcaaaaggtcagagatattgagacaggagagaaggcttgcagagttgagagagagaaggatcatgacattaagggaaataaaggtcatgttgcgtggatctggctttgaaagatttgttacaaaagcgacatagattccatcataggtgacccagaacaggaatcaacctcagagacattttcaggaaaaagtgatgttgccatgggcaaggtttacatgggacgtttgaaaaacactccattgattgtgataaagatgtctgtggaagttgatgaggattggaaacagacatttttttatgagatgatcatgcaatctagaattaagcattggaatgttgccaagcttttcggctgctgcctagatcatgtcgatgccccagtattagtctatgagtatggtgagatgggcttgcatgacgctctttttggtaaggcgtggcagagtattgaacatcctttcacttcctatgtacgtctacaaattgctactgatgctgcagaaggccttgctcaccttcactcatttgacatggttcatggcgatgtcagaactgccaatgtaatagtggatgttttttctggatctaagctcgaaatgcctagaactagtacatttccggcaaagattgctggttttggaacaacaaagctcctttccttggacaaggctcagtatgcaagatttctaacagagaacatacattacaaggatccacacttcctaataactgggctcatgactaaggaacacgatgtgtatggttttggaggggttcttgtggagctcttcacaggaaacaagattcaaatgcacgacataaatacggtaattaaatattttgatagcgtatttgctatatgccatcatctcgaggaaattaaggaactagcttcgtggtgtgttgcacccgaggttacagaaaggccaaccatggccaaggtagtacgatgcctccacgatatcttgaaagatcagcgacggccttgcccttgcccctgcaagtcaatgcattaggccctttgtttcggcttaggctttagaacagccaaattaataatgagataaaacaaacaaaaaggaccttagtttgcaatgtaatttcaggctgacaagtggctcataactccagaattgtgatatcggaagtcactccaagttgccagtaactgtgacttaaatgttacagtatattatatgtttgccagtcaacttagacagtgataatattgttgctgcggttttctactacgattcgcgcaagtcttggaggcacagttcgaatgcactatgatactaatataaaagctgttcgaagtgctttggacgataatccagtttttgtccaagattatgttttggtgtagtactgatatccagttttacccccgtgtcaaaaataataatataaaaaaacagttttacccaacacaaacaaccctcgcgaccttggagagaccttggttcttgttttctggaatgttatccggtttggcaattgcaacgtttcgagatattgcgccagatggtaactgtgatattgagttctgatgtagagaccgtgttttcgtgaactgcactgtcgattgtaaatgatttatcaattgtacaaacttagacgctgagtattatctcacatcgtttgtgctgttttagatgtctatcgagagcaaattagcaacgaatgcctgtgtttattacgatagctccttttgttgcgagtatcttacactcaacatgcacaaaaacgcctagataagagcaattcaagaacttctaatcattccgcacccaacaaattggtgcgctctatttaaccttttcttctgcaagggacacaatagaacactatatatactccttgtgtatagatattaacaccacaccagccgtgcaaaaggatgctaaatcctgacatattggatgctttacggttaggatttgttggttttcaaagtgtacaagcaaagaaagctcaaactgccacgaatgcgacgtctctactcaaagtccgggaattgcttccaggttgtacttctctgatgatgtcaggccattctctgggccctgctgtgttcttggttgctccagcacgttcagcttctgaaggtaggagtaggaggcattgggatttggcggtgggctcgggttgcttattttgcttgccaggaaccgtctgatgagtcctctgaggaatggagccatggtatctggctcatactccaggaaatacatgattccccccatgcacatgcagaaaagagccacctgcaatgtttgccgggtaactgtcagcggatctgaaaaatatgatcatctactaaccaaggggcacactgacttcaaacatgatcccttccagttatcaaggcaataggcaaattgtgtagaattaagaacttaggactaatgttggtttacactgctcttcgacaccagattactttgaaataagctagagtattgcaagtaatcctcatgtagtttttgtccaaagtagaaaaacaaactgaacaatgaagaaaaatacctcagcgtttttaatatttgggagcagatggcggttgattaatatataccacaaagaatcccctgcgcggggaagtacatagagagctagctcagctcttctggctttcttttccaaaagaatagaaagaccagacatcagaccagcaaaccagtacacaaacttgtggtctttggttgcaactttacgatgcaaacagatggcagcctagcaatgaaaccagaaggatattatgatcatgaaacatttactagtatttgttaaggactgtcctcgacaattacctggaagaatgtaacaaaagcagacaaaaaggtcgtagagcgaactgcacccacaagagctcgccaacaagttgcagctggtgattccaagaactgatatttttgatacagagattccatcattaggtaattaacatagaagatggatatgtatgaactacaggataatgaaaaagtaagaagattcattgtgctaatcttgttgagtgctcgggatgttgctcaatattttgtttcactggcaacatatataactaaaaagcaatgcatgcattttgcattaagcaaaattaaagtgtctgtgcactgtgcatgaagagtacaaagatagagatgtgctataatttgaaggcttgtacaattggcttatacttgaggcatcaaattttatttgaaagaaaaatatttcgatcaagcaatagcataagtgggaaacaagattagaaagttaccttttgaaggcgtagaacaacaaatgggacaaatgtcaatgagaaatacagagggaatgttttcttgaacgttgatgaagagacactgacattatgagccaagcacgatgctctgtcaggatgtatcacagaacatggaataatgggtggactttttgttaaatttatcaaatttgaattcttcttgttagctaaataggctgagagaccaatgagatccacatgaccacctctgcagcaatctcttacagccttgtaaacaggttccgcaactggtccagtcttttggatgaagtcttggtacgatttaggtaagctttcaggcctcataacgaaagaatacataacctggaaggatatttcatatgattatatagatcttatctccataacaggataataatcccaaagcaaatcggtcaacttcatcttgttacctgggcagacgcaagtgaaaaaagtaatgcatctccatgcctccaatggcttccccaaaagtgaaatctgttcttagactttgcagaattatatgcacactgtaaaaaccaagcatcaatacatgaggaaaagggccatacatgcatcttcaccatataaaatgcaacagtttagcagttggtgacctgggcaagccttgccagaagatatagagaaagggtgcgcctcctacttgaatcatctagcgctactatcgccaagcctgccaccgaacctgctaatattctgctccatcacgccttcagttgagtccatgaacattattcgaggtaatcttataataaaaaattaacatgctttggacctatctactttttagggaccatctcagattcaagaactggttagaggtacacatgcgttgcagatgtgttgtagtgaatcagacaagataaatagacacaaaacagcataagcatagagttacttacgcattaaatggtgtttcctttttccgaaatctccgaaggaaacatcgaagtgcatgatatgatccagtgaatcctccaaaaagtaatcctacccggcaagcttcctccctcactattagatctttctccgaaaccagttgctgcaaattagaaaagaaagttatatcaatgacatcttatttgaactttgtagtatactagtagtagaacagtaaatatttgtcagaaagggaagtttgggaactggaccaattattttattttttaaccttttcttagtaatattttaaaaataaaccatccagtattttgttttaaatgaacctttcggccatgtcacggctgatggcaaggcaaaacagtgaaaacacatgctacaccatatgctattatctcggtgtggcagaggttatttttcaaacattattaacaaaaggttcaaaactttttttaagaaaaaaaaatcatactggatagcctcacaacagggatcgaaccatttaatgcatagcaagaaacatccctccaacaggttatttgatgtgcttcaaacactaccagctggtcctacacaagtactactagtaccagctcattaccagttcaccactaactattcaagtaaatgaacatagagcaatagatgtaacatcacaatcaagaccagcataatatgtgaccctgtcctttgctaacacatttgcacgccctaatgtgcgtgtgtccaagctccaacagttaagcaccaaaacccccaattccactccaattagccaaccgaaacaagatgaagtaaattcgcacagccgaatcccagttcccggccaaattctccgaataattccgtccaaactaaactaatctaatatggggcgcagttgagcactaaccgaaagaaatttgcaaattcaggtaggaggagaggagcaaggaggaccttgaggtcgaggagggaggagtaggatctgcggcgggcgagcttgaaggcgcggaggaggatgccgatgccgacccggacgccgtaggagagcaggaagctctggcacaggttccccgccgcgtgcgccgcgcacgactccccctcgtgcccgcaaccccacccaccaccaccaccaccgccgccctcctcatctccatccacccccttcccgtccccatccccatcccctcctcccccgtgctggtggcggtggagctcctggatggcctcccgcagccgctcctccgcctcccgcagcctccgcgccgccgcctccgacgccggcgcggcctgctgcggggtcggcgggtgaacggcgtcagggggaggagggggagagcgcgggccgagggtgggctcggcgccggcggagaggtcgaacgacggcgtcgagaggaacggcatggccggcgccgcggcggggtgggccccgcctgggattcctccgcttcggtggctcgcgtcgtcgtcgtgcttcctcccgccgctgctggctcgtgtcgcgacttcccgcggggttggattattaagcgatgataataataagattggaggtggttacgggtgggcactggggcgggtgacgcgtcgtgcgtgcgacggacggctttgcacctgcacatttgcacggaacggaatgtactactaggcgcctactactagtgcaagagatgggatcatgggaaaggtatggataacctcggcctatttacatcccacccaagattttacaccctagtcacatcgaatgtttaacacttgcataaaatattaaatttatgctaaaaataactaattacacagattgcgactattttgtaagacggatcttttaattctaattgcgccatgatttgacaatgtggtgctacaataaacatgtgctaataacggattaattaggtttaataaattcgtctcgtagtttactgacggatactgtaactagtttttttattagtacccgaacaccccataaaacacatcctatataatacttgatgtgatatgtcaaaactttaccccctaaatctaaacacccccttataggaaccctcttctttcttctaaccatactactccctcaggtttcatcatttttaacgttttattacataataccttctttcttctaatcacggttctacacgtcattttttgtctagacttggctcagcatgatctaattacttgaactagacgatttgaccctatagacaaaaaaaatggtctagggcacagtttaggccctaaacgggacgaaaacctgcggtctcacatctagacgcggtctagacagtctagaccatggtctaggcgaacactgatttattttgacaagtttgcaactcgattcaatggttagtttaagaaatatcgagtttttatagaagcgttgtcaagttgtttttgtcggactgtcataccaataattgtacttcaatcagactagctctaagtcccatacaggtccggtcagactgtcaaaagtgtgttccattggctttcaaggctgggatgtgttttgatctattaaagttcaatttttttactttccctgacgtaattcaccccctttggtaagtttggttacttgtgttcaatcttacagtaatttagatttggggataattagacttgacgaactacttggtaaagtagttaaaatttaaaaatacttcaaacacatcatcaagttgttatgcgttcttttctacaactccaaactacaatttaggcgttttccgttagcatgcttcccgaactgctaaatggtgtgttttgcgcaaaaaaaaattctatatggaagattctgaaaaggtcaaataaatctatttttcaactttataataattaatactcgattaatcatacgctagtgagtcacctcgttttgtgtgtcgctaatatgctactccaatatgaatactacggttcatacagaacccttgccttttctttagcttagatttctatacgcatttaaaagaaagcaatggtggtgcccaccaactctattatattttctttaccaactacctttgtgtacttcaatattacaaaagtctttcacatattgttaatatctttttttcatctctatttaagtttcatgcaaagacatatacaaggatgaaattgtttcaaaagccatacaattaattgttccaaacaatgttagcacatgtataatacatttttgtccactgcaaaacacagttgttttgctagtttaacaaaattttactctatctatattttaccggttttcaaatgatcttacggaaatcaacaaaatcattcaggagtgattttcgatcgggtttcgttaatcccgcgttcctagcttcctactctagcctctagaaaagagcataatactctcttcattcaagtttgatggtcatattctggcttcgcaccaagaccaaacacgcttataatattcctactaatctagtactctaggccaacacacctgtggcaacgctttggcaccaacacaaccaaattgttgttgccacatccttgatcgtatgcttcttacccatagcgcttgtgatcacacgcgaaatttaactgttttactatgccttgcagctatttttgcctactaaagatgaaaattagtaattagccattgcccatgcaacctaaaccaaaacaaaattgaaagagcagatcaaatagccctatttaaatagcacttggttgaagaaaggacttaagttttcaattcttttcctccctacctggctgcctctaccaccgaacaacgaaagtaacagatgatctactctgtaaattatcacggtgagcagacaggagcgatggtaaagaagagtttgtcgtggatgcgttgctgcacatggtggattagaaaatgagtgatagaagacttatcggtatgatctatagtcaattgcaaatatgattactttctcgtgcatacatatgcaacgggcttttacgaagtactccctccgtcccataaaaaacttaatcatgtgtttaaatttgaatatatattatgtccagatttaaatctaggatttggtttagtactcatgaaacgtccacgtggtggttaattaatttcgtgtgcgaactaaaacgactaatccgacaagactcaacgggctatcaaatgaaaatccagattcttttatacaagtgtgaatgatcaatcgtgaatggagagaacagaggtggtgggggagccgggcaggtgggcaatggcatccgagtcaccaagtggggcccacctaccaaccaccgtccacgagtgtgccgccgccgccgcctcacatccactccactctctctctctcctctcccccgcaaatcccccccaaaaaaaaaaaaaacccgccaccgcgagcacgccgcgcgcctgcttcctccacctgcgccgggcgagaagatgatgctcccccggctcctcctcctcgtcgttgcctccgcgctgccgctcgcttccgtcgctgcgggcgccgtcggcgtcggcgaggggttctgctcggcggagccgtcggcggcgtcgggcggctgctccggcgtgcggccgccgctctactggaaggccaccaacccgactctggcgcccgcgcacctccagggtgagtgagcgtgaggcggagcgatacgtcgcgagttggatggaatcttaaagattattgcataaataggtgctctggattgcgtcactgcagtgtttttttagaactgcaatatcgtgatattggttctggatttggagttactgttgtggagtatggatgttgatgctggttgagacgctcgggatagtgtttagttcgttcagtttcacgatgataccatactctctagaaggaatttctctgtgaatggtgtggcttgctgtcgagaattaggctgtgaactaggtaggtagtagtaggtagtcatgtgggactgaaatagaatggcatatgatatgcacgctcgtcagttactccttttcgtcgaattggattggccgagaagattatcttgtattcccttgctaagcacactttaaagataatttatgttttatgcttctgttttacttattacacggtgaatgaggatatcttctgagctattttatcgtttactcatgtaggctatctgtgtttcagaagaggatgcgttccttttcctgttcctgctaattttgttacttttctgtatctccagatttacctggcttcacacgtagtgtttacaaaagggatcatgctttgattacaccagagagccatgtattcagccctttgcctgactggtattggccaccttctgttgtactttctctttgctttccacaactatgtaatatcatttatttactctttttttttcaggatcaacacattaggagcatatttaattagtccagctatcggggcacatttcacaatgtacctggcaaaaatgcatggtatgcaatttctcccacctacaaagcataggtagaaatgtaaatgatagcagaatattcaacaagttctctttgaggtccgagtttggtttctattctaggaattcagaatattttgtttgccacagaaccattggattagcaagaacatttttttttgtgtgtgtggattcatttcggccattgggccaagaatgcctagctcccaattaaaagcttgtattcttattattgtacatcggtacatgttgtgttcaatcttatcaaactaatctgttgacaagatagagagttcttattttatatgttttatttgcagatggatcaaaatcagccctaccaccaaaaggtgttgaaaggttcagtgcttctcacttagttagaatagcaaccattcacacttgtaatcatcactgtttcaaagaacagaatgattgggtcactcctagtcctagccaataaatgttgactgtgatgcacatccaattaagtagctcatttgtcagcatcctatacttgactcgacttggtttttcaccatccagttaatgggtttccactggtccatggtaaacaattttcaggcttatctttgtactccaaggaagcattctattgtctgaggagagtgggaatacccatactctgctggtaagattcgatcaaacttagtatctgctattttgtgaatatctagttattttttcactatactctatgttcgtcgtattatgtaagtgttaatccactttaaacatttctaattccatgacataacttgatgggatcatacgacatagttttcaaagtttagaggcagcctaagccaactgcggttgacaatatttttaattgcatgaagatgatttacaaaatgtgcatgggctttttaagatcatttctaatcattactaaggaatacctgaagaatagtatcaaccatgttcagaaattccattgtagttgaatgagattttgcgacatggtgtatccggatttgtctattcctgcttctgttgttatattggcataacatgtttgaacataatgcaaattaaacttatggatgatcagttgttaaatttgtagggtgatgttattaaaattttgtcaaaagacaataatataaatattatacatgataaaagggtactaaatatgggatactgatgtttgtaaattcaacagaatttccattgtttgtcataactgaatgaatggaactcccacttgtttcttgcatactcctgcagtaaatggcttaattcttttcatgatcctgatacttgattgttttaacttgatcatcttttaccagctttagagaagtaaaggttgcctagcattaatatggtttactgattgtgtaattgctgagtgcaggtggactcttatgcctatcttcctgcaaacatgaaacactctgtgatctcagatgaagtaactacccttgtaatctttgagaggaggtacaatggttaaatggcacactttcatgtaaattttgtttgttttttaccactattttttttagggaatgcgcataatccatgcgcatcatttgttttaagaatttttaccactattattgacctagctgactagctgagtgatcttattgaatagctgaagttcttcccattttggtaggcttttagtcgctaagactggattaacttttgcaatataaatggattggcttaaggccaattaagtggttgatgaacagtatttttcctttgtcttctttttgttgtgaatatgatctgcacatctcagacaattattgttttccgtcaatgatttagttttctcagtttacatttctcattatttaatgaatatatttgtttaggtacacaaccattgagggttaccatcctgatctcattgttggatcaactgataagcaaccccttcttgaaaccccaggagaggtacattctggacctgtgtggtggataccgattatttgcaatctctaggcatctagataaattggtttgcctgccatttgagtggtacgcctttaatttatactatgcattttcaagagggttggaataaactggtttcagttttcaatttatatcatttggccttgtgttgccaatattgtagagtttttgctgtgacattcatatagataattgctgttttttcccctgctacagacaatattgtagtactgttttttgctgatatatattctgcaagcacttacatgaaattcttgcctcttttttccaataggtatttgagttgaggaagctgctacccacttctctgccttatgactttaatatccatgtaagtctgattaatttgggtttattgtttaacttggtgtgtataacatcattccactgaatgtgagtgcccataaatttcggcaaaccaagcattagattcaagctatttgttctcctagttattcattgaaataagtgtaataagctattgtgttgtataagaactcaaactctgaaacactggcaacctgagcttgcaaaagtcattacttatcagagtctttaaacttattcgtaggttatttctagactacaaaggagctaaactttttctgatatccttatttctcacttgcagataatggattttcagcctggggaatatcttaatgtgaaggtttgtgaatattttaatatttcttaggagatttcagacctaatgtgctagtaccatgttttaaaccgtgttcatattttaattgtctattagattaattacaaaggggctcccaccagaaaatctgcaatgtgtgaactacattcttggtcatgtcactagtgactagccactatgcacccatcacattctgaagctgctttttttttgggggttaattataaacaggaggttcattacaatcaacatgggttgctgcttttagagggacaaggaatataccgattgggagacagctggtaaggatgtgatctaaaacatttccttttttgtattattcttttttttccttttaggctttatttggttgtgcaacgttcagacttcagagtcccaggttcccagccttgtttcctcctgggacaagctgtttaaggaagatatcataatcttattttaatataagttctagaagatgtgtactgagtactgtatatagattaacggctcattattgagcttgacatttacaaaatatgggtgcgtatgagcctaatctacttcatggcactattgtcatgactcatgtgtttctgcttccatccactgtcctcaacatttttttagaggccgcccttcacatctaagtatatgctttactgacagttgtaacattatagactatattagtctcctacttagctgattactgaatatttgttctgtttgctaatacaggtacccggtgcaatcaggggacaccatttggatggcaccgtttgtgcctcaatggttagtatctgtcaacatagtgtttatcattcatggaattggcttttgtaggcagctcatcaccgttgccttgctgttccaggtacgctgcccttggaaaaaccaagacgaggtacttgctgtataaagatgtcaatagggatccactgatatgaggaatgcaacatttcctgaccgatggtaatagatcaaattggagagctattacgctggtcttgaagagtccctgtggaagatgatctcagaaaaaaataaatcttctttctcgctgatgaacccttcaaaatgatgaatcgacgcaagaatctcagatctgtacatggaatggtcaagctacccacttgttcttattggtcaatatgaattcagaaaaaaagttgctgtactattttctggacagaactgggctatgctgtgactcttcggaaatctgtattggctaaccccttgaaatgtcgaaataatgcgtcgctgtaatgaaaccaggtacctgattccaagattagtgcctttttttttccttttaattgcagagcatcaaatatgtggcgacatgtcgaacatcaatgtttgggtatctgaagatgccttttaaaaatggaaatgaactgctttaacaatatttgcaagaagaaacatgattactctttggctttatgaactccaaacttatgagctatgattggtttatgcctttatgttaagcttgatctccgaactatgaaagggcattattcgtgctgtcaagggaaaaaactaagaaggaaatgcaagttgttgaagaataattacattatgcttacttttactctcttgaaatgccgtgccaatctttgccaaaaggagatgatagaaaacataatattcttaatcataaggggatatacatgcatgatgtgttgataagtgtgtccctgccacatactccctccatccaacaaatccaacctaataagaatgagacataaataatttagtacaacgaatatgaatctgaacatgagtatataggttccagattctccctactaggttatgttccatatttgcctggttggatttttttttttaagggagagagttctccactccattaaaaaaatcaacttaagacggggtgaaatataacctagtacagtgaatctgaataagtcctaggttatattttatccttgcctagattggatttttttgaatggagagagtggtacaggagaggcaactatatttttttattttgtaaactttttaaataatactcctccgtctcaaaataagtgcactcctctagttcaattttaaagagtaaattacacaagcggtccttaaacttataacgaagtttcacttaggtccataaacttgcaaaatgtgcatcgagatctctaaacttggtttaatgtatcatcccggtctaaagctgcgtttgaccatagtcttgcctatgtggcatgctacgtggacgatgatatggaatttttttctcccttcttccttctttttttctctcttcttctccctttttttctccactttgcctccttcctctcccttctgccgctgacaggtgagacccacctgtcaacgccccgcgaggctggcgagggggtggggaggccggcagcagcaacgatgtcatcgacgggaaggaaaaggaggagggaaaggggaaaggccccccactccagcctgctgcggcagctgctcaagttcaacaagctcacctcctctttcgcggagctcattgtcgggccctgccgccccgctaccgccatcgagcttgcgcccgccctgctcacgctgagctcaccgacgcctccccctgcacgcacggtcgcgttcggcgacccctccccccggggcgcggctggcgacacttccccttgcgcgcgcctcgaccgcttccgcatgaatgacgcgccgccgcccaacgaagtgcgccgccccccctcttcgcccccctccagtgcggcttgcaaggccgcgccacccccgctcatcaccatcgttctcgtcttgggcagcggcggaagaggaagtagagggagaaatcatatgtcgccgttggcggcggccgcctctccctctcctcccccctgggcctccgtctgcggctcctctccttctgccagccggcgcccgagcacgcgcgccgctcctctcctcaccggccaccacccgcgcacgcgtgctgcttctctcctcccgccggccggtgcccaagaacgcacgctgaccgtcgccggaaacctcgtccaccacgcaaggtgaggaaggagagaaaagatggggagaaaaaaggggaaaagaaatttagccatatcatcgtccgcgtggcatgccacataggtaagaccacggttaaaccaggctttggactgggatgatacattaaaccaagtttaggtatctcaatgcgtattttgcaagttcgtggatctaagtgaaacttcgttacaagtttaagaaccgctagtgtaatttacttaattttaaacataattatgaaaaagtatattcggatcatcatgtcatattcatcggaatgacaagaaaataccatcacgttggttaccaagggtgtgataaggatttaatcacgtagcatggctaaaggtttatttttgcaaacatttaataatgttaaaaggcacatttgatgggtagtagtgtttaaactttaggtggattcacttgcagaagtacgaaaaaggaaacatgatctacttcctccgttttttaatagataacgccgttaattttttctcacatgtttgaccattcgtcttattcaaaaaatttacgtaattataatttattttgttatgttgttttatcacttataatactttaagtgtgatttatatcttatacatttgcataaaatttttgaataagacgaatggtcaaacatgtgagaaaaagtcaacggcgttatctattaaaaaacggaggtaatattaaactgtggtgttattttctcctgaagatgaagatgaagttttttttacgcaaaacgaggtggtattaccgtatgattgattgagttttaattattataaacttgaaaaatagattaatatgatattatagagcaacttttatatagacagttttcgtacgaaatacaccgtttagcagtttgaaaaagtgccactaaaattttaatcttaattcaactcttgttgaaaaaaaaacgagacctaagtaatataggaaacaagtgctttgtgctagcagcacgcattgaggatagatatcaactgtcaaccaaagatagtacatgactatgatttttctttgtattaagctgagttctttttaataacttgaaacggtttaattttctctttttcgttagcacttttttagaaatgctaaatggtacattgtatgtaaaagtttctatatatatatatatatatatatatatttttaaaaatcttcttaagtttaaaataatcgatacactattaagcatgaggtaatgactcttcgcattttcgtgcccggaaaatcaacgaccatccaacataatcaaaatagcccttaggctatgttcttcaatttctttcccaactcatttcattctttttaggcaaactttttatgtccacacgcttctcaaactactaaatgtgtgtttttttaaaaaaaaaattatgtaaaaaagttgcttttaatattataagactttttagcattgcccacattcatatatatatatatatatatatatatatatatgcgcgcgcgtgcgtgcttagattcattaacatttatatgaatgttggcaatgctagaaagttttataaactgaagcggaggtattacttaattaatcatgcgttaatgaggaacacccttttttcgtgcgggaaggtggagtttcgcaaactcagccttagtcgttgtttgctgtattaacgtgcactaaaatactgtaggagacattttcacgcaaaatgtagccggagttggttcttttcttgaaactggtcacatggctaggtttttttattttcaagcagaatcaacatactatttttcttcttttagttgacaagttcaaccagatggtttgatcggaattttcgaaaccatagatgttatatttttaatgtgacaccgcttacaagaatactatatcaatatattattaccattccaattagttccttaccatcgtatcatttccatccctataataatctaaggttgcgttcgtttgaggggttgttaaacaaaacggagctgtgaattagtatataactaattaaatattataaaaaacctaataaataaattaatataatttttaaaagcattttcctacatagatttttcaaaaaaaaacacacagtttaactgtttaggaaacgtccacgtgaaaaacgagacacatacacagtatacactaattcaaacaatatttcactcatgataataaaaattcaaatcacaaactgcacttcccctcaaataatatcgaaattgatgcttgaccagtcaacactacttaatcacacacaccacccagagccaaaccagattaaatcaaggtcgggggttgccttgcctaaaccaatacaaacaagctgctaatccaaaatcaatgtcccgtccgatcgcgagatcgcgatcgcaaactggcaaaatcgcacccgcaaaaatatctcggcacgagtcgacgcgacattccaatagcagcagcagcaagcagcattcgcattggccttcgcgcgcttttgcgtttacacccctcgcgccccctcaaaattgcagacgcccccctcccctcccctctcgtgctctcctctcctctcctcttcctcctcgcctcgcgtcgcctcctccgcggcgtaccctaaccctagcctcgccttccccccaatggcgcgtcacgcgtg

SEQ ID NO: 61772 - DNA, 797 bp, Oryza sativa
cccccttgccgccctccgcgaccccccttctgtgctgcgggggggccgcctgcaaatgggcggcgagggggcatggaattttgcaggcggcccccttgctgccctgggggagggcgatttttgcctctccccctataaagcccagtccctcctctgtgaaatttcattatattcactaaaaatccaaaaaaaacaaaagagagagaggggaaggcagcagaaggggagcggcgaagccctgctggttcgctcaattcatcacaggtatgctcccatacatcttttgtgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacaga

SEQ ID NO: 61773 - DNA, 25720 bp, Oryza sativa
tgcttcctccggtggcagaagcggccgctcatgtcggtgtcgtcgtggcagccgcagccatagcaatggccaagctcccaagtgatcacccatggtgttcgacggttcgacctcgagagctccatcaatggcgtctagcttgctctcaagctaaaggtaccccactccatccatcgttcgcattggcaaaaaaaagattggatcttacgaaggatgaactgatcatagtctcagtgcttcatgtatcgatgatctagcattctagctagggatcaagcaatgatcctagctagctaagctaagctacctgccatttttcatggcaactcgagcttggatttgtgatggacacgttgcatgagaaggcgccattgttgggagaagaaaaagaggatcttttgggcattcaacttggtgagccagcttccttctaccactagctctagcaccaaattcttttcattttttttttgcttggcaaatcttgatttttttttcctttagttactcctacttttgtttagctttgatacccaaatctgatattggtggagttgttatagattgttggttttgacactactactactacataatatctagatttctagatctgtgttaattactatgttaaaagggtttgtgcatgcatgcacgctcttgcaaaattaggtcatgttgcatatacaattggtttctttgatctcaaataatgaagatgatctccctattgtggctcaatggattgggctcatttttaaattttatccttgcatttcacttcctctctctgctgtttgatgcgcttgtttgtattataactaatcatgctttggccaccactagctataaactaatgcaatttggttggtctttgttttacttaggggggtaatgaacaatgatcactcttgtgtgctgcgaaaggccagtgcattcttgcacactgtagctagtaattaattactatatttataccactcttgtgtagctaagctagctagtataattctcaaatgtgtgctagctaagctatagctgctgcattaagagaacaaaaaatagtagaatcatgtctcctgctgcctaattaaggagaattttattgtgttcttgtcctgtgtcagtgtgtctatgccccagatatgctgggaagctgtccttgggagagcatggaggaaatggcatgatcccatgcatcaatggcaaccctaattcctgccccctgtcccctctaacaaaatcatgggatttctcaagcccaagtacccccttttggtggcacaccctgcaatccttaaatctctcacttagcttgttctctgctgcctctcatctctctgaagatgaccattatttatttttactccattttggatatatgaatctctctctctctctctctctcacacacacggaccatttttactccatttttactccattttggatatatgattcctctatcttttttttttgaagactttgatttctctatcttgattttgcattgggatctttgaatgcatgaattcttaatttgttggttgaactgcattccatatttaacacatacataggatttgttaatggttccttcattcttcttgcattacggccgctttgtttaattgcatactagttggatcaaaggaagagcgaaaagacagtgccattcatggaaagttctttaggttgaccacttatagtctaccagtcgtaccaacctttctcccaaagttgttcttattaggagtagtatttagagaaacaaagttaactacaaatcgaagcactttttttttgtgtaaatctgaagttatcctagctcacacttcaatttaattattgtgccccattaaattcattgtttctgcatatataccattttatggctaggaacttaataacagtaataatttattagacatgtccttaccaaatggagttcagacttcaaactaaggaaatgattttattcatgtgtgtcttggttcttgaatttatagcacataaatagcatgactctcagtaataaatcatctgcttagatatcataaattgcatatcgaaagcacggaccatcttttatccatgctcaataaataaatagcggagaaaggatcaacattattgattgcattctttcgtcagtatcacttttagttgattttagcacatcagcaggcagcagcatagctgtacatttttacctaaccataactgactaactactaagtatttgctgacaatattatatgaaaaaggctttttgctgatgatgactatctaaatttaatttgtgaatatctttgtgtgattcctagctatatatatgtgtgtttctttaaattttgttgattttgtgatcaatgcatacgtcatctgtagtcattggatatatatatcacatctacaacctctagaaaaaaaaatctgattttgacttttcaaaatcaatatatcggacctattttgatcactcaactgtgtatcatgatatgtatattatatattcaaaaatatgtataaacatgtaatattattataaacatatatatgaacaaaaaaaattttaattactcgtgtatcgttccatatgtccaaaaatatatacactttagaatatttttttttgtcaaagttactccctccattccaaattgatctacatatttcataagtacaccaagattaagaaaaactaataattatctcatattatatttactctagcaacaaactcgatgcatgcaccatccccgctatttcctagccaatagcaaattaagatattgcatgtgggttataaatacttgtgtgcatggatgtatgcatcaatgtctatttactccaatgcataatccaatgcataaatagcaaatagacttaatgaatgaacataaatatgtagattatttaggaataacctaaaaaaactatatgtagatcaatttcgaacggagggagtaattaatatctattgattgcacaagttctaaaattaattactgacgtatatattttgtggccaaagggatgtgacattgttctagggctaattattatctcatatattcttccggagattttgcagaatttttcatacgcaagcttgattttctcctaaacaatttaacgtatagtttggttaattagagcagaaaaacgcatgcaaaatctccaaaaaggccaaaggcaaagtactgtttgacccaaaagatttgccctagtataaactaaattaaccgaatatgacataagtcaatgataggatcatgacatatttggtggcatccatccattttctttaaccattcttgacacatacgtgtacacacagttgccaacagcaatgcaagcatcatgcacacgtaacatcacatcggccagctagcataagctagcacaaattaaaggcagatttcttactgaacgagcaaaaacacacatgcaattactacgttttctttctcaaaacacataacctactgtatagcacttttcgaaagatcgacatataaaattgacaaaggtaccacgtaccactaaaaagaattattagttgcagtaatatgtagggcttgatcgaacacctcgggtgagtaggtttaactgagtgtatttagttatcataatttttctacctttttctacacatatttttgtaccttttgttttcatacttactcctattttgcaggtatatatttttataaaattaatggctgttgatagtacctttttttttcaaaatcaaacataaattctttagttgttatcaagcagagtagctgtatttaattggttcaaacagtcgtgcagcacaccatacgaaccacagattggtcatatagagtctggctatcaaatggtgcttatatatatagttagttaactggaaacatacatgactagtatatatgtatctttttgtagggttcttaattaataagcttggtcgctactagctagatactgtttctaattaaagaatacaattttcgtagagacaaattaataaaagtgttagagcccagaggtcggatccacattatccaatatacatatcttgtatactaaagcttttatggtagagcatgatcaatcttccttatcatgcatactctaacaaggaggcagctagaaagttaattaattaagcatatgaaaacaaaaccatctcctaattaagcttctgaatactgaatcatctatctcttaattaagattgaaattaaacttagtcatgtgacagacaattcgtgcgtgcaaaggtttccgaacaaattaaacccaagaggagatcgtccgtgcatgcatgtatgtgctatatgcttggacggaagagattaaacaagtggattttaatttgtagagaaatcaattaatttttctgtcttggctagttgtaaaacttctttctttgaggttgtttaggttcatcatcagagctttcctcagaacttcgccataaagttgtagaactaacgccatagagttatatccaatttaatttgcattaattgtactataacacagaagagtacatgtatgccaaaaatatgatatgtgtccaattccataagtttgcatgcatgtacaattttaataattaactccattttgtacagctcatcagcaaactccatacacgtggcacgtagcgattggtctaacggtgtcgcgcaaggtagcttacctactcagctagcaacacgtctccatgccgccggctcgccacgccggccgccgtgggcaccggccgccggcggctcgggcttccgtatacgataatatctacggccgtgggccttgcggcgtcggcgatggcgccggcgggtgcccgtcctctccgcccgacgtcgtcgccacgatctcctccaggtccggcagccgccgccgccgcggagctcccctcgtggtggtggtgaccgtgatggtggtggccgtgatggtggtggtggtggtcgacgtcgccgccggcgtcgtccgcggcgtcgtcggcgccgcgggtgctgtggcgtcgcttcatgagaaaggggatgcggaggtgggagtgcggcggcggcgccgccttcttcttcctcacgtccgtcgcccagctgtgcaccgacacgtgcaccgtctcgccgaacgcctgcagcttgatgtccccgcccatctgagcagcggcgagcgtgacgtcagccccacgtcatcggagtcacagttaaagcataatatacttaatttttttattatactccctctatttcatattgtaagttgtttgatttttttttatcaaacttttttaaatttgactaagcttgaccaagttttttaaaaaaaacgtatttaatttttttataaacttaatctaacttaataaagtttaacttaaaaaaaagtcaaaatgatataatatgtaatggaaggatcggagtagtagcaaagagtaattgtatgttaattacgtgggtaacgatggcgtatagcggcagcgtgctgtagctgcagagcacctggacgatgattctgcaaaagttcatgacagaaacatcacattactgttcagttcaattcaattcagtgcagaaatatgtactaaaatttttttttagagaaggtaatacagaaatatttgaattttttttaagattccaattaaagaaaagcaatcaatttctagcagaaatcagatgtaaagctcagacttttagtactgacccaatagcaagtctggggagggcataaatcttgttctccatgatgcatgaatcaaacccatatgttgcctgcaattgaaatttaccagcttgtttaattagcaccatagttttatactaattaaaattgcagaaacccatatgaagacataagagtactttctgcaagataaattaaaagtgcaggaaaaaaaagaatgtaatgctgtaaaacagaccagaacccagaagaaaaaacccatctcaaaggagttctggaacaggatgaagtggatcaaatggaggacaatcctaggcttgctgaaccagaagtgctccttgcatggctttgtccaggggtttcctgttgcttcatctgggcagtctgctgcctcttgtgccagcctagtgcttatgagctccagctttgtgccaacaatgagtaggagctgcagatgtgccccaaaagttggaattcctcaatcattaaaactgaaaagagtgtgctcactgttgacatatatgttgagttgtttgaagttcatacttacaattaagggcaagaaagacagccagaagtatgtgtgccaccctgcattggatgcaaatgaaaagtttaggggatagccacctgaatagatgatggaaactggatagtttcattcaatgacaaaagacaatcctagttcaggcattcaacagtctgatgcagatcaattgttgttgtgatccatgacttgttctgaatgagtgaaaatggatcatgttcgtcaactggaaatgctgtggttaaagtctaaattgtggtactagaaatagaataagtcgtatggtaacttaagtggatatctcccagcaaaaaaaaaagaaaaaaaagaaagaaaagaaaatttaagtagatatcagtgtgatggaattcagttatccaaacaattacatgagggcacttgtttttaggtttatgggagttaccatttatattcagtagcaggaagacaataacgaaaagccataggtaccagctgcatgtaattgcatagcattagatacagtaaagatgatgtagtttttaatcaagtaaagttagtattttaaccaagatactaacctgattccaactacttctttaaaatcatgctcaagagcacgaaccatgtacttgtggaaatcaaaatcaggacggtttgggtagtgcctctggggaaaaaattatgtcctattagcttcaaaaatagtacaatgacacttatgattgagctgaagttactcagagatgcatctgacctgaacaaaagctgatctaagtacttgataatcaggtttaccaacagaatcataaaactgcttcaagaatgagatctgaaatcatgtatgaacaaaatcggctgtattagaatatagctaaagtaagttgaaatttgtatttgagacacagaatttctgcaataactatgcagacagtatgcattgtcctagtacaagacacatcagtgtttcgtcatgatattgccatgttgcagggagacacctcaaataagaaaaaaaagtaatacagtactgctgcagtttgtacccatgctattcatatctttgatgtcaatagcttttccgtaccttaattaaccttatctgacaatggaccatctacaggtattctattcctttatcacaatggagcttgcgtgtgtcctgatcacacatttggactttatgaattatgacaacttactcgcgagggctctacttttatattttgctggttatcgacatatttaattcctaacttacatgatcttatatagtaaaattttatttttgagttctagttctgactcttgagtgtttgattttttttttaaaaatattttttgtaaaattcactagaggtggatgtctttttttacatgataagtggatgccacaataaacgaatcaccgttaggtgttctaggaaagcatatgattacttatcaattcaaggtaacatttaaccaacactactctaaagagtagtatgattttctggccggggtgcggttgaaatccgaattgatcattggtggaacagcgaggcaagaacagaataaacagagaacctattttagtcttgttgtcatcctcctttgtaaattgtaactgacgatttaataatggagttacaaatagtaattgataagcataataggtggcccgggttacttacggcacatcttacaacaatgaatttcatccagcctggcctctttggtcgctccttggttcttccttgttgaatttctttctcccatttctcccattttttcatctgcagaatttaccatagatgagttgattttactgatgcaccgtgaggagcacatatttatccatacaaatagttttaccttggctccaccaagtaacaatgttgtaacacaaaatacaacatggacaataccaaggacaaagataaagatgtgcagctgatgcaaagcctcttcagatagcataggaacttcaccctacagaagcataagaatgtgatttcggaacgaccaatctggtaaaaaattcatgaagataacagtttcttgtttgttctactcttcaagaaagaaaagatacccacaagaaacaaattctttagtgaaaaataacaaagctaaacaatccagagtggacacttcgtggtggagtttatcaaaaattcccaaaagtttaagaaaatctctccatagttcacatcctacctttcgcttgcaaagtttggaagcatcttctgtggtctcggacgtctctctagtaatgcatggaagcatgagatgtgcagcactctccgggatgcaaatgtgattgataaatttttggaagacgctaagcaggaaggaaatgaaacccagaagcatcaactctgcacaagtaatcaacaagctggatcaggcagtgaacaaatggcacaaattattgtggcataagtaaactggtatgaaatgttctggccatcgtgtcatgaagcattttattttatcatttggtgacgataagatcatcttttcaggttctgctggcagtaatatgtgaaagaaacagagtgaaaattgtcctttgtatccaagaaataaattgttgtacaggcagcaatctaacattctaactataagaacttggatgatattaccttctttgactctctgaagagcagaaaacagtgcttcttgcccattgaattttagcacctgatgaacaaggatacaacaattagtaaaaaaggcaaacttgttttgagcgaagttattgctgtaaaagaaagtgatggctcaatatactgcaggaatttgcaaggctaaatctctgcttcctacagagtaaacttcaatttcgagctgtctaacatctgaatctaacctctctctctctctctttttcaatcctacagttgtatcgcccgagttcatcatgagtaaagccatacgagaaacagtgcagtgcagtgggaagtgaagcagcaagcttgaacaacaattccaggtcactgacagatactccctctgtattctaatgtatgacaccgttgactttttgactaacgtttgactattcgttttattcaaaattttcgtacaaatatgaaagtatttatatcatgcttaaaaaaacatttgatgatgaatcgagttacaataaaataaatgataattgtataaatttttttaataagacgaatggtcaaacgttggataaaaagtcaatggcgtcatacattaaaatgtggagggagtagttaccagcaaattccatggtatatactatactatcaatttgaatgagcaggtgatgttcttcatcgaatctgaatgcttagtaccagaggattttaactaagaacaactggaaacactactgatttgagccgcaaagataaaaggggaggtaattaattgaagcaaattaagattggcttgccttgccgaggcggtggaggaggcgctcggcggcgagcgagatggcgacgatgatgaagcagactccggccaccacccatgtcggcgtcagcgccagcgactgctcctcccctccctcccccgcccccatctccgatctccctcctcctcctccgacgaggcgatgcgcgcgcgcgctacccgcaccatgcggctgccgttaaaagggccggggggcgcgcgcgcgcgcgcacgacagcgagcgccatggatggcgccaaaaaggcagcctcgctttcgaactcgttttttgtggcttctgtgctcttgcgtgctactccctccgttcaaataagatggacggtcacgttgtacacggagactcggttttttttttattattattattattattattattattattattatggagggaggactcgtgtactagtgtactagtactactgtggtggcgctcgcggcgacgtgaggcggcagaaaccggcagggcgtcagccacactgtggagtgtggatgttgatgcgtgcatgtttgaatgctcttttcaacaccaaataaaaagaaagaaaagaaagagagaaaaatgtatggatgctgctgctgtgtggtgaaaatgggactgactgacctcatctgctgatatttcatctgaggctgagctactgaattatttatctattgaaacaaaaaaataaactactacatacatcccaaaatataacaaacaatgcaatacagaatgtgatacatcatattactacgaatctgagcatatctcatatcaagaatcatcgtactagaaaatttctatattgtactatgttgacggatgcatactgaatcattcatatatgtagtgtgtatatcttagttgtgttggacttattcatggataattcttctgaggaaatgagattgaactagtgacttaattacttcttcaatttcatattatataacgtattgttttctccgtccatggtctagattcactaatatacatataggtttaaaaacatttataacacatatgtagattcatccctcgtatagattcgctaccatacaaaggccactctccagccacttggtttatcatgtcatggcctgagcagtaaacttaaatgggcagattatcgagaatatcaagtcgatcctcttctaggaggacagatggctacaggattcgagccttcgctcttaggcacctgagctttatgatcgcgtcccggtgcgtgtccgccgaaagctcttggtcgctgatgcgttggccaacaaccgttggatccgcgatctccatggctccttgggagtccaggcaatgctgcaatacttgcagatttggtcgttgttgcagacaacaactctctcaaaggaccatcctgattctttcatctagaggtgggagagttcggggtcgtactctacccggtcggcttaccttgccctcttcccaggcaggatctcattttagcacctaccaatctggcgcttttttgcccctctcagtgtcgctacttcctatggtttgtcgctcaacggagctgctggacggctgaccggttagagaagcgtagtctgtcgcacccaacctattgtgtcttctatgaccaactggaagaaacaatcgattacattctgattaggtgcgctgagtccctccagctgtggtggactatcttttcgagccttggccttcttcaatgcttcccctctgacgctgattccttccatgagtggcactgctctttccggctcaaaattctgagggagcgtcgtcgtgggttcgacactattgtgactcttggtgcctggtccatttggaaggaaagaaacaaccgttctcgatcctagcctgaggttgtcgcagccatgtcgcaagagacagcgctttggcttcttgcccatcccccatcgccaacactttctagttagcgtgtttggtcgttcggccgtcacattgtaatcacgagaatagacttaagtctttgctttcctttttttcctttccaccccctcccccctccccccctcttctttgtttgccgtttatgtaacttttatttctcttaatgcaaaagtgtacaatgctcttttatgtattccaaaaaaaaaagtaatcgagaatattctataacctttcaaagagcagtagcgatggttatgacttttttacagccactgctttactagctttcctatggccgttgttatgtcctacactcctacatccccgattccccgtcgtagttagtcgagcagggtccaaatggtgggttttggttttgataaaaacgatcaaccatccatatcatggataacgacaatatcatttaccgttaaagaaaaaatgacaataccatttaacatatactggtataattagctactttctttacatagataatactcgtcgtttggaattggctaatgtcaaactttggcctagattagctcccaactttttcttcaaacttccaactttttcatcacatcaaaacttttctacacacataaacttcgaacttttccatcatatcgttccaattttaatcaaacttccaatttaatttggcgtgaaataaacacacccttttaaactttttaactataaatattttaaaattatttgttttaaaatatgaagactatatgtatatattagtcttaaaaagtacatcaatgaaattatattattacaatatttctatttatattatgatggaggaaagtggtcaaaattgtttttcgagaccgtttacttatctaaaacaataagtattatgaacttggtgggtgtgagcttattttcttatatagctcttgttcaagttcagaaatcttttttaaaagaaaatatagtgggtaaaaaaaatgatgattgtcagggttacgggttaggcataccctttacccttcgatatatgttacatatcagtatggtatacccacgcgcatacagatacttcttgtatattctatggaaatccttcacggaatctacggatgggaagaatcctactcggacaagattgggtcgttgacgtatcgaatagggtctgatatctccaagttctacttggagacctccagatctgtgatataaaagggaccccccggtgagggcttaaaggatcgaatctcagagccgacacaacccacgtagcctacgaagccggagcctgcaaggagccaagccatcgagatctagtcgaatcaactcgactacgatttcgccggattcgacaagttccattgttccctttgtaacatgtgttttccaccatataatcccacatcaactggattagggctattacctatcaaggggcctgaaccagtataattcttgtcttttgttcgcttgatgtcgtactacgtagatccttgtaccaacgtaccccaataccctctatatccggtctacgggcatcacctatcgacagtggcgcgccaggtaggggcacttggtactcaaggttctactactatgtcatccagcttcgtcgacaacggcgtcaacaccaacctcagccaagtacaccctgctttaacgatgctggtatggactcaagtcagcgaaatcgtcttcccggtttacaccacaacgccgatctcaaccggtcccccaatgaccggaaacgagaacgcagtgtctacaaaccaagacgacttcatgtcgaaaaatcctcccgctgagacggagaacggagcatcgacgacatccgagctcgagaaggattctgatgcggccaaaccttgttcttccgacatgaatcgcgagctgacaaagatgacttccgaagccacaaggtcctggtgtcctatccacaaaaccaggaaacacactttgtaagcctgctaggttttcctcaacgtccgcgctgaaattcgcgcctgcaaagagcgtggaattcagcgtgtttctccaactcgtgatgtctattgtcctattcacaagacaaagaatcacgacctctcaagctgcaaggtctttcttggcgccatgaaagctccgtctccgaagtcatacgtccccatcagggataacgacaaggaacaaggagcgacttcaacttcagatcgatttgttggggtaatcgatatcgatcctcacgaatcatcagtcttacaccttctcgaagactatgggtcatcgataacgagtgcgccgcgggaggtattggctatcgatgacgttggcacgtcagcgcatgccaacgcagaagcgggaggacaattgactactccagcccagcacattagggccgttcaagctatactgagggaaactccctacgatcccgttctgaacgatgacctcgagcgttggacagaatgactacgggaatcagtgaccaacctcagcaacgcgtttgaagaagccgctaccgcagcgcactcggagcagccaccaactggcgatgtcaatggtgaagacccagaacgaagggaatcaccccaacgagctacccctccacctcgcggcactggcgatctccgagatcacatcaacggccgccgagaggcacgacgtacacaagacaatgtgaatcgttctcggcgtcatgtctcttcacggcgccatgataacggaaatcaaagagaccgctcaaacgaggaccgagaccaggacaaccaccacgatcacaacgatcgcgaacgacgggtgccagacaatacaggtcgaggccatcgccataacgaagacgatgacagagatcggcgccgagacaacagtgggagacgacgacaggattcccgagatccaggccgacatcctcgtaatcgtacgccggaaccaagcgacccgtcgtcatcgtcatcatcctcgtcctcctcatcatcagacagacatccacgaaggacacacgaccgccgacaacccaccgcccccaacgctgggtgtagggctttcggtcgttccctgcgtgatgtccgatggcctgagagattccaacctggagcaatagaaaagtatgatgggagcaccggcccagaggagttccttcaagtctactccacagtactctacgctgccggagcagacgacaacgcgttggcaaattatttaccaactgcgttgaaaggttttgcacgttcatggctgatgcatcttcctccctactcaatctcttcgtgggcagacctatggcaacagttcgtcgccaatttccaaggaacatacaagcgccacgcgatcgaagacgacttacacgtgttgactcagaactcgggtgaatcactgagggaatatgttcggcgcttcaacgagtgcagaaatacaatccccgaaatcaccgacacttctgtaattcgcgccttcaaatccggtgtcagagatcgctacactacacaggagttggcgacaagacgcatcacaaccactcggagattgttcgagattgttgagcgatgcgcccacgcagatgatgcgctaagacgcaagaacgataagccgaagaccgggggagacaagaaaccagccacggacgcatctgagtcaagcaaaaagaaaaatcgcaaaaatgggaaaaggaaagctcaagtggaagttcttgcagcagaatacgtgaaccctcccaagcgcccagacccacaaagtagcaacacaaagaaagcatggtgccccattcacaagacggacaaacattctctggaagattgccttgttttcaaaaaatcgctcgagaagcacatcgcatttgaaaaaggcaagcgagtacgcgtggtcgagaagaacgaggaggaggttcctcacgaatcggatccagcgtatccagactccgacctccacgtttcacacatcttcggcggttccacaacgtactcctcaaagcgagaatacaagaaagtggaacgtgacgtctgttcgacatggcagcgggctgcacccaagatgaagtggtctgagcagaagatagagttctcggaagaagaccaccccaagaccgccgtcatcccaggacgatatccgatcgtggtcgaacccactattcggaacatcaaggtagcgcgagtcctcatcgacggtggcagctcaatcaatcttcctttcgccagcactttggacgcaatgggaattccgtaaagcgagttgacaccaaccgatcaacccttccacggaattactccccaaaaccattgggcaagattacgttgcccgtgactttcggccaagccaacaacttccaaatagagcagatcacctttgatgtcgctgaattcgacacagcttacaacgccatcatcgggagaactgcacttgcgaagttcatggccgcatctcactacgcgtatcaagtgctcaagatgccgggaccgaagggaacaatcactattcaagggaacgcaaagctggcagtgcagtgtgacaagcggagcctcgacatggtcgagcaaacgcccagcccacccgccatgactgagccacccaagaaagtgagcaagacaaacaagacgccgaaaccggacggcaccatcaagatcgttccactctccagtgccaaccctgacaagaccgtcaagatcggggcgacactaaacgagaaataggaactcgcgctcatcaccttcctccccgataatgctgacgtgttcgcttggcagccgtccgacatgccgggggtccccagggaggtgattgagcacaaactcatggtgcgacccgatgccaagccagtaaagcaaagactgcggagatttgcaccagaccgaaaacaagccatacgagaagagctcgacaaacttctcaaagctggcttcatcagagaagtacttcatccagagtggctagccaatctagtcatggtgcggaaggccaacggaaaatggagaatgtgtgttgacttcaccgacctcaataaggcatgccccaaggatcacttccctctccctcgaatagatcaactggtggattcaacagccggttgcgagttgttgagcttccttgacgcttactctggctaccaccaaatcagcatggcaaaagaggacgaagagaagacagcattcatcacaccgttcagggtattttgctacgttaagatgccgttcggactaataaccgcagggaatatcttccagcgcacggtccagggcgcacttagcgaccagcttggcaacaatgtcgaggcatacgtcgacgacatcgttgtcaaaaccaagacaggcgactcattgattgccgatctgcggcaaacgttcgacaacctccgacgatatcgcctcatgctcaatccagagaagtgcatgttcggagtaccgttgggcaagctgctcggattcctcgtttctagcaaaggaatagaagcaaaccccgagaagatcaaggcaatcaagaacatgaagtcgcccacaagactcaaggaggtacaaaagctaaccggatgcatgacggcactgagcaggttcatcgctaggatgggagaacgaggacaacctttcttcgctctgctaaagaaacaagacaaatttgtatggacacaggaagccgaagaggcatttgttgcactcaagcgctacctatcaaacccccctgtacttgttgctccccaacctaatgaagaattattcctctatattgccaccacaccgtattccgttagcaccgtcattgttgtcgagagagagaaagtacaacgaccagtctattacgtcagcgaagctctccacgacgcaaagacaagatacccacagatccaaaagctactttacgcggtcatcatgacatcaaggaagctacgccactactttcaagctcacagagtcacagttgtctcctctttccctcttggcgaagttgtgagaaacaaagatgttgtcggccgcattgcgaaatgggtagtcgagctgagccagtttgatgtccactttgtgccacgaacagccatcaagtcccaggtactcgccgatttcgttgccgattggactatgccggataacaaatcagacaaccaagttgataacgaaacatggacaatgacgttcgatggcgcactcaacagccaaggagcaggggtaggatttatcttgacgtctccctccggagatcaattcaagcatgcaatccacctcaacttcagggcgaccaataacacagcagaatacgaaggactacttgccgggataagagctgcagctgcacttggagtcaagcgactaatcgtcaaaggggactccgagctagtcgcgaaccaggtgcacaaagattataaatgctctaaccccgagttatccaagtatcttgcagaagtaaggaaactagagaaaaggttcgatgggatcgaggtccgacacgtctaccgcaaggacaacattgagccagacgacctagcacgacgtgcgtccagacgagaatcgctcgagcctggcacttttctcgacatcctgacgaagccatcagtgaaagaggttagcggcgaagttagctcggacacccccgacattagctcagaggtcaccaaggtagaacgtgccgtcgccgacatcgagaccacagacgactggcgcatcccactaatcaaattcgtcaacagcaaggagttgcctgaggacgatacagaggccgagaaaataacccgtaaagcaaagatctactgtatggtcggcaacgatctatacaagaaagcgccaaacggggtacttctcaaatgcgtctcgaccgacgacggcagacaccttctcctcggtatacatgaaggcatatgtgggttacatgccgccggtcggacattggtcgggaaagcttttcgacaaggctttttctggccaaccgcccttaaagatgcatgcgacatggtctagcgatgcgaagcctgtcaattccacagtaaacacacaaagctacccgcgcaagcgctccagactatccctctaacttggccgttctcgtgctaggggctagatatacttgggccattcccacgagggcagggcggctacagattcctattcgtggcgatcgacaagttcactaaatggatcgaagcagtacccacgggggaaatcaaggccgacaacgccatcaaattcatcaaagggatattttgcagatacggactaccgcaccgcatcataactgacaacggctcccagttcatcagcgtcgatttccaggattactgcatcgggctaggggtcaaaatatgcttcgcctcggtctctcaccctcaaagcaacggacaagtcgagagggcaaacggcatagtactacaagggataaaaacccgcgtctacgacagactcatgtcacacgacaaaaaatgggttgaagaactcccatcagtactatgggccgtacgcaccacaccgacaacgtctaacaaggaaacacccttcttccttgtgtacggctctgaggctatgcttcccggcgagctacgacatcagagtacacgagtacagaagcactgcgatgaggaccaggaggaacagcgggacatcgatgtaaatcttcttgaggagcatcgtgaacaggttgccgtccgagcagccagctatcaacaggcccttcgccgttaccacgagaagcgcatccgagcacgcataccttcgatcggcgactacgtcctccaacgagttcaaagccaagcagggcgaaacaaactctcaccaaaatgggaaggaccttacacgatcacacaagtcttgtggccaggcgcattcaaaatcgcagacggcgacggtcgcgagttagcaaattcttggaacattgaccaactacgtaaattctatgtatgagtcaataccatccatacctgtaagacaccttacagtatcaatgaagcctatttttaggcccatattacaatcaaagtgttttcgcctgatgatcccttaccctgatgacacctcgcgttgaaacctgtccttatgtccctttacgccgtcttgaaaaggcctctgaggaacctaagggatcttcggctggggacgcccagagccgataaggccttgtcagatcctgtagagacgaaagaccatgtaagatctggtcatgtaagtgttctcgccgtgcgtattaaccaagccgtaaaatcggaaatcaactttccaacttcacggttgggggctaggatcagagcttatttaaccaaggcgggtcaaaggtccaagagccttatcctccgagaaaatttctccgacaacaaggctgggggctagggagagtgtacgactcaaacggctgactaaagtcgttaactgagaacgcactcttacacacgacattcagagtaagagacatttgttaaagatagatttctttactatttcacacaatacttgttacagtttttacacaaatctttcgctacattacatctttttcctaagatatttgtcacagggtacgaaaactaccaagaaggccaacgctagtccatagactggaagatcttctcggccaatggcgacatcgacctcgctagatggtctatctccgccggagtcctccgagaacaagcaaaaccctcacggagaaattcgaggtccaagctcgggcgatgacctcgtaggcaagccaacacgtgccctccggcgtatcggctcgatcgacgacactcctgcttcaaggcctcgtcgatacgcttgccgatgccatcgagttgggcacaggccccgttcagccacgagatgtacccggccgccgactcctcaggatctccgcggaccactcgaagttctttacagactctggctatggatgtgcagcaactctttaagtacgagttaaaccacacctcacgacctcggagcgtttccacagcctgctctttcttcacggccagcatggttctctcgagttccgccacttcaaacttcatcttccagtattggatatgacgatcttggctagcaagggcaccctcgagatctgcataatgtgataaccactaagtcaagctgtacgcctctttcgagaacatggctgatctagtcgggatggcatcaaggggtgaagggactactaacctgaggaagtcgtcgttatccctgtctccgtatcaagggtctaatccacattgtcgggcgacacgtgtggttcaaactcgagtactggaattatcgccagtgactcgggctgcccgcgctgctagacatcctcgtcatcagcatctctacaaaggacaagagttcctgaggtcaacatacaaaagtaaactaggatgataatcgcccgcacgaaggaggttagaattcaagttttacacattgtgtcttggaagtacaagaagtcctactcttcaaatagggggagaacagactcccccaaatcaccgacttcttccatcacctccctccgcgtgtcactagccgccccctgatccaagatctcgcgcagatcgagttcaggacgcgacagctttacacacgcgaggacatgacacgccccagtgtagatcccgttcgacgtctccttcgcgatcctggctgcatgcttggaggggatctcccccatcgccgtcgccagttccgcaagggaggaggtcagcgagaactcgtcgggattcaccaggatcgtaaacttgatgccgcactccccggcgagctggtgcaggccagtgtaggtgacccgcaacgagccctggatctccgataggttgttcccgagttccgacatgcggtcctcgagcctcttccgttgtcgctcgttgccggccaccaattccctcatcttcgtgaggtcttcacgagctccagccaactcgcgcaccagccggtcagcacgtgcgttcgccagcgctgcttccgacctcgcctccgcaatctcgcggccaataccgcgagcacccgcttcgaggaggcgccccatcttgacttagagctcctcccaggtgaggacggcagctggtggatcacgacctaccgcgggatcgctgactgggccgctaggcgtcgccttccagctcccggctgcgggcacgacatccgtcgaagccgcggcaggcgacgcactggaagtccctccggacttggcttgcgcagcctttgcccgcgcctccctacaggacgaccatgggtcagacaacgcttgaatagaatcacggaaatctaaaaattcatctacttacttctcgccgatcgtcacaatacgttgtcgtcgtggaggtgggggtgacgcgtccgaggcctgaaagacaatcaacgcaaagtaaggcaaaatccttctggctgcacgatctgacgacaggataaattaccgagggtgtcggcgtcttgcgacgatgtccgcttacagaggagaacttcctcccctttgtcgcaacattgccaccgctagtggtggcagcagcagcatcatacgcctccttggcgaccttctctttcagagacgccgccacctgatggtctgtgagtggcccgatgatgtcagtcagaggaagagcctacgcttaatcaagtcataaggtgatctcgaaggaaaaatgcgtgatgcttatcgggtgcacttacgttgatagcgtcatcacgctcggccgcccccttttcacaaagaggcgtggggatgttgctcgccgttgtcggaccgctgatcatcacctggccgacacggcgctccacggcctcactgttcagacctgtaaatcgagaaccagatttcgatgagtcaataggaacgcgaacataagcatgtcaggataaatgcgagaaagataccccgaggagaaacccgggtcgcgtcctccggtccggaataattataagctggataggcccgagcctggagtggctggatccgcctaccaacgaagtctgcaatgacttcataccccgacaagccccgtactcggagatcatcgatgatgtcgataaacggctgaagagaaggggtcaaggggggctttgcggtccaagacgaaatcttgtccggttgttctttgggaacaacgaagacagggttcgaatctttgatctcaaggtagaaccacctattccgctatttgctgcgagaagaagggcactggaaggggatataacgcgacttcaggccatcctgaagtcggaacccgacgcaaccagataccctgttggattccatccaacacagttcatagtaagagcgaaagagatcaagaaaaggctctaccccaatgtaggcctcgcaaagatggggcaaagatgctaagaaaggcaatggaattggggttcaaatggagaagagaaagaccatagaaattcaaaaccaagagaagaaactcggaaggtggagggagaagaccgcagagaacataatcttcgatcgcaaccatgcgacccaagatgggctggggattagtacctcctgcttctctctccatggttccacggccaggaaggacgccgtcttcctgaagcttcttcagcgacgcactggtggaagatgacttgctgaggtccattgctgattcaagatcgccggagaaagggcctaggttgatgaactagggtttcttgtgacggcgaagaaggcgaagagcgcttacaggtggaatgttttcaacacggttggcggacttcaaaatggatctccaaaattcctttaaataggcgcactaccgacggtgcgaattccaaggacagagagagatgcccgccggaaatttctgggtccgttacgcgcggcggttttctggacttcagtttaaaattcgctcgtgaccgttgggctttgaatggcgtgctcgactacggcctgtctccgcgatcctcgcaccgggaacgacaacaatctcgacacccgaagtcgtgaatggttacacgagcccattttaagcagaagtcgggggctactgtcagggttacgggttaggcataccctttacccttcgatatatgttacatatcggtatggtatacccacgcgcatacagatacttcctatatattctatggaaatacttcacggaatctacggatgggaagaatcctactcggacaagattgggtcgttgacgtatcgaatagggtctgatatctccgagttctacttggagacctccagatctgtgatataaaagggacccctggtgagggcttaaaggatcgaatctcagagccgacacaacccacataacctacgaagccggagcctgcaaggagccaagccatcgagatctagtcgaatcaactcgactacgatttcgccggattcgacaagttccattgttccctttgtaacctgtgttttctaccatataatcccacatcaactggattagggctattacctatcaaggggcctgaaccagtataattcttgtcttttgttcgcttgatgtcgtactacgtagatccttgtaccaaagtaccccaataccctctatatccggtctacgggcatcacctgtcgacaatgatggttcatgagttaagattcgagacataggttcataggttcatgagttaaactctcaactttctcatattctaatatgatcaagaagaggcaagatgtttatgtctttactgccataaattgaaattatgataatggttggatgcgccaaacggtgttcagaaatagtggtaaaaaacagtactagtaagtctagtactccctctgtttcaaaatatttgacaccgttgactttttagtacgtgtttgacaatttgttttattcaaaaaattttaagtaattatttattcttttcatatcatttgattcattgttaaatatactttcatgtgcacatatagttttacatatttcacaaattttttcgaataaaacgaacggtcaaacatgtgctaaaaagtcaacggtgtcaaacattttgcaacagagggagtactttcctcttaaaaaaaagtaagtctagtatttgttgggccaaattttcctccataagcatttgctctcagcccattgcagcccgaaaatctaacaaatatgagccattgattcatatccttgatcaatggtgaagattaccacatcctttgtgataggaagaaaaaccctagctttcatggagagagttgagataacaacaaccattgaggacgagaagaaaaccagcaaaacacaagagagagagagagcggagagtatagaagaaaagttacagtttgttcagcttggtagctcttatccgatcttcatcaagtcagcgattggaggttcaaacgtgattgaattggcaccaaacttggtgagtttgttccttactttgagcactttaatctggctagtttatgcaaggattggttgagtagagtacctgatttgagtagtggtttatcagctcgagttgctacagttacattatgcaacatttggtggaatgtcagtttgaagggtcaaatggtgttcaattgtgttgttttttggacagcttggaaatgactcataggccatcatttgtaccaagtttcgtgcaatttgcatatgtggtttgggagatctcagttgagaaccaaaaaggatctgctatttctctgcttgtttgttgatatacctcttgttagttttggtggttgatgttgatgatgtcaagtgtgtaacttgatgttatagctgatgttgcgatgtgcatttagatgttctagtgaagactccatttgtgcccattattgtttataacagaagcttggagtgcatcgttggtcccatggttttttactcctcataccgaagaggttttccacgtaaatcaccgtgtcttgtgtgcatgtgtctattgttgttccactgctgatttgctagttgaaactgtcctcaaagtttatagcaagatgagggttgattgtgtaaaatatgtttgccggttggtaaattatagtttgcacagtgaagtaatttggttcagccccaacaatatttaaatttaaagaagaaaaagggaaaaaaataataaaagaaaggcagtacatcaatagatcctagccgttcgatgcacgcatccagcggctgtaaactgctcgaaacggaaaacagtcgagaggactcatctccactcttctcctttgcttcgaactccggcggctttgcgacggcgccgtcgcgatgggctgcctccgccgcgcgctccgcctaggcctacgccgtgggctctcctcctcctcggcggctccggcggccgcggagcaggctgagctccccc

SEQ ID NO: 61774 - DNA, 529 bp, Oryza sativa
tttttcatcataacaaaacacattcagggcaagctaacaaatatccaacatgatatctattgggacacagaatgatattaaatacaactagcaactaggccaagccaactactcaaatacagtaactattggaacaccaaaactatgttatatagtgttatagaccagagctagtaaaggctttgaaaggtggttggtcccaagtaacttctattagatgaaaaaaatgcaagttacagatcccttcaacagatgaatgatgccactatattggaatgatgaatatacaaaagcaataccttcatggatcccaaaaatactgccatcccctccggaaagttatgcaagctgattcctgcaggctcataataagtatcaaatcagattgttgtagtatctcaaggaacaaggaagcaaagccacacaacatatatcaagaaacagtttgaataatggcctggtgtaagttcaataggaatgcatgtctggttgtatgcttagtgatacagaagtcttattttcttaccaa

SEQ ID NO: 61775 - DNA, 1298 bp, Oryza sativa
gaatgaaatatggactgaggcgacgtagacgctgtgccataataaaaataaatttcaaatttcagtgctgaagttactggaagattgtcgtttacattgcaagtcacctatggcactgcttatcaaaagcataaaagaatgatgacgagtagagagttcagcacgtagaaacacaatagcggtcaagataaatcatctagaaatatagaaatccaactgccatatctgccacaatagctaataataccaatagaaaaaaaaataaaagagtgtggatacaaacattttcaagtatcatctgcgatgcatctaaaatgtctgagatgcttccaatccctccaccgattgagactccctgatacaactccaatcagacaccgcaattcagaaacacataaaaaaaatatatagttcataccaacagcagtttgtaccgttctttccttcttctcatcttctgaaggcaaccaatttgcatctcttaaagcctcatcagctgcacatagagcataggctataaatccggatatagatttattgtcctggaaacaagaaggtcaatcaacagttcaaacatcaaagcatgatacagagtttaaccatatgagctattcagcaccgccattacatgtttacagccatgcaaacaacattctgtcagaatattttggctcctagtaggagaaggaaaaaaatggcagaagtaattctatctacacattttgttccaaactaggacgtgcatatttctataagtatgcaatgaaaatatgagtgggagcacaaattaacaaaaaaaaaaaaggaaaggaaaacattgagaaatcaagacacttgtcactcctggtggcactcaagataaggtcattgccattgtacagcctaccaggaacaacattagtttttgtattatgatgatctatcacattactagcagaaaaatcgtgttggataaagaattatagataacctcaaataggaaaagtggtgctagaggtagtatgggcaatcaatatctatgtacatattggccatgaaatgcggttaaacttatcatcgccacaaaatggggtgaaattatgatgtaaggacagagcaaaagttgcattcctatatatttgcaagacctaaacgttctccaattttagcatccaacaaggcctgaacaaatcactccactcctcagtgcttgaatcccaatgcagcacagaaagcaatctactgcaccaatccaatctcgcattaacaactagtagaagcacattaacaaagcattggaattattagggctaatgaag

SEQ ID NO: 61776 - DNA, 3269 bp, Oryza sativa
  unsure (1)..(3269): unsure at all n locations
atcaaatatttagacacatgcatgaagtattaaatatagacaaaaagaaaaactaattacacagatttgacaatgtgatttgacaatgtgatgctacagtaaacatttgctaatgatggattaattaggcttaataaattcatctcgcagtttacaggcggattctgtaattttattttgttattagaccacgtttaatacttcaaatatgtgtctgtatatctgatgtgacacgacaaaaaatttcactcctacatctaaacacaaccttactcatgttgacaatcttcccagtttacacgcatgtcacatttttgcagagggagaagttggaagtacctaggaaaaagtgttagggtctgtttggataatggaaaatgggggatgggattgggattgggaaataaatgaagggttatgattaaatgaaagagggggaatgaatggttaggatttaaagatgttttttggtgggtggaaaattatttaacatttccattagacaaacattgcctcggggtggtcaaaattacaacaaattcaaaaatacctagtctaaaatgaaataattgaataaatggattgccgaaagttaaatttcggtaataaaagattgccaaagtgtaattcacatcgtaaaatcacactttcctaagcctaaatctgtagtactacgtaaagtaacaaaaaaaaaagttgtactccgtatggattgtgtaattttacttcttttgactttaattttgttgttatatatgacttttatcagtttgaatttttttcatgtattttttttcaaaaattaagaatcataaatttatttcatttaattttataatttttgtatggttaaatatcttgttcaaccatttatatgggaaaaaaggagaagtagtgagataatggcattttggtacttttgaaatatgccaaggatttatagatagtctccgagtgtgtgagatagtagtcatattcttctatttcattttatccacatagtatatttgtttccttccttctatttatcatgaattcgcaactctcaggttaatccattactaaagagcttattcaacttattcatataattgtttactcctacttcaaaaaatacatttattcatttntaagctattggttaaatttattttcaaaagtatttgatttattccttttcgaacggtcaggccgttgccgacgttttatattaagaagaaggtgttccattttaaggagaaaacaggaccaaaccttacagtgtctagttaattaggaaaaactgagcgaaaactacaactacaacaccacatcaatagctaacctaacttacactaccatgacggagcccaacataagacatcggtcaagcttgccatagaggcgacacggcaacccacacatgttatcattgccaagcttaccacccaagcgacacatcagtttcgacttcactgcaatgctaccccaacgccaaataaacaaacaaaaacgacacccatgaaggacatcagcccaaattcctacacacagttagcatcaacaaccctataaggagatcgcggtgtgtgtcatcgttgccaagtttcgtcgcacccctacagcaaagcagctccgactctacccagtagtaaccaaacaaggatgatgaatacctgccacaaagcaagaaatgaaaccaaggcggcaaaggcctcgtcaaacacactaggcttgtagagcttcaaaggcattgcaggagcccaccaatggctaccgttgcacgcggaaggttcttggtgctaagagaagtcaacgccaaaacgacacctccaaggagggaaacgacgcctaatggtgccgtcgttgtcataccggcccatgccctagcaaggctttcgccagtgattcccaatcaaatccctacacaactgtcctgcccaacgaccgttgttggaccaccacgctatcccttcagcgcccctgtgcgtatagtaaagtagataatggtataataaagtagataatccgagacgatagtttgtccaattatctaaatcgaagcatgtgaaccgtattccagcttttgcgtgattgaactccgaaattaggcgaatcatattgatttcagatttgacaggctagctcaaagatgtttattaacgtgtgcttctcgacgccactgtcagccgtttggggtcgagctacaatttgagcaaaggacaccaccggcctttgttgtttaactgacagtattaatacgagttatttaatgcatagatcaagagattacatgcctcccatagttccatcgacagtgatactaactatgagttaacaattgaaccagaaataagggccctttaaatcaaaagatttatgtaaaaattttctaggattctttctatatgatttttttatttggccctttaattcaaaggattgaagcttttcgaatcctatgaaattcatatggtcatgggtagcaccttaggtcttgggtttaactcctcatgggagcaaatttcctaggatttaacggcatcgtgctttcagtggtaggtcaatctccaggatttgtcggccaagtcttcgaagatactcataggggtagcgcttacgtgcgtgcgtttaggttgcgtgcgtttaggagtgaatgtacgtgcgttgtgagtctctaggttatattgcgtaattctaaaaaaaaaaggtaaaaatggagattttgtggtaaataacagaaaatgatgttccctgccgatgtgaccaaaaatacacccatcgacatttcgatgcaccgatatgcttggttttaagttattacaataaatacacctacttaacacccacttaccaagctcatgccatgtgaatgtgatttacttcttttgatagaacaccttttctgattctacatcttttgcaaattacaatacttaacatccacagatttttgtacagtgttatgttcctaaatcctaatcggtcatctacttcaacatctactcgtaaatcctctactactccgtaggctgtagaagttgaaccaattacccgggcggccggcacgttccctaatcgcccgatctaaacaatacacaaaaaagtctcgacccgtttcgccccgaccggtcgccgcgccaccacccactccccctcaaacaccggcggtggtcatgccgcctccgcctcctcctccgccgccgccgccgccgtctcctcctcgccttcctctcaccgcccaccgcctccctctcccgcccgcgacctcgccccccgcctcgctcctc

SEQ ID NO: 61777 - DNA, 2892 bp, Oryza sativa
gggcataattgcctaatcatccaagaaaagagaaagataaacagggaagtaggttttttacatctccaaccactgttgttttactaagatacagaaaagaagttgttattcgtagggccaaaacctatggcatgacacactgccatgacggttcacgaagttcatccaataatttgaaccaccaatttttttattttgaatctactattccccctgttccaaaatatagcaacttagtaatcgattagacatgttgctatattttaggacggggtgacggggggagtatataagaagaacagcatgtttgatacatcaaggcccttgtttttttcttatatctgtagatgaaatatccatgcgaaacttctcctctggtatagagataaacatttcccttaactcgactggaatgtccaaatcttcaaggaccttcaaaataaatagagaagtataggatcagaccttattttccaatgggtgtagaagatgaaaactacagtgaatgcataccttgaaaactccttcaatatttcgaccaccaacaagaaatgttgtacctgtgtttttacattcgagaagtatctctagcattctattgtaatcacctccataatacttaggctgcaacgagtaaacttcattcagtacgagcaacaagtaaagcagttaaactgtctttcagaattcagcaattggcttgaaatattgtgtttagttccatctaacttcttacattaacaagcctagctgcagtgtctgcaccgattacaaatgcactgcctggaaatagctccgctttcttgtaaaagtatggttggttagatattatcacattcttccctgcatcagaaagaagaacaaaaccatcgatcaattggagtttcctacctacagaaaggtagtacattcttatctcaagcatcaagccccccaaaacacaaaatatgtgaaggattattggttagctgaagacagatttcagtaaatagaaaaggagttgttcaggttgtcgcttttcaattattatttcatacaattgattataaaaacaaactgaatcagaaacatgaatttcaaatctataaagacaccccatctgttcgctgttaccaatctaattggtgtatcatatcacattgagactttcattcatggcagtgggtcatacctacttttctaaattgctcaacccggcgcttgatttctgcgatagatagtggaggtttgtcggcattgattgctgatatctcaaagcatggaagaccatcatcacacatgctacaagaagcagatttgtggggaggaaatattagttcttactctcttgaggtcagaacaagcagactaaaagctttatatgtcatgttgtgcactttttatgcacatgcagctcgtggaaccaacgtcacacttatagttttaaaataattgaagcgtcaaaatggagaggggcaatctagtccttgatacagacatacagtatgtatctttatgtgacttgtaatttccagtttaacagagtgccttttcattaaattacttctttgttcatttctattcttgcttcctcgctaatttttaacatgaaaaaaaatccagttgtgaaaatgctatgatctattctcttcagtgttttcacatgataaaatcacaccttgatgcaacttctaacagcctaaggtgtccatcatgcaggggattgaatgaaccaggtagaattattttcctgttgaagtttttatccattgaatctgcaaggaaaaaaagaaatagatttaagagagagaaaaacccaggacggctgcaaactagtattaagagatactacttgtctgctatattttgggatggatgtagtatgatttaagagtgaaaatgaaatattcaagtgtgcacacatagcaacatcgagtgacaaagtataccagaaaagtgatacactttcatgcagacttgcccatcaataacttgctggagttcttggtcttcatcaaattgttccacgctttcttttggaagttcaggttcttgaacatctgactgaatggttgcaggaactttgcagccgtctgcaattgcctgcaacacagtatattcttacaacggagaactaactggaagaataccaattagcaagaaggttggcctatcctgacgggattggttgattgtatagctgaatcatgaccaagtgaaaggtttggtcaattgtactaggttatcatgaagtccaactcaagtgcatgttgccagtgatgacataaatatgtgtgacagtgtgagtacacctagttatacataacaaaccttgagcagaaagtagcttgaaactttatcttcttcctctctgctccgtaaaccctgggtagaaagaccatgttaatgtgatacatcatagctaagtaatgaggttgttatgtttatttctattgttgcactttccaaaaatgtgcatatggtaaaatgtgttagtaataaggcacaccatataatgtgaccaactcataccatttttgcactttcttaaaagaaattctatgttaagattgaaaacaaaggatagcaatacaagtacctttgacaatgtaacatgtgatgtcctgaggcaattttgtgttcgtgttgacacatagaacctattcaaaatcgctaacaaatattataccgtgcattgaagaaatgggaattaaatacatctctgcaaaagcagagaatatggtgtggtataacatgtcttaaagcccatatgtccgactttaacaacaaatgtaaaactactaattttatgtcagcaagtagttcatataaatggcatgtctgcttctgtatgattaatatcatgctatgttgctatttgatgtgcatgccatgtttcactaacttaatctg

SEQ ID NO: 61778 - DNA, 1114 bp, Oryza sativa
catgcttgatatcttcagccagaattatataagaacaatattagtttgatccatcatgcattttatttttctcactaatccttattatataaaaagcattaacattttatgatgaattttagatacaaagagaagtatcatggtaacatcattctgttccatgaactaatcatcagattcaatccatttacctttgccctgagaatacgtcccaaccgttgagcttcttgacgccgtgaaccagcatgagatgaaatttgtatgatcacatttgcttctggaatatcaatcgagttatcacccacctaagtgacagtagatatgcagttaagatgatgatggttgaatctacaaaagtatgttttgaatcagaatatcagttactgcacctttgaaaggaaaattgtattcacatctgagctgttcttgaattgatgcaagaattctcgtcctctcaacatggctgaatgttttcaagcagatataagcatataactaatggacacaaacattctgtataaaatgagaatcaccttgtggaaccataaatcattggtttacggagcttcattgcgtagctagttagtgcaaatagattatcggcaaacacaattatcttgtccccacgttgttgctcatggaatcgaattagaaactcgcaagctctgaatttgtttgggttcatcgcatagaggacctgataggccagggttagtgcaatcctcgaagatgacaagatttgataaacaagcacattgaccaataaattcatgtctggcatgtacaaagcacaagaaaaccaacattttaatgtaagatgatttggttttctcctaagtcaaacttctccaagtttgatcaagtttatatatagaaaaaatgtaataagattcacaatgccaaattaatttcattaaatccacaattgaatataattttataatattatttgtttggtgttgaaaatatagctacgtctttagttatttatgaacttagtcaaacttaaagaagttttgactaataacaatagcaaaacattttacattctaaatggaaggagtatcacaaaaagctatactagaaattggaacatgtggactttatattgcaa

SEQ ID NO: 61779 - DNA, 18063 bp, Oryza sativa
tggatttgcccaatacaaattaatttagtgatgactctaatacaaaattcataccaactgtcaagtgttaacaaacatgattttaactgttgttaacgtacttttatatatggacacatgatgtaaccatgtgatccattctgtgcctcttcgtgaataaataggaaccaaataattataattaaactgtcatgagaaaagccctattctgggtacagtcaaatcttccaatacggaatagtcgctgtacaaaaacctccaatccaaatggggcttcactatgaaacaattctttgggtatttttcacttttttaagcgtttgaacctatgcccatccctgttgcttcattcatttggctgactgctgtgacaattttttgttttgaaatattgttaattttcttttataaatttagtcaaatctaaaaaaattacctcataaaaaagtcaaaaggacttatatgatcaaacgacctaaagtagtagatagcacaattctcaactcaacccagttggcattggcacgaaatgatatctatggatgcgtcaaattattttgatatttgtggagcgatttatttcatatccatcatgtttgatttcctccatcgagctaagcatatatataccgatggagaggatacagcaattatcaggtgatgttatgacatgtacagtacaggtgcagcttaatttaccatcagagagtggaggtgaatgggttcactcacttgacaagccctatgctgaggatgccgaaggaggtgtgcggccaatccttgtccttggccttgatcagcatcgccctgccccatgacacccaagcctcccatggcatcctcttgtcccagctgctcccccactccagcaacagcttcacccctgcctctatctgctcctctgcctcctcatacatctccatgttcagaagcacctgagcaagaaccaggtgaggctctcctacaaacgggttcctgccaatgcaccgtcgcaggatctcctccaccttgcgccaatccgtctcgtcctcgccgccgctgcaaactgcatcccagtagaggtcccgtgccgccttctggtcgtcggcggtgagcacctgggtgcagccattgaacaccggtgggatcaccagctcaatgtcctcgtcacgatcgtcttcttggccattgttgctatgctttcgttgagctatgtgtatctcttcctcgcgaacgatgaggctgtagagcgcgcccatgcgggatatggaggcagtccagaggccgggcttgccggtgcctggccagagcgaagtccaggtattgccactgaactcgaggcggccattggtgttgtcgaagaggcgatcctgccagtcgaagagctggtcgctgaagtccgccattgtcatgagaaggaaggttgccgcgatgcgcctcgacagtgccacatcctcgccagtccttccaattcaaagtacagacaaaaatcaggtgcaatctgatcgaagtatgtagaaccaacttcgaaatgcaactaagtttgtttgctatctatgcatggggttggtttgcctttgcattgtactcatgcactgtagattacagttacttgtggatgatatgatctaaattgtaagttacgttattatcgcagcagtaaacaaactagatactcccatgtttactggatatctccccaaattttattggcactagctgccaacatgagcttatgttcttttgtattgtcaggtataataaacaacagtctgtaaaattgtcaagacatctttctgccaaatcctctgatcgtataaaacatgtatgagaagattaattttgtcatgaattgttaagtgtttttttcctggtaaccaagatgagaacggctagacaacgggattccgtttcaacgggataagtgctgacgtcacctgctccgcatctagcgcttcgtcgctcccaactaccatgtctgaaaccaaagtcgcacatgccgctccacatcaaacatgcgctattccgtgttcccactagtgcaagtgccccagcttgaccggtctacatgcatgggtctcaacgactaggtctcgagagagctgcttagttgggcactttgagttgtgatatattaattgagtttgggcaggcatggccagatgtcttggcagggcaatatgcctcccgagccatggagcgaggcttgtgaaaaataaaaagattttttttgtcttgataatctttgatgatacactattatgtctggtactgagattgactagtgcacgttgggctcccacgatgcctgatttatatatggctcgcaagtaccatgtaccatataagatacatgtatgtatcatacgtgatactcaggtatcaaattatcatacctgatacccgatactaggtatggcacatacgagtaccaggtcagatatatatagataacgggtctgatactcaggaaccggatctggcactagtatcactgtatgaaaattgtttacagcggatgctctccaagcaacagcgtagaagatgatgacatccgacatgcctatgattttcactcgagctgttgtcgtgagatttaaaaacttctaaattctaaattctaaacgtcgaagatgaaattcacacggttttcggttgatgccatggtaaccgtcttgctatgtatgtgtacaccaattttaatacacgaaaatccacacattttcaaccaatccgaatcttcggaaatgcatctaggcaatttaaattcaaattttgaccaaatccttactaaattacgtagaaaatgcttatttttggaagagggcagctaccgtacgagattccgttgcaacgtagcagccacgggataagatctccactaccttgtctccttccctttccctccacaaactctctcacacaggagaagaaaacgagaggcggagatgaagttggccaggaggaaggggtcgtcgtcgtctccggcggccgtggatgacgacggcacggcgtcggcgaggtcggggcggcatcgagggtgatctcgccgcacctccacgacgtcgtcctccgcccgctgcggcgccgcctccgcgcgctgtggcactgcttcttccactggcgctctcgtcgctgccggcgccggggcctctcccctcctccctcgcgctccttgccaaggtcgccgtcgtccttgcccgctgctcccgccgcctccttgccggtgagcgtaggtggctcctcctccgccgctacagaagcagaagaatctggcgatctcggtgtctcggtcactgcaacgccggcggcaacatgctctggaacctctacctcctctccatcctgatacctggtaccttggtatcagtcggtaccaggtacctttggtaccgactgatacctttggtacctggtaccaggctagtacctagtatctggtaccgggtacccgtgatatctagtacctggtggcctggaggaggagagagaggaggaggtagccgcgtggtggagcaggagaaggaggtggcgcgcgaatccggtggtcggcgaggcgaagcgtggaggaggcagcggcgaatccggtggtcggcgaggcggggcagccgatgagaagaccgacgagagcggggagccagagcggcgcggcaagggaggcgagcttgagggcgacccttgccgaggccgcgccgtcgtcgtcctcctcggcggccggggtcctgagccagcagcggcttccccggcgccggcagcggcctccgcgcccccgctcccgctctccctcttgttcacctcacccgtcgccaagctcctcgtcgtcgccgcctcccccgcggcggtggccgccggctccgacgagcggtggggcgacggcgacggggacgacggcggccaccggctccgacgagcggtggggcgacagcgacggggacgacagtggccgctggctccgacgattttggggagaagagtgaggtatgatgaggggatcgattctgattacttatccgtcttcacgggatgtcggtggaatagattttctgaaccaagatatatgctgtgatggactctgtccgattgattcttcaccacacgttctgaatcgaacggttcccataatgaactcatcatctagggtcggagaaaaattaattctcgtaaccccatctggtgctgagcagtagaaattaagaagatttatttattgtaactaattaactaactcacctgatgtgtttgacagtgattccgtggggcgggaggaggcgctggatcttgagccgccaggcctcgccgtcgtggtggaacagcccgcgccgcgcgtcctgcagtgacgcctcggaggcggcgaggtcggcgacgaggtcctggtcggcgtagtggaagagcaggtcgtcgtggatgagctggtggcgcgggacgacgcagaagaggtggacgaggcgctcggcggcggcgccgacgatggggcgcacgtggtcgcgggcgacgtcgggttcgaagatggcgaggttgacgtaggagttggagtaggcggagtggtagaggccgcagcgcgcgacggcgtcgggggcgccccagaggcggaggatgcggtggacgtcgaggaggtgggcgaggaaggtgccgtgcttgtgccagcactcgccggcgccggcggcgcgcagcacggcggccagcttggggagcgccgggtccacctgctcctcctcgccgcgcaggaaggggcgcgccgcgtccagcgcgccggcgaggtgcgaaggcgaaggcataatttggctaggtgcggcagcggcagcgagaggagtgagagtgatcgatcgcgtgaagtggcggttggcaagttgtgcttgtgcacgatgatcaacagtttggtttcgattccggtggaccggattagtgtgtgtggttcacaccaaatctggtaggagcagatcttttatttcctcatctattgggctgtgggccgcatcatccctttcctctgggccgtaatagtaccttttcttgtttgcttgtgattttcatcttcattcttcagtacattacataatccacgctgacgtcttcatttctttgtttgctccttatttctagttcatcatcgcaacatgggatttgcctgcctcacaggaacttaatttgaggcgtagctacataggagtatacagtacagtatttgtttttttccttatcatctcgtcttctcatcatatatcaatcctctacatattcttatggctcagaggtaagtagagtattgcttctttgaaaaaaaaaacagtacatcaacgtccttgttaacgtattcgttttcatctgtaagcatcagcatatccatatttaactctatccaattcaaacatgcacaacagaatatatttggaattggactgtactactactaccaagtactccctccgtttcaaaatgtttgacaccgttgaatttttagcacgtgtttgaccattcatcttatttaaaaaaaattgtgaaatatgtaaaactatatgtgtacatgaaagtatatttaacaatgaatcaaatgatatgaaaagaataaataattacttaaattttttgaataagacgaatggttaaacacgtgctaaaaagtcaacggtgccaaatattttaaaacggagggagtactaagaaattgcagaatgggtcatgactacatacatggtcacataaaaacagtattcagtcggcctcaacatacatttctttctcagagtctccaacaacctcctccaacctttcagataggactgaattggagcaatctgacacgtgttgaagcctgattaattggacgagtaacaaactaatcagtaaattgatatgacgtactagtacattttgccttgctatcctttactacttgattggatgatgattgccaatcttagttcctctaatctcaagttacaagttggttagcttctgtcaagcttctcctcttgcaaccgatggtttcacaattaaggaaaggagctgagattcttaaatatctgtgaagtgtactgacatccactcaaaaggaaaattcttggtctatcatagcatgacttgaagcgtctccaaacggctggattaccagatcttatccagattagggatgaactaaaccttatcagaatgacactagctgtattgtagtgtgagaattaaatactcctgcacattatcattgttgcactggtgacttacagcaaccgttgctactccaaaatccagtgggcagaggttattatgctatgctacaaactacaatccgaggtgtgtgtttgccttctccagaaagccatgattctcacttgagttttcttttttcgccgggccagagaatagccggccaatgtatattaagagtaagaaaagaaatgtacaaggtagcgcgatgagtcaatgcaccaccattacagacataaaaagaaagctaaaatctcacagaatgagttgctacagagtgacacatggggctaacaagacctgcagctatccaagtctcccattcatcccccatggcggaacaaagatggagaatcgttgcctcgatcccttcgaacacccttgcgtttcgctctttccaaatcaaccaggttacaaggatcacccccgcatcgaacgttttgcggtcaaccttagcaacagatttccgggctgcaagccaccaatcagcaaaatcagccgacggcgaggagcacgaaaggcccagacgtgtgcgcacccgaccccaaacctgttttcagtttcactgaagagtacagcacgtagtattgtgttttgcaaggaaggaacaagcctttaatttttgcaaaattacattgacccggtaggagtgggcgtaaattcttatttgtaaaacgaaaatggtgtgaagagtgggacccacaggtcagcctcatctgctttccctccccttgctctcttctttaaaaccgggaaagccctttcacgtttcggcgccatttcgccttcttcttcacctgggtttcgcccccataaggccggtaagcgactcctccaactccatatctagcggccaatggatttgaacttgtcgtgcttgattcccttctcttctttaatttcgctcgtccaatcccactcgatcggttttcttcactgattctttaattactccgaatcgtctcctgcccagtttttatgcggttccttcaaatattcctgaatatctccgagggcagacgcaaaaatcgatttctttgtgaccaataatagaagctgattggttctggatacagtcaaactgtccgttctaactgaaggttgactttgcaatcaggtgctaacagtttctttttattgttattattactgagaaatggaaaagtgtgagaaaaaataataaaattttcatgaatgattcatgcaaggggagaaaaagtgcgaattctagttgcaagatcgatcgttgacgtgtcgtggtagggcatgtgagcttgcagccagtactttggttgtttgatgtcgatgtgatgctcgtgactcacttaattgcttccctctcttggttggcacttaataattcactaaatcaccacagtttaattagctagcatattcagtttctttctttcttctacctcccccccatttcgctttgcaccattcatcgatctgctctctgcaagacgtggcaccttcctccttgtgttctctgacttggtaatttccatctttaaattggtcttttgtctttgagattatcatttgtaactgattaacctatgcattcgtttgcatcctagaactagctagcttctcaattcttgccagattgttattgcttgctagtgcttacaattcaatcaatcgctgcctgccatttttttagtttttattgaaagcaacactacctttcttttgctaccttattataaatgcttgtatgtatgtttgtttgtttgtttgtacacgtcttacctttcttcagtttgttaccacttctgattattattcatgtccttgcatgtagttcagctataggttgtgttcattctaactgaattcacggacagatcaagctgcaaacttgcaggagatgggatgcttcaattccaagccaaacgacaccggtgcgatcagaagaagacccgggagcataggcgaggtggctgtgttcgtgcctggattgagagtacccgagagctcggatgagctgccccttcagccgctaggtgatggcctcccaaggaggctcaccgaacgcctggccgcgttgaggaatcggataattgtcatggctgctcatgaggcactgtacatgaccaagcccacctggaggatcaccatcactcagcatggttcatccttttatggctcatcatctgatgacaagaagaataatgtcagaggtgatgaactaactgtctgaatttggtgcttgcaggggggtctaagtcagctgatcttctgcaagctttggaggattacttgcccactcttcttggcctagtaaaagatggtaaaactcctcatgtatgcttttcttccttctctttgctctttgatgaaatccaggaaatttaactgtcagtactcctggttcttcaattcttttgcagggagcgagttggaagataaggtacagtttgcatggatgaaccaagaggatgacgcagaggtctacatgctgttatgcgtactgtttgattttctgtggcaagtaagagtgatacgactgtgattaatcgtctacttatttgtgttgtgtaggatacgtcaatgcccagtgcttggtatgaggtgctatcagttctacacttgatggctctgctgcgtttgtcccaagcaaattcccttcttgttccaaagacatccattgagggataccatgctaaggtatctgaaggtctgtaccatgatcaccattgattcctcgctgatgcagaattagtacttgttacttctgaattttgaagtagtacttgttacttctgaattttcgatgatgttccttacttctcagctgttgtccgttgcagcattttgactgttctgtgtttcccttttttacttttcagaaaacaaacgagcttcagtggagatatttctcaaggcagccggatacttggagtgtgcaatccagcatgttctacctaagatatcgccggagaaaaggtggtgtgtttgatgaacaatgttgcgttctgtagttagtgcaggtcggacaggagttattgttgctgactgccatttcgtgtaggaaaggtcttcctgtggacttagctgaaggaatcctgaaagctatctgcatgcaagccctgggtcaagtaaagcgtttctccatctgcttccttttattttatttttttgggtgaatctttctttcaaatcaaatagctagaaatcacatgactcatgtaaatagcagttgaaatgtccatttctaagcccaatcgtcataattttactagtataagtcaaatgccatggctttgcgtacatgctatagttttgtggcttttacttatgtctgaagaacatcatcctgacaaaatgtccatgtcacgcggcttggtgtactgtcaggcaattgatgttcagcttggattggcaattgacagtccaaaggctaccttggcagtgaagaggaggctggcatgtgagatggtcaagtgctggcagcaggtagtacttgttttccatatcagtgctatatctgaagtagtctgttcttaagtaatgctgttattgactaagtagtaactgacaaaggcacgtgtaacacttggaagcagcttcaattgttatttgcctcatctttgttaatcttgaattgatactcctggatattcatcattatggcctcactgtgaggcactgaggctatagggattattgctactaatgatgttcaacctctgctgagatcttagtctgggttttacctgttcctcaactgaactctgaacattgtctgaacgtagctttgcagtcagtaagcaaatgtttgagttcagaaactactcctagcagcctatgaggagtcacaaatcaaacgataaatgctcctgcagtttagtttgataaatagagaatcaatattcttttctgtataatctctttcatttgatctgttcaatctttcttgtgtactatttcattttcaggcacatgaaagcatttcggacctacctctgcttgatggctgggcagaaaagcacaggctctttgttacatggaaacacatcgaagcaaaagtatgtaaaacttctttcatattctgaaacattaatactacaacgaatgatgctgtaagcacaaacaaattaatggctgtcctatacaaattaacaagaagtacattaacacatagtgtagttgtgtaaagataatttagtcatgttgcaaaaaggacggttttgttgtgagtgtgttaatttcatactccatttacactatgataaaatctatctataactgaagagaaacatatgtggatcctcctgctacaaacaggctgcggcatactactaccatggactaatccttgatgaaggaaacagtgagaaatctcataggacggcggtggcagcgctgcaatcagcggaggagttgctcaaagagagcaaagctgcatgtgaagccttccatgcggcatctcctgtttcaaggcgtgcattccattcttttcagatgtagtgttatctgcagtgagctagcttaagaatctctaagatttctgaattttggtacctgcatgcatgtgaataataatgcagaagcccgccgctgtggggatcgatgaggtatcttcaggagaagatacacaaggagtcgtcgtgcaaagttcggatcaacaaggacctctacaacaaggacaacatcatcatccatgaccatgctgacagcgcgccgccgctgccggacttcgccgtggctctcaaacccgacgagtatcgccttcctcccccactcactgacaccaattaaggatcgagtcgacaagggagaaattattaaggtccaaggcatcatgcagatgcagaggaggaagaatcaatcaaataaaatctattatgtatattcattcatattgtgccatgtatgtatgcatgggtgtcacaccgcaccacatgttgcaagaaaaatgaaagagaagctagttactactacctccatacatatatgtatgacattgactagtataaatttgaactagccaacatcatataaaaaaacctggagggagtactagctagctagctaggaaaaaaaattaaaatttttataaaagaaatctcaaataatgtgtatcttgtgtagctgctctggccgaatctcgtagttattagaattactagtctagaaatgtcatacttattattatatcatggaaaaaacaaatactccactcgaacacaggtccagatatccggtgttgtggttgagggatatgaatcagattcggccactagttaagggagacaaagtgaacttttattcgggcaggccggacttgcattgatgtgatgggccagcggcccatactgaaagtgaaggagccgccacgtctgacttttctttcttctctctctctctctctctgcgtccgtccctccctcgcttgacttctctctccgcgtcacttctcttccacctcttgtagtagctgcttctcctcccgatcgagcagaggcagtagtagcttagctagcagatatatactgtagcgatggagtaatatgatcgtcgatcgagccgatccgcgcgatgcagattcgccacgccctcgtcacctcattaccctgggtaacaatcgatcctttttttcttttcttttttgcataatattacgcctttttgcgcttcgattaaattgctagtgcctgtagaccttgtcccttcatatgcctgactgactgactccaacaggcgtgaattcaatggataaagacagtgaattttgattagaattagtgtgtttgtatatgctgctcgttctccctccccgtttagttaatctgtttgttgtttggcactgacagggatggttatcagctcggcattgatgatatggaagggattgattatcatgacagggagtgagtcgccactagttgtggttctatctgaaagcatggagcttggatttgaaagggtctgtttattttccttcctccatcccatggcatgaattcactactaatcactctaccattttcttcaaactgttgtcatctatatgtcctagcttgtgattcacctgatcaatgttagtgtgtttgcttgcctggcagggggatatcctgtttttgcaaatgagcaaacaccctatacgaacaggagatatagttgttttcaatgatgtaagtccctactgaattgtcactggtttatcgatcaccataaaaatattttctgaatcatcaacaaagcagccctttctccaaccttgttttaatgatgctaatacacgtgcatcatttgcaaggcactaattaacttattgcgatttgcctctttgatttgtagggccgtgaaattccaatcgtccatcgcgttattgaggtcgttaagctttgtaatatccacaccaatcagtctccccttacatttgatctcaggtattatgtctgaaaattttccttgttaattatattatatctccttgtaggttcacgaacgacgggataatgcacaagttgatttcctcacaaaaggtatacttacacttattactattttctatcagtggttttgacctcctaattttgttccttgcatattaattaagtaatctgaatcatatatatctgttggctcaagtgatgagcatgaattaatttgtactgtgaatagcgctgcgttatactgatcgatgaactgtctcattatcaggtgacaacaatcctatggacgaccgaattctttacacacatgggcagctttggcttcagcaacatcacatcatgggacgggccatagggtaaaaatactttcaccttggcttaattgtctactggagtagtacttgtgaatttgtgttttggtgatgggctgattaatatactgttcttctgtaatgttaacaggtatctacccaaagctgggtgggtgacattggtgatgactgagaaaccagttattaaggtatgcacatttacccttattatattactggtctatatagctataagcatatactagtgttgcaagagtcctactgtgagctttgcatcggtgcaaagaagttaattagttcgtgttttgtctgaaatgtgttgtttacctgctgatcgatgcgctggggctgctgctcatcacatcaagctagtacaacaaattggtcggaacatgtttctaacactcagggaattggaggaaagcattggtttttggaaggctaaaaaaaccagcagcatacttgtgtttagaggagtattaattagctactcctacagtattgtaatgtcgagggattttgcatattcttccgcccggacggttgggttcagaatgctatccaaaacttgtttaacaatgcgggatgcatacggaacctcacttagcttttacaactttctcgtttatcataaattcgcttaccaaactattaaatattctgtaaatatttttatattaaaaaaatttaaaataaacttatttttcaagtttatagctagtacactaatcatgttttttttttcattttgtgtacggcaaaaagcaaagcttccgagcatagactaaggccttgtttgtttcaatttaacattactgtaatccagattattgtaatctttaacgacttgggaaaaaaaattcaacaacaactttgaaataaaatttcccttgcaatctggaccgttcagtctgtggatcagacggcaaggcagatacactcgtcgtcatcggctgctactagtagtagcaccttgagtaagaggtgattcccgctgatggcgccgcctcccgccggcgtggaggccgtctgcgccgccgtcatcaaatccacgctaacccaaccccacaaccaccaccacctgctcgcggcctcgccctccctcctcgccgccgtcctccaccgcctctccccgctcccctccaccgcgctcgccttcttccgctccctgcctccgccccacccgctcgacgcctccctcgccctcctccgcctcctcgccccccacccgcgccaccaccccaccgtccgctccctcctccgcgacctctccctccgccacccgctctcctccccgctcctcctcccttccctcctcgccgacccccacctccccagctggctcctcctcctctctcccagtccgcccgcccgcacgacgccctccgcgtcttcgaccacatgcgcgcgcgcgaggtcgtccccgacgcgcatgcctcctccgcgctcctcaccgcgctcgcgaagtcccggatgacggccaccgcgcgcaaggtgttcgaccaaatgacgcgggccggggttgccatgaacacccacgtgtacaacgccatgctgcacgtctgcttgaaggccggggacgccgcgctcgctgagtctctgatgacgcggatggacgccgccggtgtgccgctcgataggttctccttcaacaccgtcatcgcgctctactgcaggaagggcatgcagtacgaggccatgtgcgtacgggagcggatggagaatcagggtgtcaaggctgacgtcgtcacatggaactcattgatccatggcttgtgtaaggagcgcagggtgaaggaggcgagtcagctgctgagagagatggcgatggcaggggtggcaccggaccatgtcacatacaccacgcttgtgatgggtactgtcgagcaggcgacttggaggaggcggtcaagctgcgaggggagatggaggcaatggggatgctaccaggtgtcgcgacatacaatgcgattctcaggaagctctgtgaagatggcaagatgaaggaggtcaatgtgttacttaatgagatggatgagaggaaggtgcaggctgatcatgtaacgtgcaacacgctgatcaacgcatactgcaagagaggggacatgacctcagcgctcaaggtgaaaagaaggatgatggagtcagggctacagttggatcagttcacttacaaggctctcgtccatggtttctgtaaggccaaggagctggatgaagccaaggaagccttgtttgagatgatgggtgcaggtactacaaatctaactaaaatttatggctctgattggtagcgatagtacatcatcaagacttaataatgcatattgagagatcctttttgttataatagaaaagcatgcagcatctttgactctgttttatcagttatcaatccatatcagtattttctaatgatgtttggtatatcttgtgttttttccccttgtacgcaggattttcacccaattatagtgtgttgtcatggattgtcgatggtttatgcaacaagaataatgcagttgcagttctagccattcctgatgaacttatgaaaagaggatttccaccagataaagcagtatataggtctctgatccgaaggctatgcaagaaagggtttattgatcttgctgggaatgtgttcaatgaaatgcaaggcaaaggtctagaagctgactgtcttgtgtatgctacacttgcgtgtgcatatctgactgctgggaagccagttgctgctttggatatcttgaatgagatggcgaagaagcagttgtacataacaccccagatttacaactgtatgtgtacctcttatgctgatgagaagggatcgcttaatatgctctgggttcatgccattgagagaggcctaatcacaaagagcgtatacaaagtgatgcaccaagcaagaatgaaatcttcaaatcctgcagtctagaatgcgaggaggggaatgctcatatttcagggatgaacttttcagagactgtgaattgagagtgggctatagaaatagtcttgcactttggtcttttgatgtcgatgatgctcgtgagtcacttaattggttccctctgttggctggcacttaatttactaaatcatagcaattagttagcacaagcagtttctttcttgtaccttccacatgtccctttgcatcattgatttctgctgtctgcaagaggtggcaccttgtgttctctggcttggtaaattcccatctctattccctttcatcctgcccggaacagagtggaggcgtgatgtttgtgatatgtaggtagggcagattgctagtgcttacatttcaatggcctgcctgccatttcttttagttttattggaaggaactctatctttctttatcaccttaattatcaatgcttgcattgcatgtacgcctgtatacatattagttcagttttctatgtctgattgattcttcagcccaccaatcattcaggtttttgtccaatgctattctgctttaaattgatgtttctttttctgaattcacagacaaatcaagctgcaaatttgcaggtgatggggtgcttcaattccaaaccaaacaatgccggtgcgatcagaagaagacatgggagggtagaagtggatgtttgcgcctggattatgagttcctgaggctcagaggagctgcgtcgaggacttggataattttcatggctactcgctactcatgagcactactcctgactaggcccaggaggcgcacgatcactcttcatggttcattcatggcacatctgctaaattgattatcaagaagaataatggcagaggtgatgaactaactgtctgaattcagtgttttttttttcgccgggaaggctgaaggagaccatccgagtatattaagaaggagtaaaagttacaagaaaaacaccacaactgaattcagtgcttgctggactgctgatcttctgcaggctttggaggattatttgcctctgctcttctcagcctagtcaaagatgataacctgatttccccttctttttaattggtctgaatgaaatccaggagatttgtgtcagtcgaggttgaattcttttacagggagcgagttggaagatagtacaattttgcatttatgaacgaagaggatgatgcagaggtccgcgtgcacctatattgttgcatgtggtgtaggacaataggagtgatactgtactgtgtttgatcatctatttgtcttgtgtaccgtcaatgcccagtgcttagaatgagatgctacctgttgtcttggacacgtgacggctatgctgcattcgtccgaagcaatttttgtgcgtcttcctaagacatgtattgagggataccatgctaatataaggtatctgagggtctggagcaatatgtaagcatatgagatacagataattagactctgaaactttgtgtttgtattccatgataagtttgctgctgtgatatcaactgccctctaaattggaactgttagtttgccggaataagttcaccggaggtccctcaatttaacagcgagattttttgaggtcccttaaccacaaaaccagaaatgtgtacccctaaactcattcaaactgttcaccggaggtctctcggcagtatttttgcccggttttactgacgtggcatcctagtcagcaaaaaaaatttaaaaacacatggggcccacatgtcagcttcacatctttttttctcctcttttcttctccttctctcctcttctcttttcttttctctctcttctcttctccttcaggctgcgggcggagcagccgcgcgccgtggccgccgccgtcgtcggctctccaccgtcgtcgtcgccgtgggcgaggctatgcggcgcggccgtccggtggcggagcggaggcagcggagcgcggcggcggagcggaggcagcaggcggagtggcgagcacggatgcaggcggcgcagcggagggcgagcgcggcaacagagcagcggaaggcgcgagcgcggcggtgggccgagcagtggagcgcaagcaggccgcggacagagtagcggagcgcgagcgcggcggtggagcggcggcgagcgagcgcggtggccagcgagtttaggagggagggggaggcagccgacaaccaagaaacaatcg

SEQ ID NO: 61780 - DNA, 3912 bp, Oryza sativa
aagctcctcgtcccatccactgtcttccgcttcgctagctcgccctccgctgctttgcccaccgctgcgctcgcccgccgccgctcctccgccgcgctcgccttccgctgcaccccccgcatccgcgctcctccactgcacgtaatggcatatatacatgtgagtgtgctcagccatatacacatgcttggttaatatatacgtctgcatgttatcgggcggcaaaccaacaagaagctagctaggctatagctggtcgtctccatgcatgcatatatatgctcgtacgaagacgcatgtacatgcggccatctgtacccggtgtatatgcgtatgagctacgacgtcaagtgctaccgcgacgtcggcgaagacgacgagggtcaccgcgcccgcgccgaccaccgtccacgacgccgatggcacgccgagcgtggacacgctcctgctgcagctgcgcgagctgggcgtccgggagggccatgggatcaggccggcgacgctgccgccgccaccactgtcgcggcgtcagctggcacttcgagccacctatgcacggccactgcgacgcctggccgatgccgccgaacggccgcgccgtgtagcctcgcccatggcgacgacgacggcggccacggcgcgcggctgctccgcccgtagcctccgctccgccgccgggctcgcccgccgtccgctccgcccacagcccgccaccgctctgctgccgcgctcggccatcgcgactgcgcccgccgccagcctgaaggagaagagagaggagagaagagaaaagagaagaaagggagaagaaaagagaagaaaaaatatgtgcagctgacatgtgggccccacgtaccttttattttttttttgctgagtaggatgccacgtcagcaaaactgggcaaaaatactgccgagggacctccggtgaacggtttgagtaagtttaggggtagacatttctggttttgtggttaagggacctcaaaaaatctcgctgttaagttcctccggtgaacttattcctagtttgccaccgctcgctgggattgctcttcttggattattattattgggccttgagtttttgtacagacgggctgctctccgacggcccacctggttatcaatcagtacggccgggccaaccaatgtgcttcccgacggcgacggctgcgaagaggataagcaaagcagcaagagtgagctgctgctgctcagctcggcgatgagatgatgccaccaccagttcaaaccctacgcctcctcctcctcacccctttcccgccacctcctcgcctccgcttccaccgccttacggccacagggaggtccgacaatgccgccgcggcgtccggcaccacggcgagggagcgccgcctcgccaaggtgcgggaggagcgccgccgccgtcagcacgagctcgacaacacctatcccggctgggcaaggcactgtccttttaccctctacatactctgctcctggatctggattcgcctcccttccctgctcactcaaatccatcttctgcatcatcatcaccatcatccatacagatagatacagtagatttgtgggctggtgctaatgctgcctgctgtgcaaatgcagggttctggagaatgcctgcagggacgacgacgaactccgcgccattctcggtgatagcatcgggaacccagagctcatgaagcaaagggtggttccctaatttatttgagctttctttctcgccacttcaaacttctcttctagtaatacttacttgtacatttacttgtgtgcacgggtggcagatccaagaaagggtacgcaagaaaggcagggcacaattcaacaaatccaagacagggtctattgttgcattcaaagtcagctttcgagagtgagtttcaattccacctaagatttaatgactgataaaaccttcaatgtcatagttgagcatcatctagattttctcttctttttttttctcagtttgatacgatgatacgactttggactattaatacactaactcagtagctaaattgatatcatactcctctgtgtatgcatattagttccactgactgaatgccacttatctttctatctttgcagcttcaacccactaaattcattcatttggtttgaactctttggagaaccaacggatcgagatgttgatctgcttggcggtgtaaagtgacattgtatttctgttcctttggattctcattattcagaaagaaatcaccctgtcttgacatcaacatcatttatattctgcaggtgattcaggcttggtatgtcatggggagattaggagcttacaactcttcaaatttgcaggttggacttgttcaagtgttggaaactacaatgattacattatttttttatgactcgtcacctacgtagggagaaaacaaaacatctcatctttttatttcttgaaaattcctacgtcaaccatcatattgcctaattaaccaacaatgcgtcatatctaagatacaccttctgggtttcattgccaaagcatggaaacatgaaattaattattcacgtgtcatatgtgccttccgaattttgtggaattgtatgcactattgtaatttgtgaaccatcttcttttgatgaaacttgtgaatcttctttacatggctagctttggacttaacttatgttgccaactcatggtcacatagtctaagttaatagcttagctggcttccttaccagtcatttttgtataatgagccattagtaaactgtaaacatgcctttttggtgctacctttttatcaactgcttacacaattatgtaacactggtgtgttatctatgcaagctgacttgcaattttgtctatttcaatttcagctggccaattcaatgctggactatgacccttcatatgattctgatcaagcttctggtgtgatgccttcatctttccatgatatcagtgatgtcgaattccaagacaattggggcagagtttggtgaggattggaaacatttatagtctggaaattgtgttatgggttctacagtactgaaaatgcactcttcattcagggtggatcttggaacatcggattatcttggattggatgtattactcaactgtcttacacaattaagctcagagtaagtcatctttctctataccttatacaaaacagtagcagctatagcttcaaatctgatcctatagtctttagttcaattgtgattgtggagataaatctgatcctatagtctttagttcaattgcggagagaaaatgaaacgttatctgaattgtgagagtaatataccactgtagaaatttctggcactctgcaaacatgtcagtttgtcacatgcctgtttctgaatatgtcacagatcagtcctaatatgtagttcatcgcccatcacgtacattatgagttacttttttgtattcaaaatgtttgtgcattgtaattagcttttgctgtgattgtggctttgacaaaaatttcaggcacttgggcatcaaacaagtggtatttggtggcaaaaaaatgggcgactgggaagaggggatgaagaactctgattacggatacaggcatttcaagatatagctgtaccgaggagtgatatgcaatggtcatgtgagggaggccttcatatgtactccaggcctctggggattctccggcctatagtggcaagacttttcacttgaagcagagaaattttttggacgactgaccaagattagtgtgcctagattgatcttgtgctcgtgtgtgtaaataattttaattttcctctaggttgtattagaactgaatccaacaatccagtaaaatgtattgtagcaattatatcaaacagttacaaaatcatgagcaattactgactgtactcctcgaatgacctg

SEQ ID NO: 61781 - DNA, 7021 bp, Oryza sativa
catgtaggttggaagagaagtaacaagctcagaagaggatgggatgtgttcactaccttgaatctgttaccgataagcgagccaatgtgactgttggtaattttcctatcaccaatagaagattcgatgtcccactctaaatcaggcattgatgtaaatccgtaccagagttgatcagaaggaggaggtttcacatgcacacgcaggacacctcgaacagatgaaatttttatcgccagagagagcggcacctgtgcaagaagatcttaagatcactggtgaaatattcatattgttttaaagagaaatctccataactttaagcttctaaaataagtttgatgtacgatttcactggcagagatgtaccaaggctaatgttacagtttttaagagcaacttatcaaatacagagatgacctgagatgtgctcagaaacatgtaacacgtaggaaagagatgcatgaaggccaaaaggagaggtgtaaacctgtgagacatgatctgctatggaatgcatgatatttttccaccctgatatataggccgatgtccatccagtgctcttgggctgactaccatctgatacaaaagatcacacaaggtctggatcactaaacatatcttgattcttgatgcatcagaggactgggcaaccttctaaccataattgtaataaagcttacatcaagtcagtacaagcatacataagcaaaacaggaaaacaacaagctgatcatgccagcggtagatcataactaattggattctttttactcttaattgtaatgcagtcattggtaggacaatcataaacagttactcaaagaaacaaatgaaataaacaagaaaacacatatatgaaattgaagcatacctggttcacctttttcttcaactgaggaaactgaattttgggaatctcgaaattggttaccgtattgttcaatactctcaagaagatctgattcaacctctccatttgagtctgtaccaaagttacttttcattatgtccttctgtaactctggttcctgaacctcgagtcttgtttcaatgtgcagtagtattccactagaatattcaaaatcaacttcaaaagcccataactcattcaaatccagtggaaggactctcatcgcgtgtacataaggtggaagctttccaaggctgaagtcagcaagtgtgatgtcaccaacataaggtggggtcctcatgcttgataacgttcgctaacaaaataaaattcaactaattaacaagtacagacaagagcaggttactttgtaaacataagcagtatatctaacctgaatgcgtgctttgatggccttgtgtatctcatcgctcattttagcatcaaaaaacaaccgtgaagataaaaggttccaacaaagtgtaccttcatctgctattctatcatcggcatttacatcagggaaagctgaaggttgtccaatttgacccagagcaggagacgttggactgggtttcactgtatcttgtgatgaactgctattggacttgtcatcttgtgaacccattaatccttcaataaacggtgtgccctgatagctgcgtaatttatccaatatctttctttctccttgtgtagatgatccggaacttgtcttaccctctaacggaacctttgtagatgccttctttgccagctttttgagaaagagacggaccttggaagacccatcagtctttattgccctgtccataacctcatggtcctcactagaaaatactgtaggctttaggaaacctgggtattcagaatttaatgatgatatgtaattattgaactcctcgctcagcttggcatgccaattctttttctccttgtcagcagtagctgcaagacgaagtgctttacaccatgattccttctcccaggaagtttcagcataaagatagcataccttgcttccattataaatttgatattccttgctttccagtttaataggataccttttagccctgaaagttaagcaaaggtactaaagttacacatagagtgaagtatacgagcaaaaaaaaaaccctagtagcagaagtaaaacagctgaatgaaaggagcagaacagaaagctgcttggcaagtacttctaactgtcttctaaagaagtacattccgtctctataggagttccttcaagaaataaaatccatataagctggctccaacatgtacaaatacatgatttaccttcaaacaaaagcatttctacatgcctctgaaattttatttggcaaatcgcgacacaaggttaaacttgactgtaaattcacaatgtgtacaactggaaactggataggggtaaaaaaaagatgagctcatgatgaaaagtatcattttctcctgcaccaaatactgaccatttgcgagagggcatacttgatgctgaaacagcaaatactgtgcaattcagaagcttaatggttgtgtggaagccatcaggaccagacaaaataagtgaacgccccttgattttagccgacctctttgcaggaaaaacctccacaatattctttttttcctttgtttctttagggcctccaatcgatgagcgttcattactagctttaggtgtcttttctggctctagtatccacagaaagccctgtaaacatacagcatctattttaagcaggatcatccttagtaactaaaaaacatggaggctctaaagaggaatctaaatgaaatgttattgcaaatatagtatgccaaagcaatttggatgagctctggattgcaatggtatttaagccattttatccaaaatgcaagtatattttccttgaaccatattgttcaacctttataagctcaatgttgagtacccatgatgtaaaacagaactagcataaagatgcagtgcaaaaatatgtaaaaacaaggaacatcatggtgaaaggaagttacaggaaaaaaaacgttgcattcatgaaaatataaccaggtcgtatgtatattggtcagtggtgaacatgtatcagctgtgataattggaaccaaaaggaaacgattatgtttaggtctcttcagcatgtaacctactagttcatccatagagaattcattaagcttagttgtggagtctactacatgtacaagtacaacacttgtgatgaagatgagaacatgtaggtgtttccgcacaggagaacaatatacactgagatgagcaggtgtatgagctgggcatgccaatggatagaatcatgggccaaaaactaagtagaggtcaatgccaggagcaaattagaatttgaaataaaaaaaaggccaggaacttaagaagtaaacatatatggcatgcatgaaccctaggagcaatttgcttggataacaaaaggggaacataaaattttgcgatgaataaccagaataacagaacccaatcactgatattagtatttggaacaactgaacgatccaggatgtacaaaaattgcggtctgaacacaaaggcatgtcgattctctagttgaagtgcagcaattggggaaaaagaaaccttgttagcatatgaatgcacagtagtagcattttgctcctcccaagtaagtaattagcagtggaagcaagctgcaactatttcatagtaagataaaaaaaaacaggagatcgaatcgagaggtgatccctagctccaaagctgcagaagcagttactgttactagtattccagcgcgccgcattcgccctatcccctatcccctatccccgaggagggtaatcgaagcgagaggtacgtgagtggaagcagcctgacctgcttctcgtacgggaaggggcgttcgccggggagctcgtcggcgtccggcgcgggctgcggggcagagtcccggcggcggaggcggcggacgagccagaggagcgcggcggcctcgagcgccgccagagccaggaggccgaggaggaatcccagcaggaaggcgagggccatggcctcgccgccgaagacgtacggcgacggcgacggcgacggtgagcgacgtggaggttgaggacctggttgtaaataatttgtaggagtgggagggaccggaatgtaaagagacaaggttggggtgggggggaacccgatacgcaagacgcaaggatggcgcggtcgctggttgggtcgtctcgtctcgtctactttacacgatggcgcgtgggtcccacgcggtgtctctgcggtgggtgggacccacttgtcggtgcccccatcactgcaccttttcttttttctttgagtggttcgttcgcttcgttgcttcacgccacgcgttgggttgggtttgaattcttcgtctttgcttgctgctgcaatcatactactagtacagtatttgcttcaaacgtccgaattaattaaattaggctactaatttgggaaaaaaaatagagaggacaagagttcctagctacctataaattaaatacttccacggataaaaaaaaagttaatgtttagaacaagattcaatcactcttaatgggcgggttcggttgtaagaacagtgaagcaagcaaaaaaaaaaaaggcagcggctgcaagcaggcccaatattacaaccagcttatattagaacaagttataaaacctagtaacaactcatatacatttcaaagtaattatcttcatgtcatcccttttgtttcaaattaaacatttgaaaaattatcaatgaatggaattttataagtaaccgaatcttattccaaatgttgaatattatcaaccgaatgggatagtccatattttcacgtgtttttcatagacgacgtggagggctactttatttgagattttctctcatccttggagagaagggaaaaaaaagcaatttacactctcatttctcatttacatccaatttatctttccagctctattgtcgatctttttccctgtcaagtcattaccagcaacaattcctacgtagttcgtacctgttcataattctatgaagatagagtgatgtagtctactccctccgtcctataaaatacgaatctagacatacgtttgtctagatttatagtactagaatgtgtcacatccggtactatatttgttttttatgggacggaaggagtacaacatacttgctgttgatgaaaaaaaaaaagtcctttaaattcagtatagctcgcaaggtgactgacaaaacaatttcctccatcctagtttggccttcttctagcaccaccggaggctgagtatcgagtataattaagcttaagcaacaagcgtcaggttcagaatgcagattgccggcagtgagacgtgaagaagatgaagtcaggatggtaagctcgcagctgcttgagccaagaagacgctgcccagaagagatcagagctcctcgacgatgtccacagcttcccttccgctctgtacgtcgccagcccaaacggcgaaacaccaacaacgctcctcccctcctcaacattatctgcaaattagcccatgcatttccatcatcaacatcgatctaattacactgtcagtaatgcacatatcacagccacaagattaacgaattgatgttatataggagtatgtaatatgtggatggattacgtaccttggaaaactgaggagagggaatgataggttaggaaacacgtagataaccccttgaggtttccacgagctgggatatgataaatcgggtacctgaatgcatgcagattattgttgacaagattagttgagttcaagtcaagcatctcaacaagctgttcctttgtttagttttctgaatatacattagatgtaatgtgcaattatgtatgcatttgaacctctagcttcagagcaataatttaacaatcaaagaagtgaaaatgatgtgtaaattcaagtaccatgctacagacatccagctcgaaggtgaaagttgtgcactgctgagagatgtcaagcatggataatgctgagccagctctgccacctaatcaataacacaacgtatgcaacaccaaacttaattagagtactaatgtggtaagttatttgcattgatcacattgaagactgaaacaaaactagtaaccttatctgctagcgggactctctcgtagggcgagctccactcgttgtactgaaaattcaggcagccggcaccttgctttgcagaaaccgattcagagctatcatggcttgagtcgtcgtcatcagacatagcagcatcccatgatcttgataacttgtcgcctgtactatcatcactccaagaatcactctcgctccctgcgctgcctctgtatgatttcatcgaatggcattagttcgatcagatcggaaacaattaataggccaaagaggattaagggtttgcagtaaagtaaaacaatgtacaggtaggttgcatacagctacaagagacatgagattgagaggtagagagagtagcaacgaacctggagaaagcaaggagagacttggtggaggtgtatatctgaatggcagataagtagggaacaaaatgttgggtgatggtgttgccggattcaagacggacaggaacagcaaggccatacgcactgctctcagcgtaatgctcccagagatcctcaagcgcgaagtaatcgacctcgtctttcttcttgtcgagttgccaaactttgctgggatcttggaaacattcctacattattgaatattgaaagaagaagaagaagaagaagaagaagaagaagaagaagaagaagagagagaaatagagatgataatttgtttgctgaaagtatgcaagggcaggagagatgttaatttgagcagaatgtataccatggaggcggagcgccagcgcaggcatggagtggcggcctggaggaacacctccaggttgttatcggtattactcttcttcttctccatcctcgaatcgaatcgaatcgcccagaagcgaccaatgctcctcctagctagtacaatgcaatccttgatacgctagttattcaaatgcaatatgaaccagctgctgatcaatctctctctaaaat

SEQ ID NO: 61782 - DNA, 694 bp, Oryza sativa
cacaagtcttgttgggctgtgacgtggtgggcggcaccgcctattgggccacccaggaaggagctccgctcgccattgatccgtcccctcccaaaaccaaaacgaaacgcactcgtgaatgccatgccatggtggtgaagcgatcgcggcgtcgtctcctacctccgctccctctccacttcatccgcttcattctctcccatccccatcctcatcatgcgcgactgcgaatcggagggaggggacgctcggcgtccatggggaatatcactaaacttgagcgtgctcgttcccatgtcaccccgcgccgcacttctcgcaaggtcgaatctgcgtcaatgtcagacaagtgcgagatccaattccaaggcgcatcaggcggtccagaacaagtcgcccaagcctccaattttgacagagcttcttcttccccaccgccgccaccgctggatcttttaaattgccctggtaactaatgattccttatttcagcatccttttcctttgtttaactcccagcccttttgtttttttttaaaaaaaaaattccctctaccgttcatcacgttgactgttttcttttgccccttcaaatgtcgtctcgtggcttcgaaatcagatgaattcaaatcactgggaacggacagactacttccttgtgacttaaaaaactctagtccgtgtgctttgcagc

SEQ ID NO: 61783 - DNA, 4779 bp, Oryza sativa
aattacacagttatgggagaaatcgcgagacgaacttttgagcctaattaatccatgattagccataagtgctacagtaatccacatgtgttaatgacggtttaattaggctcaaaagattcatctcgcggtttcctggcgagttatgaaattagtttttttattcgtgtccaaaaacccattccgacattcggtcaaatgttcgatgtaacacttaaaaattttcattatgcgaactaaacagagcctcagtcaatagagtagttcagagatataaagtactactgccaaagatgcaccgcttcagcttgcctggtgagcatattgggttatatgcatgatgatatcagccagaatggtgttaatatctaaatttaacactagaatcaaattatagtaagtttgaactaaatttggaaaatatcgaatctttcccgcgaaggacggtttgactgttgttgtgtggacggtcagaccggataatgaactgcagttagctagcaggtgtctggcgtagtggcgtagggttgaaagtgattcgaatagtttccatccaaccagacttttttcggattcggatagtttcggtcggatatattcggaaattttcgaattcggaaatgagttcggatattattatttttcggaatgaaaacgaatatgatattggtgatatccgtcggaatcggataacggtcggacactatccggtattcttatgcaaaaacatatttttcttttctctacttaggtggaacaaaacaaaccatatgaaaaagatacaagaaatatcaaacatacaaacaaatggaaaaaatcgattctaaaaagtaaccacacaaattttcaaaaactttcaattcaattctgaaaattttaaaaacttttaattcaaaaattgaaaagttttagttcgaattcaaaacatcttattattatttgaaacgaaggcagtaactattattatcgttccccgctcgcaaaaaataattgtgagttgatcatcaaggacaggcaattagagtagagggtttagagagcattgcaatgtcaaatgttgcaaaagcagcaaacagtctgcatgtgcgctgcgctggaattactatagtatagtatagaacataatagtaaatagcgtaaattgtacccacggtacaacaacttgacgggtgggagcgatatagtacaggaacttgagaattgaacattcgagtgcaacaacttgacaagtgggtacgttctagtataagaacttaacaatttagtattttgatgcatcaacttagctaagcatatgctaggtgagtttttttttcgcgatgtcgatatgccattacatagcaatcctacggatattaccttataatattgaatttaatctttaagaattatactgcacatccaattaccttcaagaatttttgttttcttcaccttcccaaatctcaaccgaaatacaataatttccacatccagtttaattgaatttcaattattagttattaggataaaaatataaatatgcttatatacaaacccacgctagtatattatcaaaataagcacttaaaaatcaaatatgtgtaaaaatgtgctccaaataattaagttgttgaataacttcttaacttattgtatcataatcatacatatcttacaagttgttacatttatgcgatcacttatgaagttcttgtattaaattgcacttatctgccaagttattgcactagaacgctcatttctcaagttcttgcatcaaattgcacccactttccaagttgatgaactgtgggcatagtgcaaaaaaccggaccggccatcgaaccggtcaaacttctggttcaccggtctgaccgctgggtcgtccggttcgactgcagaacagaagacttcatattacatgtgtattctccttaaagcaacatctgtaggtggtcttgttggcttagtcgtcgaacctgtaacgagacaaccagggttcgagtctcatcttcccacccttttttcatttatgactccttttttttcatttatgacttgggcctagtgggcctttgtagcctggtccacgtgctcgtcagaaccgctggttcagaagcgtccggttcgccggttttcaccaaaaaccgcccggttcatccggttgtgaccggttcgattgcatatccggttcttgcagcaaaccgaaccgactgaggggctggttccggtttttcccggttcaaccgccgggccggtccggtttttttactaggactgtgggtgcaatttactctagtaaataatacggagtactgtttaggtgggccataatgggccccgcgtctccttactgggctgtggcgtggtaggcctggggccaattctcccaaaacgaaacgcagtcgcgatcggtagccatggcggtgaagcgatcgcgccgtcgtggcggtcctctccttcatccgctccctctccccctctttctctccactccatccccttcattctcttcggggatggcttgcgcgcgcgcgccgggaaaagaacctgccgagcactttatccctttagtcttaattacgtatattagttaatatacttaacactaatgatagtaattaagaaaatatttggaaatttttttgggatatctttttactaacagattgaaattttttgaagttagatttgaaaacttttgatttaagttttaaattttaaagttaaattttaaaaactttcaactaagatttgaaaactttcaactttagatttaaaaactttcaactccgatttgaaaactttcaactcgagaatcaagattcaaaaactttcaagtccagatttgaaaaaaattaaaaactttcaatttgagatttgaaaactttcaactcgagatttgaaaactttcaactcagatttgaaaaactttcaactcgagaatagagattcaaaaactttcaagtccagatttgaaaaaaattaaaaactttcaatttgagatttgaaaactttcaaatcaagatttgaaaattttaaatcgagattcgaaaactttcaaatccagatttgaaaatcttcaactcaaaatttaaaaactttcaaactcaaaacatgctaaaaaattaaaaaaaatcagaaaaaaaagtgaggaaaaaaaaaggaaaaaaacgaaaaaaaaagaaaaaaaaagcgtgcagaagggcgcgcgccggcactgggccttctgggcctaaaacgcgccccgccggcgcgcgcgccaactagcttttccgattctctttcatcctcatcatgtgcgactgcgaatcggaggaaggggacgctcggcgtccatggggaatatcactaaacttgaccgtgctcgttcattcccctgtcgcttctcgcaaggtcgcatctgcgcgcgtcaatgtcggacaagtgcgatatccgattccaaggcgcctcaggcggtccaggacaagttgcccaagccagagcttcttcttccccaccgccgccactgctagatcttttagtttaccctggtaactcccaggccttttggtttgtttaatttaattacgttaactgttttttttcccatgtggcttcctaatggtgaaatcagatgaattcaaatcactgggaacagacagactactttcttgtgacttgaaaaacactagtctatgtgccttgcagcagtacaatgcctaccttcactggttttactactttcatagaggtcccgctcctcttgcatcccttgctgatgctgcctccacggtaacccccgctctattctctgcttatctctatgaaatcactacgaagttgctgtgttgggtcacgaaactctattcggaatttgtatttcttttaataaagaaactatgctaaaaaagtaagtcattggatttgcccaatacaaattaatttagtgatgactctaatacaaaattcataccaactgtcaagtgttaacaaacatgattttaactgttgttaacgtacttttatgggcacatgatgtaaccgtgtgatccattttgtgcctcttcgtgaataaataggaaccaaataattataattagactgtcatgagaaaagccctaatctgggtacagtcaaatcttccaatacggaatactcactgtacaaaaacctccaatccaaatggggcttcactatgaaacaattctttgggtattttcacttttttaagcgtttgaacctatgcccagccctgttgcttcattcatttggctgactgctgtgacactaactgcagcctccgtgggaggcggtttttgtaattgctccgtagctccttcctttatattcacagcagaattcacttaaattacaccatttatctttgaagtatttattgggaatgacatgcataagtaatgatatggtttctttctttgaaagtgtttggagaaggagaacagcatgacgctcttatggagaactgtaaaagcctttagttatattcaaggctccatagtgggtgagtgcattgttgaatggatgcgtaccgtgattaaagaaaaaggtgaaatagaacatccatttggcatcgatgctgctaaggtacatctaaatctcctggctgtttagtttggcattgattaccatattgattctgttttaatgattgaaagagaggctcactagtttcttgtattggttatttgcaaaaaaaaaatgatggatggtttcaagtgcattgctaaggaggctgagttgatttctgaatggctgaggcatgggcgccgtatgcttaccgatgatgagtacacc

SEQ ID NO: 61784 - DNA, 10401 bp, Oryza sativa
cactgcaagatttagcggaccatatcgtggatcagtatactccggaaatggcaatgcactgataaattcagcaccatggcgaggcaatcgctgatcaaatgagctagaagggggccagtcctttagcttaagcatctcaggccagtaggtcctgggatgagttctgccccttgtatatcccataaaaaacatgtgtatgttaatttccacctggaaaatcagatatgaatgtagtaagcgccagaaagttcaactgtagatgaagaaagataggtttctctcatttcaacagaaacacataacaaacattatttaatagggaagctcaattcactaatggatcaacaaaattagttaaactggtcaattatttaatcattatgtgtattactttcttctggaaaggcaacacatgcacacattatttcattgtcgcatttgaaaataagcatcatctcatgtatttctgccaaaagataaaatcaagattatgccaggtatgtaaaaagagtatgaactgtggtaaagtacaataaaccaaacccgagaaaaagagtactatcacataaacacattagagatcctcacctcacaccagtcgaggcaatctactgccctcacagcaaactgctcatcttctgccttccctttggttcgttctcgtactgcccgccacataaccatcggctcccagctaagaccagaagttagcttaagagtgtctgaaacaacaactggttcgccctttgcccaatgcatctgaaagtgcaacaggtcagcgtcctggatatcagtggccaccggacagtataagtagttatcactcgagtcctccctatttgcagcctgacgtaatttcttgctgtcacttcttatcttgcctgagtgatcaaaacaagggcacagctcacttgttctacctagttcttttgcaaatgtttcactccagaagaccttctcagatctatcttctaattcagggagcaacttctctggaaacaagcatttcagatctagagatgaaaaactgcagtcttccttttcctttcgtgggcaaggtatgctaccattactgtttgctttccaaagtaacagagccttcttttggttttcgtcagaagccatgcctttgtttgactcactgttttgggtgtcgctgcgacacttcaaagagtccctttggttctcaccatctgacagaatcttaccaaaagcataatccttgtctctttcttcaggatccaaaatttccacctcttctcctccagggatctcacctttgcgaagctcctggcagcaggtcaagcacaagtcatagaaacagtgcttgcagcttctatgaaaatcaactatagaagtgctgcatctattgctgcagttgacaacaaaattggatcagatgctttctggtattatatcatagcataaagtgaacaaggaaagaacttaaccaatagacacgctcatctagatcacacacagcttgttccacctttatttgatcaactgaaacacctgtaaacaaaacaagatgagcattcatagccataccagcttccagtctgtgtgctagagaaccataccttgtatcttagcctctaattccttctctgccatctgctcctgtcgcagttctatcagccaaggacgcaacaagcgtaacacatgacaggcataacgaatctgattttctttagaaatttcctttcttggaggctgcttcacaatgaatggaatgaactattcagtaagaatactagaaagtgtcatttattaactttaaaaagaatatgtcctgaagaaatggaaatgctgtaaagaaaagatgagatggaaatgcaaacctcttcgacacctctcattcgcaggcatgccttgcaattacaattcttgcgacaataagggcattttgcagcaaattcattttcaggcaaatcaggatacctgtccagttgaattatacaacacatgggatcaccttaaaaggttactagaggtatagtgcataaaaacatatgtaccaaggcaaacataagatgaaacaagaataataccataaaaaatgtaagcagaaaaaatgggtgttatgggactatgggtaagatgaaagcaaaatgtacatttaagcctataggaaaacagtaggctgggagtccaactagtagactagaagtttgaggaaacttggcacaccattgattaatgcatggcacacaaaagcgcttattgttgcaagtcttgcaccagaccactctccctttgtcatttctctggcattggtgacacattaaggcgttttcacctgtcaacattttcttccctttctacataattgaaacaacgaaaagttagcacacccatcaaaacagttatacaattttttttaaaaaaaaaacttatacaaagaaacgtgtagtttatgaccccattattttctgccgctcctgtgtctcctctcttacgcttcttttcagtcttcgaaaccttatcattgactaacatcttgccttttactgcatttgcgttatgctgtcgaggaaagaaagtcatgggttatttcggtatcaatatcaaagagctggggttatgtttcactttgtaaagaacacaaaagtgcaccttccaagcaagtacatgaaacctctgaaattttcatgctttgaatgacaataacatgcttaaattaagcatgtagttagttacatcgaatcataacaggtattcagacattatctaaaaagacaagaattcaagcaagcacttgcactgtcataaaaaatctatgcaaaaccagcttgcatagaatcttgaaacttcttctaaaaaaaaataatcttgaaactgaccaagttcaggagaaacataatggtgggtttatcattaagcaataaataaagcgactaaaattgacggtgaaactgcgatcttactagggagacttgataattaggcccccacaaaacaaaattaatttaaagaagagatttggcttggtcgatgaatcgcaggtagcttgagaaggtatcaggtactcgttcacaaggtagcaggtcgagtaggaaacgttcaaaagtaacgatgcaggcaaatatatagtgaactgcgtacatgtcacaaaccaaaccgttcccaaataacttgtaaaaggaacgttgagtagtttaccctgtgggttttgatgttctcttgatccactttcttttttctgggtcctctcttcttccctgcatcacgtcttttgggcttgttgagaggctcgagaagttgatcagttttctcgacatcctattggcaaaacagcaattggtcagtataactttataagttctccctcaaagagtaccaaaatccatactagatagatactccatccgtttcatattacaagtcgtttgacttttttcctagttaagtttgttcgagtttttgactaagtttatagaaaaatgtagagtactatttcaacacaaaataaacatattattaaaatatattcaatgtagatttagtgaaactaatttgacattttagatgttgttaaattgtactataaacttgatcaaacttaatcaagtttgactagggaaaaaagtgaaactaattatagtatgaaacggatggagtagataaaagcacaaacactgaaacagcaacggatagcattttggagaaagaaccgaaaaaccgtaactttctttgacgtaaataaatttaaagatatttgtagcaatcgggcgaaatgagatgagaaagcaatggtggaagaatctaggggaaaaaatcaagatgttttgggatataaagggatcggattcgaaggaataattccgtactagtatatcctataccagtactagtatttttttaatcagattcagattcgatacagaggatacacggttgctggaatggaatggaagatactcgagcggaaactgaacagacaaaacaaaatgtatattgattgattgaacacactgcgtctgcaatggctgcttgattagcaacaagaacaagctgtttgatcaacacatatgacaggacagagggggggagagagagagattccctacctcatcatcgtctggcgcgttgaaggcgttgggcggcggcttcctttccctgagcgccccgggcctcgtcgcaacaccgcgcccttcttcctccggcctcatcgccggcgggcggaaagcccggtcgccgttccggcgcctccccttggcgcccgatcccctctgcttaccactcttccgcttcgcctcctcgccggatccgtcgatcgccacctcctccaccttctccgccgccatggcggtgcggcgatggtattgatattggggcaaaacgagagagatagagtggcggctgcggcgtaggctctcaagtgtcctccttttattacccgcgcttccaatattccaaccacagttacaaaaaggtcctccaagtttttcctttttttcgttttgctttcacaacatttgaatgcatgcccgtgctttacattgcatatccaattttccaaataatactaataccgtgcaaatgcaactggttacttatatataaatatgatggtcattaagcttcaagttttcactagtgttttccttaggaagctcttacgcacaaacacaagaagaaacgttcagggatctttcgactaactccgtgaggtggtgagcgtttttttttcttacgcacaaacacatagtatatgtacgatgttttgctaacgtatggattttcccgcgcaattttgagcgggacacaaggttttaaatgtatgaattgattgaatatacaataatagcttttgtttcgaaatatacgtagtccatattttgtatataactatatcagtcgatatctcgacggttacaatctaaatccaccgttattatttgaataggttacatttttaatatagagtatgatgattagataacagatagtaataaattttcccgcgtaaaattggtacgtgcttttttatattatattttaaggagtggattgcataatagagtactccgcgtctagaccatagccatcattctctcttttaacacctaaaaaaagcatttgttcaatgtacagttaattcaccttatttaaaatgtacagtcgtttaagcttgatcttttccctctaaaaaaatgtatatctcttgcttctgtttacgtgcattttgtattttttttacagtaacatcaatcatcaatatatatacacgtaatatggtacacacgcatagtgaaaatatttcatcttgttttgtctgattattaaaaatgctgtaaaccatggtgattatttatcacggaggggacatgtaaatgagtaactagcgaagatatactgtgtacacaatggaagcaagcaatagaaggagtttgtgatctatgtgttttgaatgtgtgattttatggctgggtttgtagagattggtcgaagcaacacctctctctctctcttatactatggccgagtttagttttaaactttttcttcaaacttctaacttttccattatgttaaaactttcttacacactaacttataatttttccgttccatcgttctaattccaatcaaactttcaattttggcgtgaactaaacacatccacgtacaaactttcaatttttccgtcacatcgttccaatttcaacaaaacttccaattttgatgtgaactaaacacaccctatgaatggaatcgggtgaagggaagggtgtgttttagttcaagctaaaattggaagtttgtttaaaattggaatgatgtgacggaaaagttggaagtttatgtgtgtagaaaagttttgatgtaatgaaaaagttggaagtttttttttttaaaaaatatggaactaaattcggccgaagtgtactcaatcatagaaacaagaaaatgtggggggaccttgtgtaaaaaaacaggtactagtagtatgtcatgtcctcctcgagacgcgcacaggcaggcaggcaaaacaggcggccgcaccccgttcacttccttctttctggctgctgcagccgtaccaacgcacacacgcaccgcacctcctccagcgcgcgggcaccggactagtaggaggagtagccttcgaattttgaaatttgaaccctcaaccatttggagggaagctggaaaggaaaggaatccatcccatccacgagtcaattcaaggtttgaccacactctttccgttcccctcccaaaggcgtattttccctcgatacgtctcctttcttccccaccaccaccagaccagagacagggggagagatggtgtggctgcagtacaccgcacccgctcccagcgcgccgccaccgcctgcttcttcctcaccggcgtcgccctcatcctcgccgccgcccgcctctcctacgccaacatcgagccccagcgcgccaaggccgccgaccgacgccgtgtcctcgaggacttcatccgccgcaagcgcaaccacgccctggacctggaggatccccctcctaaaccctagctccacctgcctcctccttcttccttcatcccaggttccccgtcagattcctcactctgctgctctaatctaatcttgtaccatgtggattggatgcaactccacctagacctagcaaggaataaatagcatagggatttctattttacttactcactcactgctgtatgcatcactcttttgcctaaattacatcaataatattaatatatcgattggtttattcattcagtggtgattattcctgcaattcacttcttacgtccatcaaacgtttgttactcttactaacttttattttcattaatttcttccgcgaatgccgtctctaattcttgcaatccaacctttcctactcacaattacaacagcatgcgaatgaatctcgatcaagggatcctaccactgttttctacttcatgtactattcattccattttttgttttccccctttaatttctttacctctccttcagccttgtcaattgcaattcaggtattgccaatctaatggacaaaattacccccaaggagtttgtcataaccacatctacttcttttaactccactaaacccattgggacacctctgggtttgctaccaatgctactcatcatgctgcctatatgtgatatctcatcactgctaatcaacaactgaactgacaagattatctgcctacatagtcaagaattactgcaacttgataagaatatttttgtacaactaggaacccttatgcctgtataatctccacctatgctactgatttccctcactgctgtatgactcactacatttcctaaatgtcatcataatacattatttgattcatcggctgtttcccaattcacatgcatcgcacattttcgattgggctatcttcttttgttttcgtacttgatagaaccatgctcctgttttcagtcttacaatctgcgtatctctcctccacctgtcagtttattttgcaaatctcacaatctgcgtatccctcctccagctgtcagttttttttcaatgcaaccattttttccaaaggataggaaacaaataatcaagagaacctacttttgtcttctattctttctgaagcttgattttattttttttcctttacttagcttcccttcaatggttcaacctgagttgttgtcaattgcacttcaggcatgattccgggacataacccagagtatctactagttctttcaagtccactagagctcttggcagagcttttggtttataacatcatcatactatatgtgctatcatcagtacattcaacaacttagaaatgagaagattatctggaaacatatatcagagtcattgcttaatgttgcatcttgataaaaaaaatgttggcagcactaggggccattattcttgatattcagtaaccctcgggtaaacagccatgtttccagggctgaaggctggataggccatcttttttagctattttcatttccttcctcatattgcattctgatgtttcaagctgttatgaacttacgacccatgctgcatccacttttttctgcatgcattatgtcagctattttctagttcaagcatacatgctcaaaaatttttatattcagaacatgttattcacattttctaatcttttcttttttgttgtgtaattgatgatctatgctatgtagacatactatacatgatgaaactaatggcaatccggttgtcagtagtcagtatgtagaggcaatgattttttagaagtggatgtggcctcatatgacaggcatcaagtcattgggacaaagcggtaaggtgattcttttcttgctgaaattcttcaatgtcaaatgaacaacaacaaaaagcaatggcatgatttctgagggacatatgattgctggggtttattctatgaccatgttagtccaatctgccaaaaaaaaaaaacagccactattgcacacagatagttactgtaaattcccctttctttttgcccggtcggcctgtaaaatcctatttccttttcctctttttaaattttaaattagtaaatgatcttagtttcacccactatacaattatgcctgccaattttcacttatggcttgattcctcactgctagcagttctgtctctcttgtgactacacaggttcatcatggtgatttgttggagtattcttcaataaggatcgtgaatgtttacagtgcagaaaaatatgtgttggaatgttgatgaaatcaaataatagaccaatttttttggtggagattcttctgtctcaaattctcaatgttgagatagtttgcctcagcaaggtcagttatcaattttgtgcaaactatggccgtactcctgcaaccaaaattcttgtctcttgcaatgtaatatctgatcacatggaatgcattgcctgtaggccgtaggggcggtttcttttcctgctctgtgttggttgcaatgtgcatgcaaggattggtcatcaatttgggaacacctcaattctgacatgtaccaatttagtaccattcatggtggagccattcaggtgaatgatccagttatccaggcaagtactattatgcatctagcattgaccttagttttttttttctattcagtataatcactcgtcatgtttggaaccatttggttgtatttgtcaatgaagtttgaatatacagggtagtttgtgggtagttcttgctgtgttttctttccacactagtgtcgcccgtttggtaacataactttaaacacttaattgtgtacttggtctaaacaaaacacatagagctggtaaccatagtgggatttgatgatttaccgctgtatttttctgaggactaccctcgtacagtagaaactagtgtagaaagtagaaagacaaggaactctactgtatacaatcactcccagattgacctgcaacccacacaggacgttcactatgcaaaagaccacgtggacgtcaatactatttgagggggcccataactatatataggcctgccccccatatctccgcatattttggatcgcttgtttattcgggctgggccatatgtagtactggcccaattcaatttagtaacaaacaattaattgtaccggtcccagttaccccgagcacaaatcagataatctctggtcaaattaggtgtcaaactgatacaatcgttcaggtctatgaattatatatagtgaggatgaggatttatatgtatgtaaaaaaccaaatatttttagtcttggctcccttctttttaggatatacggatcatatcatatactaccaggagaatcttcacctgattctaacagcaaccagaaataataaaaaaaatagagcccagattaattaaggacggacagccgaaaagggggattgcccacaaatgttgcaattagatactccatagtatattaagtagctgattatattaagccatagcccgcccacttcaaccaccgtgactgcatgtagtaggataactaaaagctttatacggagtacatattgatctgttcatgtgcctttgctactgattagagaaaatctggcatgcaagtctggttgccactgatgtttgatactacctgtgagctctgcaactgcaagagtctgcagagctgaaatcaatttaattaagcgcactgattacaatcaatctttgttgataaatcaaagcctggacacatcaagatctatcggctgcattttctctctcaaaaaaaaaaaagatctatcggctgcatcgcacagtccatgcgcttgtctctagctagcggaagcagggaaagtcttgtctatcttttttctggagtagttgagactttgagagagagaagccctgttggcgcagtgcctgttttgctgcttggcgt

SEQ ID NO: 61785 - DNA, 6894 bp, Oryza sativa
aaaacttaggacaaatgtaaaatgacatataatacggtattatggaaagagtaagatttaatatattggttaagctatttctaccgggggggggggggtatcgataggaccaaaatttcggatatttggtccaaattatttgaaatttgaaaaaaattggtcaaatttgaataattttatctaaattcacaacaaaatggaaagaaccaaaatttttgggtgaaatagtttcctatcggggaagtctgaatgtctgatagacccaaagtttccctccggaaattttgaaccctgtgtaagaaaacatggtgagcggaccggtatacgatatgtatatcgatggatgataagacggtcggacgatggcgtgtggtgcactggtaggtaaggaaggaaggtacgtgcagttgccgcggctgagctaggcatgaaactcacatgcattgcatatttgcatggtccctcccatcccatgtatagtatgtactcgtacagcacaggtagagatcgatgatggacggaccgactggtggccagccaggcagacccagtcgctgctgcttgtccgcctgtaaattcagttattagggccatccatgcatttgctttattgcatccccacaccgtaccgccttgtgccggcccccacacccagccccggcccttatgattaattttctactattaccacatatttcttgtctgatagaaaaacaaattaagagttggatgtaacatatcctagcgtctagatttattgtatttgaatatgtcacgtctaatcgcgggtttgtttttacgggatggaggaagtattatattcctttcattccaaaataaaaataacattttatactatgtttgtagggagtattccctccgttcaaaaaaacctcaaaccctagtatcccaataaatttttaagaaattgaacaaaagaccataataccattagttagtgaaaattgtattagttgatgggtacgtgagcggtattgaagtaataagattttttttatttgcggattggtggtaggtaagaaggtaggagctggtttatcttagaacaaacttcaaactctagcagttgatttattttgaaatggatagagtaatttggtagcttcatcatgtcccatcaatcagggcactgattccatccatgcaaactaaacatgcaaattactgtaaaataaaacttactccgtgcaaaatgtaggatggaaatgattagagaaagggtgtgattggttgagaagagaaagtagatgaaagagaatggttgtgattggttgagaggaagtaggtggagaaatatttttattttgagataaggtattgtgttagaaatagctatcaaccgtattctaggattaagccaaacgtcctatttgtaaacgaaaaatattttgtgaataaaacttttatatacgtgttcttagcgatctaaaagtaaaggctaaaaaataaactacgatgaaaaaaaaaccctaaaatcaactctaaatttaaggttgaaaatttaaattttggctgataagcataagcataagcgaaaagatgagaccgtgtattttggaatggaggtagtacatgcatgtagagtgggttagggatccgaggttcaaaattgtgcatcagtagttggtactggcgtacaatactgctagaaaaaaaacagtagaagcttctggcggttacagttgtacccaaaaaaaccttctctaaatctagtttttgtccttttcatattcttagaagttaactatcaaccgctacttctcagaatcttgagctcattcatacaagtcctaagtagtcacatactatatactgtatatgtctatccgctctgaaatattatcttcttcccaaaaagtgcattactgactatgcattactctctttgttttacgagggtgctagttgtgatcttaggaaatgggcaagaaagcttacggggactaaaattatgaaagagccccatgtgtgcttatagggatttaattatattattcatttcctttttttcacacagtttaatttcctgcaaggtggaagactggaagctactgtagtgatcagcacacattcctgaaattaagttctattccccgcttaattttacagctatcccctaatctttcagtattatagtaatagatgatgaatgaataatatagtttcctttctagtttagtactctacatgcttccaattattgattggattagatagccaatgtatagctagcttaataaaaattaattcagcagtatcgcaagagacgagagataaataaaaaggttaggaagaggctgatttgtcatttggtgagtaatatataattgctcatagcctttttcagtatgtagctaggttttacttatatttctttttccacgtggtagtacgaattgtggataggatcagatgcacggtgggcagaggccattggtccaagtaggatcacatcaggtgggatttccggtgggccccagatctatagcatatactccctccgtcccaaaataagtgcagttttgcattattcacgttcaacgtttgaccgttcgtcttatttgaaatttttttatgattaatatttttattgctattagatgataaaacatgaataatactttatgtgtgactaaatatatttaaatttttcataaatttttcaaataagacggacggttaaacgttgggtacggatattcacggctgcacttattttgagacggaagtagtatgaatgaataggttgacaattgccctagatagctcctctaattcttccacgcaatgagtatactattataattagtgtgtataagcgtatcgtgtcgtaatcatgtcttgcggttgttttacgtacttacgaaaatgataatctctgtatggtattcattctcttttgcaattacccgagcaagagcagaagttgagaggcttgtcgatctagccagcgtgttgttgatttcagttccattaattcactgaaatgtatatatgtgcgatatatcctgctatataaaaattgccaggtaaacctaccttgtccaatgtaaacgtgtgtgagcttgttgtagtggtgaggttcaggtaggcatgcatgtttttgttttggatatgttttactcataaatctattacatatggatggcgggagtacagtgtggttcatgagcagtgttgtatgcttggttgtgcataaaaattgatgtacaacaacaccacaaggctgagactgactagtcggtttcaaaaaaaggtgaagctagacacttggcatccgtcgtttggattggattggaaatctacaacatgtcgtcccgcattgccaggtcacttaattacggacgtcacccaatcacaatcacaatcacaatcccaacccaaacccaacgggacgaaggattgaatccaatccatgggcccaccagacccgacacggagggcccacgccacataggcttcagttgcatcccttcatctctctctaaatttacccgagtggagtcgagacctggttggattggtacggacggatagggactggattttttacattttggtccttttaaaaaacttatttcgcaaatagatctctagaaaaacttatccccaaaatggtcctttttggggcgccagagtagctggcgccgtcgtccaacaggacggcgccagcctctctggcaccgtccccctgctgacgtggcggggcgatgcgaggtggctagggggagtgcgccagagtggctggcgccctccctccccccgaaattttttttgttttatttgtttgatatttttttcacgcttagggacacataagaaccaaccatagaaaaattgaactcaaatggacgtaatatgtgacctatagaatttttcctctcctctcctctctctccgaactagtgcaaaggagagatgtgcaaattttttatttttattttatttttttgatatttttttcacacttaggaactcataggaaccaaccatgtaaaaaataaactcaaacggacgaaatatatggcatgtggaattttccaaagctctaccgaaaaacttctctcctcgaaaacacaatcttgcaagcgaaatttggaggttttaatattgccagacccggcaaagcgggggagaatcggatgtaactttttctgtagatgtctgtgcatatattatttgcctgattccgagtccgtatgagaaagttacgcctattttaatagatgacatattttgtccgtttcggtagagttttggaaaattctacaagtcacatattttgtccgtttgagtttattttttatacggttggttcctatattcttctaagtgtgaaaaaatatcaaaaaaataaaataaaaataaaaaaattgcatctctatgtactgtttaacttatatgtcatttcatgtggttatattttgaattagattaagtaatttcatatagtggtagagtgcattatgtttaacatcctgatcaaagggttttactaatggaattatggtctaattttagtgaaggtgcaaagtatactaagtggtatgctagctattttcagacttagctaagtggtagttcgagtttaaattttttttttgtggttggttgtatcgtgatcctgagtgtgaaaaaaaatccgaaaaaataaaataaaaatgacaccgttgcaactccatacagagaaacaggaatggaggcggcggcgccagccatgctggcaccctcctccctggggcggcgccagcatggctagcgccctcctcctgccacttcggttcgcgtgcgccacggtggcaggaggacggtcccgttgatgacggcgccagccactctggtgcccctaaaaggaccatttctaggataagtttttttaggggtctatttgtgaaataagttttttaaaagaaccaaaatgtaaaaaatcccgcggatagggatgcctcacccaccctgcattgcatttgcacccggcacccctctacggttggtttccgttgtgccttcagcttgttttgttgccaacacaccttccttcaatctatcctgtgaaaaaaaattggttcaaggcacgtaaaagaacactctaagagattgaggttagccatataccaaccaaggaaaaaaaacataccctaacagactatatatatccaaatgcattggacagtttttttttttgattggccaaatttgagcatcctcccctagtcatctcttccaaagttaaaaaaaaggagagactgaatggttgatatatatgtagggctagttcactttgttagcactttcaatcttatcatattttggcacattttagtgttatcaaaacttggttgtgttggatgtttaacctactaaaatttggtagaatgtttaacttgagagtggaaactttcggaattaccaaagtttggtagagtgacaatggtaaggatatgtttggtttgttagcataccaaaaattaataaggtgtgaatatggtaagaaaatgaacaagctcgtagttcccaatgggattttattgtttcatttgaattaatgtgcaggagatatagaaatgaatctttcattggctagtctctagaagatgcacaataaaacaaaaatgagtttaggagagaacggagatgacagttatctcaaaattacaaattgagtaataaagtttttttaaaagccacatattttagagtatatatccgtagtattattgaggttatagaagttgtagtttgatgataaaacgatgttaaatgtgtaatttttatatgatatgtcgatatatagtaaaaagatatgatattaaatctgtagttttttatggtacataatatttaaatatatagttatgtgatagattgatgaaagcatatactaagtagtttagtggaatttatactgttaaaaacgaggaacaagggtagaaaaagaaggcaaccggtggtggtggccaacggtggagacagcgtattagagcccccataatactcccctaaaattataatccatatatttatagtttgtattataaatatagctaatttatatgagacatgtttcaatttttattggctattttggtttagtccccgctttaattttatcctagctccgtcacgagcggtggctcaatatggagaggcgcatgtggtgaaagtggaggaggtaggggataataaggccctgtttgattcagcttaggattattataatctagtttattaggagtaagctgaaacaaacaagtagattattataatctataagccagattattataatctgataagctgctctaaaagagcttttttcagattattgagtggctaaagacccactacccctacatacttgagaaaaattatccacctatgtcatcaaccgaatagatagctgagggcattatagactttagccattcaaacccaatgatccatgccttcaataatccagacaaacaaacaactcacagcttattttatgccagcttattataatccagtttatagtaatctggcttaataatctagattataataatcataagttaaaacaaacagggcgtatagttggattttatttttctcccacccttccgaccatcggcacagttgggcccacaaaggcaacagctgggccccaccaggagggccatagtcatagtgtgtagattgggttaggtgggcccctacagcaggcccatgtgccgtccagcccgtgtgtctggcgtggccgtgcaccggctcgatccgctcctccgtctcgtcgttgcaggtgcaggtgcagcccagccgcgtcgtctctctcgcctcctcctcctccctccctcaatcattgcattgggcattggcgtctcctcctcttct

SEQ ID NO: 61786 - DNA, 10313 bp, Oryza sativa
tttagtgcaaatttcagccctgtgctctgtgctctttgcttcttcccagttgggttgacataggagctttagccgctgattaggttaggtctctgcttctctcatccatccatccatccatccatccatcccctgctgtgcaccgtgactccaccaccaccatcaacaagatgaaaaacaaactcttcttccttttcttgccttgccttgcttgctttgcagtaatcaggggaactgctctctcgtgcgtgtgatttctagtcagtcagtgtggacatctctaaattcatttgtgatttccttcctcatttcgttgcatcggtgtgctatgctgctccaagaaacaagacaaagaaaagaaggcgtgcttgcttgcttgcttgtctgctgcacgagtcatagttggcgtcaatcacatgtacagctgcaaatgctgtgccaagaaatgaacaaaagaaatttacctgacccaaaagaaggccatgtaagtcgtctcacttgttcctctgtttctgtctgcttgctgctctagctctttaggccttttgtccagaattcttcttcttcttcttcttcttgttgctcttgtgttcatctctggattggattagtgcttggggagaataatagtaataataagtaattgttggtaggctggtagctcagctcctctgtacgtatgccatgtatgtatgtatgtatgtatggattgtttcatgtgttaaattatcaccatgaatgattgagaatgaatgaatggacaaaataagcaaggagaaacacacggaatcaagaatgcatcttcctgctgcctgcctggctgcctgcctgcctgtgactgttagttgctatgtctctgtcactcttttttccttctagtagtaccatgatatgcttattattatcattatcgtcatgctcgcaaaaactgcaagttcatcgtcaattagagtctttggatagcattgcaatgtcaatgttgcagtaagcagcaagcactgtgcatgtgcgctgcgctggaattagaataataccgtgggggtgggggagggcgtctcggtggcaaaccaacttttttatgtggaggaatcctgtctctgcgcctggtttggttggtgccctgtttaatttatcagtgcacgataatgaaggcgcgcttgcacttagcttttctttctttcttccttgtcctttttatttttgtgtgttcagtgggtgtgatccctttcgatctctctgcctttcccttttttcctcgctcctctcttttctacacttcctttttcatcctggataacactcaagatggtcaactctgtatctgcttatgcatcatcttgtctctgccctcccactgtatgtgcgtttgcttctgctgctttagtgctccttgtgtagtactagcagtaattcttttgcattactcaaatgattaagataaaagtgagcttggatgtcaacaacattgttttagtactactactcctttctctctttctctgcctcttttgttcgtgcttgattacatactcagatagtgtgccgtaaagttacctgatccaaaaagctacagtacagatataagtacatatacaccccttggtaaaaaaaaaaggattgtactagtagtaaaacagaagcttgatgaaatgatgatgatgataggtactgcatcgtccaagatcctgtcttgtggctttaataattggataatggtggacaagatggcgctcgtacttcactgccatctatcgttagctcagtttgtctgttaaaaactgttctagtggtagaaatttttttttctgtgccctatggctcaatagctgtgagcagtaattgttagagcaatggagattgtttcaactttcatcaagcactttcctttgaactggagtaatactgtggaaatctgaaattcaggtgttggggaaaaatgtggcttcaaattgcactttgttttagggaatggtattgcgaatttgcgatggttgataaggaatcgaatgatctttcgctttccgtccaatgacggagccgaattggggatgttgctttcgttgctgtgcttgcatcattaacatgttaaggagtctataatatctgcagcaggtgtggccaatgaagccaggcaaatactgctagttgcaggaaaaatatagcagcctgtgcatgtgcacagcgcaaaaaaaggattgaatttgacttggactgtggcagcctgttgtttctggaccgaacaaatgcaagcactgcagcagcagcagcagcaggtctctttctttcagcatacaagggttttagaagatgatgtgaaatgaattgatccccattttcctgccttaaatatcatttatgtgcctctttttacttactacactaaagtaatactacatcttactactggtgacttggtgagcaatttctgtgactaatgagggatgtgtgaaatgaatagcaaaacttggacgaaaagggcgaggcgaatttccagcccaccttaacctaacctgccccatctttcttcctttcctttttgtttccttggcactttggcaggaggctaggccggggagcttctagcagctgcagcttcttctagaatctccagtagccagaagctcctccaaacagttcagttttttatctagattctgaaaatctgtagttgtagaatctgggaaatgaattagaagccagaagctaggtttcctagcaagaatctggaaaatgaattagaagccagaagctaggtttcctagcttttctagattctcaccagctagcttctcagcagtagcttcttagaattttaagctcccccaaacaagccccacgaccttcttgttcggatgagctgatgcgatctactacagcaatttctacgcacacatagtacatgctatctccatgataacttttttctgtacgtaaagcagacctcaagtaccattcttgattctttctttgtgtctttgatactactggagtacactctgctgcagcaggagggaggccagaaaatgcgttaagcttttcagtctggccatatccatgagtccatgactgattgatcattgatgaatgatgtgttgcatgtttgcatcgcctgcactgcatcgtactaccatcactataggttgtgatgatgcgtccagcccagagagtggagtactcctgtgtacagtactttcagttccatctctgatgacggacgactgcagagagtggagactggagagcaacgaacgaattcttccatgcatggctgcatctgcatacttcgctttaacttcgtactagcatcattcaacgctaatactatcactagcatttagtactggagtagtatcgaatatcgattgcaggcttcactgttattttggataatatgaatatcactgaatccgattcctaccagagttaattactccattgaacaacacttcaatagtttaaagaaaagcatgtgtgcttgtgatatataccaatcgaacaacattatttcatcatgaatgggccggccaatatgaatgaaaggattgatggatggcgacccgacttgctgtgcctatcttgcctcccaactcccagcttcacccaatccgaattggagcatccaactcgcatcctggtggcagggcaggtccaaagcgttatctctagttactataaatagatgacgaaaatgaacatcgctatcgttttgaaggcctaaaaaccatcacgttcatcatagggagagaagaaatatgtttagattatgagaatttttactgtccagcaggtaccttggtacctgtcggtatatgcaatttgagccatcgatttcgtttgatccaacgggtgagaaagagttgtacctagtagtactgtccacgtgattttacagagcatagagaggtactaaagaagcaagggtagttaagtaatttcgcgtgtatcttcttcatcttcctcctgtcttttctctctccaaaagatgctgcatgcctgcatcgatcgatggctctcaccagggatggacaggctagccggagtggaggtggagggggccgaagagcctccgtgcatcacttcctccaagctcgccggtgacatacgcctaccacggcccttcccctaatctcgctgccggattcgagcacatcggcgaccgacgcaggtcctcgtcgcctccgccgccgcgtagcagcctccgacgcaggcgccgccgttcaacaccaccggcgccgaccacccctcctgctcctcgttacctcgccaccatgcagacaccgctggcgcccaacgcgccgccgtccaacaccccgccgccgacgcccccggcaccaccggcgccgaccacccctcatcccgctcccaccacgcccttgctcttggtttggacttgctcagttgctcttggagtcttcgttgacacagtcacttagtcagagagaaggagcatcacgagctgcttagcgtgtgagattttcaatcttaccctccgtgaatgaacggccggatttaaattggtacctcaaggtaccggtacctcgaggtacaatatgctggactggagcaatgctcttagattatatggtggtggttaaggtagattgagttatataccaaacaaaattgtagttacggaaacatatgagcagtaagagttgtatattgaattttaattgtatatttttaaatattgctcaatgtaaaactacgcaggaacatctagtagttttgcaagagaatcatatcttctaccattattgcctctgtgacgtggtcactgacatatggaggtctttgtctataagccaacatgtcagcgaccacattcctccatctattccttttgtaagggtagagcacctagaaaagaataccccaaccatttttgttgacatctataattggatttgttgcgggaaactattttgatttatcgaggggatgccccccccctctcgttttaaaaaccatccgaacagttatataaaattcttgaagaatttgacaacactcacccaatatatataccactctaaaaaaaatttaggtccaaactcaactcacacatgaagatgtgaaaaagataaatttagcgtatgaatagtagcggtattgttcacattagaatttatctttttttttctcaatgtataggtcaaaatttaacttagtttttggtgaactgataaatgccactgtacaccacattatcatctttgattatgcaccgcatgatgcacataagtggttgcataagtaatagctaattttactgtggcaatcgccttacattacattattgttggcccaacaagagttgtttctttccttgctttgttgtgaactgaaagcacaattagccactctttccggcccatcccatcggatgattatttatttattagagtacacgcagtccgtagagattatttgacgccacatccacgaaaaatttcttatattatgggacgaaggtagtagcatttatcgattgcaggcttgtctgtttgatttggatcatatgaatctctctgaatgcatgattcctatgaatcagtttttgactttgttcgttgtgacgtgtgcaatccacacgagctattcgtgagctcgtccggcagcggcaacggctgacggggcacgcaggcgacgactgatcgacgaggaggcatctgcatctccatggtgtagagaccgaaggccgccgctagaccaacaagacgaacgaccattgatgcccattaccaactggttcaaaaatatgatgcccaacctggcacagagcactaataaggtaaatacggagtattattagtggcgttctatagcagatgacgcagccataccacttccaacacaaaggttcaataataagatcggacataactatgccgaaagaaaaaggaaattcattgcataatggacgactgtagatcgatacagcagcacatgtaagatcagagatagtttgtccaagagaaattcatcaaaagaaaacagctgatatatttggtcccagcatgcgtttatggaaaaagtttcaagtagtcttcttctttctaagtttcaagtagtcttcatcatgtaggtcaccctggcaacaatccaaaaccaaacatgtgagacaactatagcatgagattgatatctccattgagtaaaatcaagagcataaaccgtaccacatagtaggtgtgttcttcaacgacatcttcatcactctcagaggccatttcactttcactgctctcctgctttttaaatgatccatactcaacatacttctcacacaaaaaatctaaggcaaattgccgaatcttcatggaggtactaatggattcaacattattacgcttcaagttctcaatcaaccactcagcctcctttctgataccctgcagatggtgcaaataaattgatcaaagtcatgtgacacaaatttcagacaagtataccagaacttggttaggtgaaagcaggcatgcacataccagaaggcgtactcctcatcgttaagtatacagcgcccatgcctcagccattcagaaatcaactcagcctccttagcaatacacttgaaaccattttttttgggggcaaataaccgatacaagaaactagtgagcctctctttcaatcattaaaacagaatgaatatggcaatcaatcagtcaaactaaacagccaggagattgagatgtatctcagcagcatcgatgccaaatggacgttttctttcatcttttacgttaatcgcggtacgcatccatttcacaatgcattcacccactaagcaatcacgaatataagtacaagctcttgcatttttccacaagagcaccatgctcctctccttctccaaacactttcaaagaaagaaatcatcattacttatgcatatcattcccaataagtatatatttgaaagataaatggtgtaatttaagtgaatcctgatgtgcatacaaaggaaggagctacggagcaattacaaaaaccgcctcccatggaggctgcagttagtgtcacagcacgcagcccaatgaatgaagcaacagggctgggagcatataggttcaaacgcttaaaaaaagtgaaaatacccaaagaattgtttcatagtgaagccccatttggatttgaggtttttgtacagcgactattccgtattggaagatttgactgtacccagaatagggcttttctcgtgacagtctaattctaattatttggatcctatttattcacgaaaaggaacaaaatggaccacacggttacatcacgtgtccataaaagtacgttaacaacagttaaaatcatgtttgttaacacttaaacagttggtatgaatttagtattagagtcatatcagtaaatttgtattggacaaatgcaatgacttagacctttttttagcatagcatagtttctgtaaaagaaaaacaaatttcggatgacccaacacagcaagcaactttgtagtgatttcgtagaggtaagcaagcagagaaatagagtgggagttaccatggaggcagcatcaacaagagatgcaagaggagcaagacttgtatgaaagtagtaaaaccagtgaaggtaggcattgtactgctgcaaagcacacggactagagtttttcaagtcacaaggaagtagtctgttcgttcctagtgatttgaattcatctgatttcgccattaggaagccacatgggaaaaaaaacaaaaacaagttaatgtaatgaacgacagtagagggaattaattaaattaaataaacaaaaaaggattgggagttaccagggcaatttaaaagatggagcggtggggaagaagaagctgtgtcaaaattgataatttaacactcttttcaaatgggtttcgattatttgacatcctgacgcacttttattcactcagatggtcccatatgtcatcctcacaaaagtgtcaaattatcaaatttttcgggatggaccgccttggaatcggatctcgcacttgtccgaaactgaggaggatgttagggtttgagaagtgttgacatgggaacgagcacgctcaagtttagtgatattccccatggacgccgatcgagcgtcccttccctccgattcgcagtcgcacatgatgaagaatgaagcggatggagagtgaagagggagagggagcggaggaaagagacgacggtgcgatcgttttgggaggtgaaagaaggaaggcgagatggggtgccgcccaccacatcacagcccaacaactaggaataagttcacttgattcacgccaactatgacttgtgcagagcaggaggggccatgggcgagcatgtacgtacgtcatcgccatgcggatcgagcagcgcggcgacttgtgctccctcatggcctgcacggcagtagcggcggactgaggcgagccattatattattcattgcataatggactgtagatcgataccgcacagcacaggtaagattagagataagtttgtccgagagaaattcatcaaaataaaacaactgcgtgcgagcagaagagaggttgttaatttctaagtcggagtatcgggactagcactcattgaacttcttgcacacacacactgccactgggaataggtttagccagaagcatcggaccaatgatcagatcacccatgacgaaaggagactgcactaggggcattgcccgcacggctggagcgggcaggctgcgcccgcgtccgcacgcccgcattagttgtcactgtcaatgcaagaaaaattactgccttctcttcaactgtggcatcaattacatctgctaattaaaccaaaatgaaaggaaaaaaaactgcgatatatggtatgcaagcatgaagactcagagttcttcagtataagcaaaaatgcaggcttgcaggggtgaatcttcagatgaaacagaaaatcagtaaatattagtaaccatcttgagccctgaaatcttctgaaagacagtgactgcagcgaaaagcagagtctacaatttggcataaaaatccaccgatccttaatcaaattgtcctaaaaaaatccctttccaaaatattcatagcttaacaacagcataaaggggaaaaaaaggactcaaaagacatgcatatcctgacagcaacaaagccgcctgatccttgcatctattcctgtcactcatgcagaattcaccaggcaaaatcaaatatgaatttcaggctcaacggcagaaaagaagtccagaaatcccaggctcaactaaatttccaatacatcatacaaattttggatgtaatctgacatgtgtgggaaacactgatatgagctgggaaactaagcaagctccactgaccactgctccagaactagcaaaatttctcagaacccagattgcatagaactcacatggtaatttgcctgagatgtcaaatgatttaatgtcctgcccagtgacaaaaaaaggggttaaaagttggaacataatctacattgccagtgccagaacatcttggattgaatttaaaagcaatctaacagaatagaagtgaatctgacccccagaaaaagagaggtccaaactacctagaaatgaagataaaattatgtagtactatttaaggaacagaaacaattcagttacagttttatgaccatggtgagggggtaatgcagcatgtgtacacaactctttttccagatctagcaactcatttaagaagcaaatgtagaataaattgtaaattattattagatcatcatagtacccatattcaattagacatacagaaatataaaatcaagtaatttgaatacctaatagttgcatattaacatcatcgccctcagccgtatcagttagaattgaatatggatcaccaaaacctaaaacatcagaatacaaaagttcaacataaataagttcatggcccataatataagtagcaatgcacaactaaagtaggcttcataccatcggctcgcatccaatcttgaaggcaaaccaatgcctccacagttccactagccaacctactcctatagtcgctaatgattcttgatccagtagaaaatgcagactctgatgcaactgaggatgcagggacagcaagcaaatcaagtgccatgcgtgataatattggatatttgcaagagttcaccctccaccactggagtatgtcaaaatcatcatcagggaaatcattttcttgaggaatatcttcgagatatctagttaactcagtctttactttactcttgctttgatcatgaagatatcgcctcgtgtgcgggtgaagggggcgagaccttgtgcctgata

SEQ ID NO: 61787 - DNA, 651 bp, Oryza sativa
tacctgcatgtttataagccatggaggtggcgcaccatcaggcataccaagagcctctttaagttctcgcgacagcatgcctggcttcatttccctaagcttgacctattaagtccacatgtacaaagcaacaaattcaaatactcaatgtacgaaaacacagataaatggattgtgcagacagttaccaattatctcgattcttttatatatatcagcatgaaagataatgtaaaagtacctcaaactctttcccttcataatacaggtcaccatgactagtcaattttggctttgtttggtatttgaagaaggcgtcatgcaagacctgtaccaacgaaatcaaggtgagacttatttttcctgcctgtgaatcatgtcaggagttgataactcaggccccagctggatatatgagataaattactctagattttgggttgaatagttaaaacaccctgaattttgagcttaacataaacatgtgtgctgtaatgctgcattaggactaaaacagtctgtaacacccattaccagtctcaaaaagaaaagcagaaaaattcaacattattagaacttgagcttaaggaaagagtatgaaaatgtgtgtttacaataaatgttgataccatcaaatgatctctatagaca

SEQ ID NO: 61788 - DNA, 1057 bp, Oryza sativa
gcgctggcgtggacggcttggagtcgacgacggcggcgccctgagcaagcaggatgaggcagtgcgccatgtcctcctcctcggtggtggtgctctcggaggaggaggccggcgccgcgtggtggcgcggcctcttggtgcgcttgcgcttgacgaccccggcgtgcttgtcctccacggacatggcgacgaacgccagagcgcgctctgtgtcggcgtgatcggtggcttgcatggcgatcgatcgaaagcaagaaacgatggatggaatcgaagtggagaatgaatagcaagtttcgatctctttgcctccttatcaatggaggagaggaaagaggagtaggaatggcaaaaacctagcctagctaccaagctgcctttgcttcttcttcttcttcttcttcttcttcttcttctcttcttctcctgtgatgtgttggtgactttggatatatatgtgtcttctcttctctgcaaggctttgctgttgctttgcaactcttataaccttccactctagagagagagagagagaattaattagggagagagagagaatatgtgtgtgtttgtgtctgtggtttagtttaattaggtggttaattacagcagctagcacaggtgcatgctattgttagaaggtgtaaataggcagtataggagatggagcacaagaagaaaggttaactggtggccaaggaacgggcacgccgagagtgtgtgttaaaaggctccctcttaattacttgtggacgattttgatgcctggctagctccctctactagctgccttttaacttcgtgtgccaaatatgtttttacatcattattagacacccttaatttagccccttgcttgttttccaaatgcttaattacttaccctcttgaattaacccatcaaagtgtatgtgtgtgtgcgtgagtgaggatgaagctgtgcctactcaactattatactagtatctatagttagcatagctgttgttttctttttggtgatgaattcaagtaatatactccctttgtcggcttcatttctagtatttttcagata

SEQ ID NO: 61789 - DNA, 1364 bp, Oryza sativa
ctttcagcgtgtaaatacggcattgacaagaggctaatggtcatattgaccaaagtttgccagtgagaaaaaaatctgcccgtctcaacagaatagattttcaacagcttagatgactaggcgcgtgttttgaagcaaaattgcagtgcagaagagaagttgacgtttgagagcagaatattcagattgcataaatatatgtccaggcttataatctggaactaaaagttccagttggagatgaaacaagagattaaaacatggttaatcacataaaaaaaaggaaccagcattttcgtaacagtcagcatgccttgaagcgtttgaaactagagtattacatcacaaagaagaaaaggaaccgaaatattcagaacattcagcatatattattaccacacagcgaatcacagttttgctttgcaccgagtaaaattaagaccggaagtgaattacatgaggcgacaccatcaccaatccctctgtaatttgcttcctcagcagctcctgctcctcgatggtctgcggataccatgacggagcaaccttgatcttgggatccaagtcttcgcagcactcgagcaacttcctgtcgtacagggatacatcctctaggttaacagcagcttccatgatgtgcctgatgtatccaaggaagttgtcatttggttggaaaccatagattgtgagtttagtcaggttgtaatgcctgaaaccatcaggtgcagatgactcccactccacgtttgctttttcagagtaaccctgttcttcccgttccaccttgtcggtctgcatcccacaccaatggtcccaaaccgtgacgcgcatctccttcagggagggtgctgcctcgagaaagaagcatgtccaagaaatatcacattcttctgggagttcatccagattcagaacttgcagattccgaagaacaggcgccaacagtttcgggcactctggctgaacccaaatctgcaatacataccagcaataaaggatgtagattaagttgagaatgagggacaaataacctgagagagagagagagagagagagagagagagagagagagagagagagagtcttggttaaactaattaccttttcacttccgaagttgaggtacaggtcgcttatgttggggacattagcaaggaagtgacttaacctgataacctcctgatatctcatggctacattagtgaggcttaggcttgaaagcagcgggacattgccaaaagacaaaggttcatggggacagacccacaaactaaaatccagatgtttgaggtttggtaagtagttgagctcgactaattctaaacttgcatgatagatatcaagctcaacaagtcgtgggtgct

SEQ ID NO: 61790 - DNA, 542 bp, Oryza sativa
ggattggaatttctggcataggtgcatctgtcctcggaggtaaaggttctgggacaagaacagcatggctgatgcgtcggccatttttctgtgatccaaagcagaagtacacactcaaccaatcagcccattttcttcgctgcaaaagaacaacactatttaattcaaaaggaaagtcttaatcctcctgaaatgtgacttaagaagattactattgtagcataaatatttggcacataaacagcataagcacagtcgagtacagtagcctgcacctagcttttgtcagacatgcattctatagcgattgtattgcagagttaggatgaccaataacgtgaacatgtaaacaggttggcaatagaaatatagcatcatcgagctattaggctccatgttaccgtaacgaaaaactagaaatgaaattccacaaatcatcaaaattacgtcatagatcccccattagccaggtaatgactttccaggttaaaataaaagcattaagaaagtttcataaatgatcataggcaccagataacccg

SEQ ID NO: 61791 - DNA, 640 bp, Oryza sativa
tcgaattcctgcagccctattttattggctgaccagccggtggagtaatttcagtcgatagccgatgtcaatggggttttgagtaatcggctatatatcatatgtagataatgatgtaaagacaatcggctgatgataataaaatataaaaataatataatccaatagaaaccaatcggctaataataatatgagagtgtaagtacttatccgaaggttaaagcatacatcggctggaggtctgatgtcataaaatctaaacgattagataaacatccagataattcattggctgaaaccccgatgaaacccttattggcaatcaggaagcaggctagagattatggttctaaacacgacttagtatatcaaacttaacctatgcaacactaagtttgtaaagaaacacaatatctagactatcaagcccttagactgatttctcagggtggtagatgtctaagctaatttaatctagcaaggcgatttagtcgataccggtagaaaccctaaagcgagaaacaaccgatagagctaaatcaagatgctaatactagattaacagatataaatgataaattggtaggcaaatatatcattcaaaccagagcaatccaagaggtcgaatgtactgatgcag

SEQ ID NO: 61792 - DNA, 20752 bp, Oryza sativa
aattcgcatcccctcgcgctccggtgagttcaacctctaccgccgccttcggccatgaatgccggtcgccgtggttcatctcccttcctctaatctctcttctccttccttagggcaccccgaatcccgtccgccggttgccgtcgtcctcccgtggctcgccgtcgccgtcgtcttcctccgcgccggccaccctcggtgaggcgtcctctcccctctattcccctccctttcccttctagccgccgctttagcgccgccgcccgttagccgtcgctttagcaccgccgcccgtcggcgccccctttgcgccgccgcctccgccgccggttgccgtcgccggcaacgcgtgtgcgcgcgccgtcaccgtcgccgtggccgcttggccggtcttgagccgagccgggtcgccaccgcccgtccgatcggccccgagggcgatctgggccgtcggtcccgtggaccggcggtggaccacccgcgtggtcccggtcctcggtgaaccgtcccccctgagccactgccgagtgggctcgcgtgccggcacccctttcctccctctcccgagccgctgaccagtggggcccgcgtgtcggcgccgccccaccccgtgctgacgtcaaccctggaaggctttattgcgcaataattcattagggtttttcttttatagtaataaacacagtgaatcttctaaaattcataactaattcatccgagctccgtttaagtccattcaagtctcagtaaatcaagaaaaatgtgtagaatccattaaaaatggttttgttccctgtttcagtagtcttatagcctgtttgcattgtttgccttgtatgtcgttagattccggctcttctgacgctccggtgtacttcgaaatagtcgccgaggttcctccagcagcagagcaaggcaagtcatgcttgtcacttgatcatgttgatcctacattgcaaatgttctattgttttccttcaaatactgcatttattttgcaataacactatggtatgattatctattgttacagccatgctattttgataccatgctcctttgttagcttgggttataacatgaatagactttggactaggaattgcttagccatgcttagttccactagcacacaatggggagatctcattaaaatatagactttaggttcaattggtaatgttggtttagtatcaccattttggtgttggttaattaaaatgaatcacatggtgggctgtgggtgcatggttttgctggtcgcacccatggcatttaaggaccggttcgcgggaaacactggaagaacttatcgtgcttaccacaagccagcgtgggcaacggctgggcttgtagtataacttttctctagctgacgcatccaggcaagggtgggcgtgatggagtttggatgggccctgcgacggcctatgtggcttccggattcacctaggcacgagaggggactgcccgtcgcccgctggggacgggggtgaaacataagttgtggtgtgcttggatagagagggttatgcgaagggtcctgtcacggcctctttccggtatgtcgtggtggcatgtcggcgcacggaaacgtgtcgtggggctatgtcttgtgggtacagttgtacacctctgatcagagtaaaactattcgaatagccgtgcccgcggttatgggcggtcaaccagactcaccgtgattagactcatcttagtttagtctaatgaaattggatggtataggtggatggttgggcctgttgcaacatggtggaacgttggacagtggatgattaatactacttaattattacaactgttttcgcatacgacttctgtttataaatgccagtattgtgcaaatgaacctgtttagctctcccttgttaaatccctgcatcataccccccattccggtatgacttgctgagtacagtggatagtactcagtcttgctctatttttcccccaaccctagagtatgagtatgtgtccgatggcgggttctgcgaggagtaggcttcgtccgtgccgtcgaggatgcctgtggagtggtgttcccgctgcagttcaagtcaagacttagctcctgttacctttctttttcccgctgcatttatgtaagacttttataatgtttgtaagacgtgaatctgtatgtcaacattgtcgtttgtgtaccccggccggtcctggacgggggttttaatgcacattctgcttggaattctattcgggaatttctgggcgtgacaatggaaaagtactgaagtttgaatccaaattttggatctaaacgcagccgtagtagagttttttttaaagaactgtagagttctttaccacgaggagtagtgctagtagagttaactaatatcagaaccaacatgtataatactgtatcttctagcactcaatctttccctccatgtttcttttaccactcactctttctttaagttgggtataaaattatctccatgtttctgttagcactcactctttctcttacttaagaatttaattaatgtatttaacttatatgtaatgctaactcttacatgagactgagagacaacaatatatattttcctttcttaatttctctcctttacataaccttctagcccactattatcactcgtataggagtacagaaggagacattcctatacgatctccgtttggcagagcatggcaaagcaggttcagctgaaaaaatatctcgttttttgttagtcagtttttcgaactgtttaaaaaatcacatcaattcatttttcaagttggcagccgctgaagtacacagattgatcagcacactaagacaatcggaatgattgttttttagtatactcaatgagtacggtcctcagcgagttcggttcggagatgcatttgataatgtaatgataaaaggtgtacggtttctaatcctaaagtctcgtgctaaattcttaacaaacttataatttactttataaatattggaaaggacgtctcttcctccgaatctttctttttttaaagaatacataagggctcaaggctcaagggacatctacgtactagtaacattttttcagcaaggctgcaaaatatacatatagatgtatatatttgccggttggccctcttcatacatacataggattagtatagcaatatcactcgtaccacagataatcttctactactccttacgacatgtcaggttaattatttcaccctttctgtctgtcgtttttatttttggtgctaattgctcctccgtatctaaatatttgacactattgacttttttaaataagtttgaccgtttgtcttattttttaaaaaagtaattattaattctttttctatcatttgattcattgttaaatatacttttatgtatacatatacttttacatattcataaaagttattgaataatgcgaacggacaaacatgtttaaaaaagtcaacagtatcaagtatcaaatattatttagggatggaggaaataacttactgttcggaaggctacaagagagagagaaaaaaaggcacacgtttaagcaatatgtacatgatgttaagtatatcgatctgctacacaggaagctagcgtacatcgatctatgtagccaagataataagctaacctagttaatttctttccgagttgtacgaaagcacaggtattttagctaattattaaagaaataaaatcccaagctaattaagcatacagatatatatatgttgttattaatttgttaatttgacagtgcacaaacgcatgcatcagcccaatatggagtagaaaattaacacatatataggtaaatctgagatatagtaacttactagcttagatagaggacttccaatccatcgccgatctgtggatccatcgagatttgtattaggtatagcttcagatccaaagaagagaagcagctagcgcgctgagctcgaggtaggtagcttgcttagctcagggctcagcttcgtcaagctcgatctgtgcagtctcgatccggccggccggacggcagcagggagagcacccaccatgggccatggccagcttgctttgctagctacaggtctcaggtgaggctgccggctgccatggccagcttgcttatgccggatgcgccatggcaggcagcaggcatggtgggtggtgggtgcaggtgagaagaggagaggaaagaaagaggcccctgcagctgcaggaagaagaagatgaggttgtttggtttgctttggctgctttgcttgcatacttaaatttggtgtggctgtggctgtggctgctcgctggtactggtgggtggagtggaaatggaatggaggactatttatactatattgattacactcctaattaaccctagccgtgctactgccactgactgctccatatggagtactgtacagtacagactctactgcaatactcctactatactccacggccgccctgagctttgattttttttttcttcttgtcgacactgagctttgatttgactagtccacaccccatccatgggtcccaccaatgtcaaaagctgctgtccctcccttgtgcttttgtttccttcatcgatactactgtaaatttgccactccgatccattcatccatcgcgccgtcgacgatcttatccttgccaccgctggcaagctcctcgacgatcgctgcaggggctcgccggcggacgaatggaatcgccgacgcaggcacggactgacgactgtccaagcagaaacggaggtctcgctcgctggaaaagcatcctcccaacataatttgaaaaaacaactcctaaatccttgatgaaaacctctgcatgcttctttccagatcacgatttcctctttacttgtgccaaagagctaggtaagccgccgatcgcacctgatttaatttggagcatccaacacacaaagaaaaagcgtgtcaaagaccctcctgtagctgatacgaaaatcaagtctcctgtagctgatatgtccctacctgattcggcgggcacttcactcacacactagtattatgagtcatgtactagtattatgagtcatgtgtgatagatagatagatagatagatactgtgatgtgtctgtctgttattcaagaaaccttcaaacaggttcaactgcatgtgccttcgccttttttttgctttgctgatcaaacctgcatcacaaaatgaacatgcattttctagtaattgcagtgaagaagcaaccatacaatcaactgaagagaggtttactactgcagttgctttcgcttttctcaactaccccctccgtcccaaaaaaaagtccaatcctagctatgaacctagatatatacgtgtccaagttcatagctagggtttggttttttttgggacagactagtatataggtaaaaagggttacctgaataactagtgtgacacctggataattcattccccgtgttgaaatatctgaggccaccagatcaagcgactagaatctcgaaattcttctaatatccgagttctatagtgctgaggctttcttgaatgaatttctcggacatttagcttcaaatctcgaagcatgatatacataaattcagtcatcatggcagttgtgcagaaaacaattaatcacctgggatgagaaaggctaagtaaatttaacttatttaagttcttagtcaatcatattgcctggtcaaaagagggatgagagcaccttatagtccacttcctgatcaccttataggctataaaccatatgaaaatgctgctcgtgtggcaaaacgagataaaactgctccacataagctcaagaacaccaaatatcaagggaccagtacgcaactaaaattcatttccatgggagaagataaaaaagagactatcgtaacaatattttacttttgagctaaaaatcattagaaatatagtttatattgccgtacaaagtgtacaaatgtcttaaatagtcaaatgataaacacaatgacaagaaagacatatggtctagaatatctatttatctggatgtcggcatctataaacaaaatgttttacagacacccctgtttgtgcatccatggaaatcaaaagtgctgaacaatgccgacccggcaaaagtgctgaacaatgcacgaatgacctaatggaagtcccttccatagatacaataatgcaaatgtgacctcttttaattggcacattaagatacatgctaacagatgctctaggtaatgcaaactaagaaaattgatcacagcacatttctgtacttgcaggagtcagaaaaaatgagcatattgcagatgagaaaaataaaagattaaggtgatatataatactaaatatactagagtagaactggaagcatagaccttagtaggagtttcaacagctcccaagcccattgtatcaacaaaaacatcatccctttttaaaactagttgcgaaacccttcgaacctttcattgacaaattcagatatgtggttgtcaaccaatacagaaacagatagataaaaatatagagactactagttctgttggccatgctgattacagtaccccttttgggagtagtgtttgtctttgacgtagcaaactatcaacaatcttttcaatgtctgtaagaaaacccaaatctagcaaatgaacagcttcatccaatacaagcaactccaatcccatcaagcgagcagataataaaaatttgttctcaatgtgatcctacagtctaccaggtgtaggctgtagcaactaaaatcttcaaggggggaaacacaagatatagttcagacaaacgacaaacagttgtctgtacatatcaagcatcagttacagtgagtgcttgtactgatgtcaatgaaacagcacaacttgtttgttagtcacatggtctgtatctctttacgcataaagtaaaaatgtaaaatcatctatcggtcattttatcatgatgagtgatgctgaatactatgttctttcattttattattgttaattcttgttgtacatcagtgcaataaaactgtaactccaagaagacaatctgtaccaagtaccaacttcttagttcatataccatgatacgtacaaaagtgcatgactcctcttcgctggaagctctaaatttcgcaaacctcaaatcattctttgatgtttttgttatatcttcatcatcctgtcaaatcgccctgctgccactgggtacaacctctctttgtttagcgaggaatagacttcagagctcctgcctttgtacatagttttttttccttttgcttttgtttcgctttgttttcaaggcttctcgccttgactcgacattctaatatcgagattcatgtattttcttccaatcttaatgaaatttagtcagcgtttcttccgccgacccatcaaaaggtacaacctctctttgattaaacagggagggagaaatccgaccactggaagacctctagagataagcagcatcagcatcatcgatgcatcaccatgcacctggaacggaggaataactgagcagcatctcttgggaccaaagaaacagaaagatgcctctgttcgcaaaggaatgccagaagccaaactccattgcctccaccagcacataaattagactccaaacttctctgatctaccttgaatcttagtgccaccgataagattttgaactacaattcctcgatggtacttcaaccaaacagttgcctttgcctcagcagtgagctggatggcaagctctcttgtagccttgtagccttttagggcagaaggataaggggaaaaatatttcatcggaaaaaaaggaaaccggaatattcataatatactgcttaaaatatgtcaggctactgtcctgaaaccaagattcaatgtgtgtgatgatacttaatgtaatacattttataattaaattcgaattccaaattaaacaggaaagtcgtagcattagtctctccacttaacctcctgtccacacatcaacaaaagctttcgtattacactattatatttatatgcaactaattttaaaatttatgaaaaagaattaaggggcaaaaaggataagattaagaataagggaacatatttcattaaaaaaaagggataccagagtactcagaacattcaaaatatattactattgtatagcacatgcttacattacatatgtccagtccatgctactggcctaaaactaagatgcaggaaacaagagaattttaatgcatgccttgaaacatttgaaactggggtagttcatagccaaaaaagagaataaacaaaaatattcagaacattcagcatatactattgctactcagcaaatcacaggaattaagaccggaagtgaattatatgaggtgacgccatcaccttagctctgatctggatggcaagctctcttgtagtagggcaaaggataagggaaaatatttcattgcaacaaaaaacaaagtaagcaggaatattcagaacattcaaatatattaatattgtatagcaagctttacatacggcctggaaccaagttgcaggaaacaagagaaatttaatgcatgccatgaaacgattggaacattcagcatatattattaccagtaccatacagtgaatcacagttttgcaccgagcaaaattaagaccggaagtgaactgcatgaggcgacgccatcaccaatccctctgtaatttgcttcctcagcagctcctgctcctcgatggtctgcggataccttgacggagcaaccttgatcttgggatccaactcttcacagcacttgagcaccttcctgtcatgcagggatatgttctctaggttaaccgcagcttccatgacgtgcctgatgtatcccataaagttctcatttggttggaaaccatagatggtgagcttagtcaggttgtaatgcctaaaaccatcaggtgcggatgactcccattccacgtttgttttgtcacagtaaccctgtttttcccgtttcaccttgtctgtctcaatctcacaccaatggtcccaaactgtgatgcacatctccttcagggagggtgcagcctcgagaaagaatcttgtctaagcgatatcacattcttctgggagttcatccagactcaaaacttgcagattctgaagaacaggctccagcagttttgggcactccggatgaacccaaatctgcaatacataccaataataaaggatccagattaagttgagaacgaggaacaaataacatgggagagaggattgcttaaagtaattatcttttcacttgcaaagttgaggtgcaggtcttttacgaagaggatattagcgaggaactgacttaacctaataaccttatgccatctcatggccacattagtgaggcttaggcttgaaagcaatgggacgttgcaaaaagacaaggttcttggggatagacccacacaccaaaacccagccgtttgaggttcggtagggagttgagctcgattagttctaagttggcattggagatatcaagctcaacaaggcgtgggtgttccaactacagcagcaatacgctatcctcagtttgacacaaggccaaacgcagatactctaaccgtttgcatgtggcgatgatgttgggaatgtcagtttcagcaaagctttaagttgcgtaggtggagacgtgtaaggccggcaaatgcatcagtacaggaacaaaaaaatgtcatcagctgcttcccatcgcggcggcgatcatcaatagttgaatagtccggcggcttctctgtcagaatgttgaactcagcgctgtggatgttgtgggtggccatggctcgggcaacagccttgccaatggtgagacaatcatagtatctcaagtagaaacctatgctgagcttgcgaaggggaatatcttgtcttctgaaactgagaatgttgtcagttgcaccagccacagcagcgttcatgggaattgtatccttcaaggtggcatagccacaacggggcacaaaggaattgatccgaatatgtaagtttgagagcatatggcggagatggagtgtcctcttagaaaggaggcaggttctgacagcgtcgggggtgttgaggcggtccaggatgttgagcaggacatcttcaggtagcttggtgaacccatccagcatcacgggatctgatttctgcatcaagatattgcagcaacccactagagcatcaatccatggatcaacagacaagagcatcaatccatggatcaacagacaagagaagattgagagatgcaatgcaaattaaggaagaggaagatgtaatgctgctcacgttgcggttgcaacgactacccttcttcttgttcttcatgggctgtctagttccgatgagcgaggtcaagatcgaactggcgacttgcgtcgactacctttccaccccttgtcgttcgtttgagacaacaaaaaggtcacactttgaattcaatcaatcgaagaagaggcatgcattcgcggcaatggtggtgtggtggcggaggacaagggaagaatggccggcgttaatggaggaggcggcggcggcggcggcggtggcggtggcggcgatggtagggaggattggggacggcgacgttaggttaggtacccttgttattatgggcctcctctcgaatcatcttcctaattgggctagcccattgtgtctgattgggcctttcaaacaagagatatcattggcatatagaaaataagtctactttgcgttcatcatctttcgtcccatgtcatcctcgctctcatcacatattttctcttcttttctctccatctcttgtcggcaaggagcagtagtgatttaataatatctaagtctgatgatatgcgagctcacgctgcgctaacagaatagacatgttaaaattagctcattcgaaccttccgtttcatctcttcatcaatatatatgtttggtgtttgagacttctgcaccgggagatcatttatctcatttcagaaatactcttcccatggggcaaacaagggttcagatttgttcttgtcatctctgacgtcaagtgacgaggacatttcaaggcatcttggttgctttacattaaaatgacttggctgtaaataacggttactataaaaatttacattagtattgataattgcttaattggtgaagcagttagctccttatttatcacttgggacttgggagacaagaatcgtgtcagcttattcacatatagcgtcacctaatgtggattatttccaactgaacattttggttgcagatgatgtcaaccagggattctttgttcatgcctgcttcatgcaatgctttatgcctccctggcaaagtatcttcttgcaaatgaatattaccagaaaaagctgcacttttgccggttccaattttagccttgacaagtacattttcacctacatgcatacagtgatgagtgaggggcaacctcttgatttcttgaaggtttcaatcatagcattttgagctagatcgagagatataatggtaccacaaggtgctaagtagcaagtgtggaactactgaagcaagtagcatgatctgtataaatttgtggatggtaacgcatattccaatttccaatgaaagaaaaaaaaagagtgctttcaagacacataggaaatgctgtttcctgcacaccagtagtttgtacatatccagcatcagtgagtgcatttactgttagcgcggagataccacattcatcaaatttgatgtcaatgaaacagcacagcttgttaatcacatggtaagtagtaaccatctctgttttgaagtacgctaggaagcaatacgcataaagtaaaaatataaaatcacccatcagagtgtcagtcattaaccgcaagttaaaagggcatctatcattgttttcttcctcatatcacagttcctcaaagcagaacttcgccatttcttcctgatggcacttctcgcctccaattcatcgtctgctgactcctcttcgctggaagctccaaattttgcaaacctcaaatccttccttaaacagggagggtgaaatccgaccactggcaagaactctagcaatcagtggcatcaccgatgcatcgctggactcctgatgtctcttgggactgaagagacagaaattaagatgcctcactaagcaagaggcgagcgtcaacagaggtgccggggaggagcaggccgccggcgcggtcgcaggagagggtgccgaccggaggcagagacgaggacccctaggacatttagtagcaaaattgtgaggttgaatgtgcataataggaagtttgatgcatttagtgttctgtgttttttagcaacaccctattgcagagaacaaaataaaactatctcattgttagcttcgctaattatgggcaattttctggtttatgtttcacactacccagagttgcagtatcaactaagagctatattttcctatcaataggtcactcttgtcgtcaaacactttgatgatccaaggatagtgagtgcagacttgaaagatcttcttctttttcttcaatcaatatcggttcttgtacagtacaaagaattcatgtttctatttgagaacaatcgggaggctataaacagaatgccaagatcacttctgtcagcttttggtaatagatcatggatacctattaccaacataccttttcaactctgcaaaggtttaggttttgcttcatccaagaatgctgaatcttcatcatctgcaactttccaggtttactttaatattacaatctcttttgtaattatattcattcttctatttctgttgtgcttatgttaccgtctgattgtgtgagaactatctatttgatcttacatttgtttttctctacgaatgttctactcagggagacatgtattcatgaagagaactgtttttatcctttctgaatcgacttttcaacacattaagttggacaatgacgaattctccatgtccatccgtgagatgcaagataagcaccgggtggatttttttttgttttatattcctcttggtgcagaacttaaactctttgctgattaatgctttagtactcgggttacattttcagtttagttactaaacgccatcatttttcacatgtcaaaatgcattaaaaaaactgaactttatcttagctctgcaatgaaggtatacactaacaggatccttccttttttctttggagaacactaacgggatctcttgacaaggataaattccagtaatttggttgcttcagttaattgctttttcaatattttatcccaaggggggaaatctgtgtccgtcccgggtgtagccatgcatgtggaggtaaataattgtaaccaatatttttcaggttgccgatttgcagcaaagaaagtgcagtgttattttttacatatcagtagtcttgcaaggatcttggagttctgcgccagagagatccctcatgcgttactcatggggacagatatgaatctgcgaagattgactgaattaattgtatttattctgaaccacatcatatcagcaactaatgcagagtggttttacatgcaagtccacatcttaatctgaattctgaagtctgaaaattagcagtgttttagttattttaagttgagacggtgatcttgaaaggttgctcagtttagcgtcagaatctaaaacgcactgcttctattgttgatttgagctaactcaagtataaaccaatattgttatatcatggtatctttttttccacagtacagttgtagaatcgcacgagaccaaacaaacctaccagagggggtgaatggtagggaaaaccaaaaacccaaaaatcttttatggaattaaagattaccctcgaacgatgtcgatgacgaagtccagtcgccgccggtcgaaccgcctacctgccgccggtcagaccgccgctatctcaccggtcagaccacgcgcacacatgcagttagaccgtcgggacccagaaacaccggtagatgacaaactcgaagatatagattgaaacttttcgactttattgcatcaactagtgtttacaaagtgcaccaatagcactcctcaccaaaatcttgaactaaactcgaaatcctaactttctctcaattctagtctctctagaatcgataccaggacctcaccctccctttctatttatacaaaaaaatcccctactctatataactcctataaataggactcaattcctcaatttcccttttctccgaaactgcagccgcaccggccatctgaaatcctgctccgggtcggactccttcggatggatccttcgccagctcgcactcggtctcctctcgccgcacgtcctggaccggctccagcaagccgcgcgcctgcccaacctgctgtccaaccgaagccgctgctgctgcctgagccgccaacacatgcacagcacaacatgcatgcatcgatctccatacatgcacagcacacgtgcatgctacatccaccgagcctacacacacatacatgtatcaacacatatatgcatgcatatacttctcaccgatttcttccaatctccttcgcgaacaccgacgcttgcacgcacacctcgtaaaacccgttgcaaagatctctcccacatagtgtccatccaccgtgtgccatctcgtatccaacttcgtcacccgacatccttgaccgtctggacctcaactcctccttgagtttagtcccgatcctcaccgttaccgaagttgacctccaagaatcctgactctagtcaccttctcacatggtatcccgatcgcactagacatctgttcctccctgaacatagttccggtcctcaccattgaccaaggctgacctcaagtcacatgcacacaatcagacaaaacaaccgtttctgggcacagatatcacaacctgacccacattagtgacacgcactcacaccaacatccacacatcttttcaaaccaattcatcgattaaatcatttgcatagccaattgttcatcacaaatattaatcatgacaatgatttgacagtacaccaagatgcttcctcattttatcggtgcatatgataatctttaatgtactaaaaaaatgcatgtgcgttacaatgggaagaaaagatgacaaaattgaggagaatttgagaaagatttacattatgtaattaacttaaatacacatttactggaatacttgatttttttaagtaggtaggtgtttaaattaatttaaaagtaaagtaagtgtggaaataaaatgatatggctgaatttaatttttatgaagttctccatgattaattacactctttggaattttcttgaaattttcagatctcaattgctaattttaataatacaaaatcatttcaacatttatttaaacgaaaatctaaataaaaactctccattatctatgggccaatttcagcccatttccttcctcagcccgcagcctagctggcccacttttctcccttctcctctcctctgcctcggcccgcaagtacgcatccggcccagcaaggcactacaagtctaatcagactccctcactccttccctcactcctttcactgtcatgtgggacaatgctacagggtcgtctcctacctccgtccgtattgcttcatctgcctgactacgcctgaatccgcctctttcgtgaaatacggccacatccatggagataatccgaaattgactgaggggttttgatccttatcttctactctttatgttttttcaagaatcaaagcaaaaccacatcatcgtatagatgtcggaagggaaaccagctttgtgctctgagtttgtttctcttcaaaaccgcccacgcacgtgctgagagggagggaatcggataatacggacgaaaacaaatgtgactaaaggaaaaatacaaatcttttaattaggtgtagataagtatatgtcaatgttatttttcttcagttgtatatgtcgacgtgccttgcacgtgcacgttcactagtagtatgctattttacctactctaataacatttgtctcgtcttcttacaaaaccatcataatgaaaagttttctagtcaaaaccatacatctaccgctactttcataacactttttcacccttgttgtcaaagccatacatctaccgctactttcataacgttttttcacccttgttgtcccagctcgaaggattcactgtgccaggtaggccagggttccccgacgcctggctttttccaatgccttacacttgtctttcacagatgtgaattctcttcttagacatgtgcacaacaaaaaactatcacacttgcaaaacaaataacttttgaactttctagtcaaagccatacatctaccactactttcataacactcttacacccttgttgtcccagctcgaaggattcactgcgccaggtaggccagggttccccggcgcctggctttatccaatgccttacgcttgtctttgacagatgtgaactctcttattagacatgtgcacaaccaaaaactatcacaaccaaaaactatcacacttgcaaaacaaataacttttgaacttgtaagcaaaaaagaaaaagagtgatagcaatccgttaaaaaaatttgtttcaatgatttttttactgtagactattattactaataatagtagtgatattccactctaaccgcttgtccctacggattcaactgacactcatgtagagtgttggcatactaagattcgtaaagtaagacaatatttaagaggttggaacaaacagactagcggtatttataaaaaagagaaggtttggtgagaaaaaacttaattttgttggtaaaaaagttttgattttcttgataaaaaaacataatcaacttatttggcttattataggctttatttgaggaagaggttatcctatttgataaggaagaggaaattaaatggtatcaacgagctcggactaaaaatattttggaatggtactcgaatactaaatattttcatttggtagtaaatgataagtatagtaaacaagcatttcttagctacatgatggtgatcgggtaattaatggtgatgcgaatttaaaggcgcatatcaccatttattataaaggtctttttggcccttatgaagcttcttctttaacgttagatgaaagccaaataagtgatattccccaggtttcttctttaacgttagatgaaagccaaataagtgatattccccatatttctcaataagagaataatgctttagtacaagatttttctgagaaggaaattagagatgcgacttttcaaatggaacataataaagctccgagttagaatggattcccagctgagttttatcatgttttctggaaagtaattaagcctgatttggttgatttatttaatgatttttatagtggtaatttacctctttactctcttaactttagtactgtcacgccccgaactagtcccgaccggaactagcccgtgacgctccaatttaacctgttaatcgataccagtcccaggaaacagtgctggtatcacagggagacagaagatcacagcaacagaggtctctttattatagagtagaagtacagtcatgttgggctgcggacagatcccgagctcacaactgcattacaaaagggaaacggaagccaggacttggaccaaacacacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggagtactcagcaagccatgggaattaagtgtttaatgcaggcttcaaggaaaggctgttgtttttgcaattgattttatttgaactctttttctaaaacaactaggtgagtgcttctcaaacgacacggatgagaccgtgcgtctcgtccggtcggagtatgtgcaatgtgtcagttctttagaattgagacaaggttggcacccggccaacagcttttcaaacggccacccgggccaacaactttccaaacggccacccgggccaacaacttttcaaacggccacccgggcctagctgattccatcagctaaagatttttcaaacattgaaccccttttcacaacagtaatttcacaagcagtagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcaaccacgtcgggagacctccaagctttcatgacaaggcatttcgaaagccgacacaggtttaccatatgccaacgagaggggtcccagaccaacaacaggttaggtcacagaccatactgtgccaggaagcccaggggtcctccccgacaccaccccggtgaatccacatgtctctcggcatcaaggctcccccgattagcaatttactcagccaggggcgtcccattccaccaatgtggtcgtacttgtcttatgttcggatgaaattccaaggaaacggtccttaggtgcaagagcgggaaaccgtacacccggtacgttccccggtccgcggttatggaaattcatttagttcgcaagcaccgacccaggtgtcgggtttttccaagtcttttgtaaaactccagttttacccaagttgttactcagattttaagtttgaaggcgaccgtcgatactcgcacagagtgcacgagtatcgaggcgcaactgggtggttacaaggggacatggtatagcaattaacaaaggaaggatcaaatgcgacaaattaggtaggtccgccaatctgccttgcagacgggacaaacagattaagtgcgatcctatcaattcataatattttgcaagcaacataattaaatttcaaatataggctcaagatgttcaaaggtggcttgccttgcttgagatctggagcttgatcctcgaaatcctcgcactgcgggtcttcgggctctgaaactatacgcgaaacggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaattaaatcctttttggaaaagaaaaagaaaagaagggagagagggaatatagacttttctcggacggctagggcgcggcccaagagaaatggagcggtccggccaagctaaacgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcgcgcgggcggggaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggccgcgaatggacggggggcggcggcggcgagcggcggagcgaaccacggcgatacgggcaacagcgagcacaccgggcggttgcacgtgacaaggagaggcgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcaggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccgaggaagaggaagaagagggcgcgcccggagtccccttccgcgtccacgaacgcaccggctctcccagcgcttggcgatggacggcggaggcgaggtagagcacgggagcggcggcaacggtgaggaggcgaatgggagaggaaaggaagggagggggaagacgggtttaaatgggcggcaatgtcggtttgagagaggggaaccgacatgggtggtcaagccggcgagctggcgctccggctagcgtccaaagcggcgacaggaggtgacgccggcgagagggagaaaaagaggaaaaggagggagagaaaggggctcgcccctttgccgattcgggaaaaggaggaaggagcggggcgactcggcagagggagaggggctctctgcctccgccccttggaggctagcgcgcggagtggcgggggccaagcaatgacgacggcaatgacggtgggatggtttggagcggc

SEQ ID NO: 61793 - DNA, 15638 bp, Oryza sativa
ggggccgggaaagagatgggccgagcggaatttggcccatcgaacccgggggaggcaaactagacttttgcggagggattcgatttggaaggaattggattcggaattgaactcgacgatagatcggggattgagatcttgagatggcacggacactagacaacaatcaaagaaacaaatttcgcaattagggttttttggagataattttcccgctaggcgccacgacggaacgggcgctacaagtactattattttactgccaattgcaaagaggctttgaaaatttaacaatatatgcctatttgtttacttactgtcagtttcaaaatttttactaaaattgctacaaatagaatttctggagtggctcaaatggttattagtcctacacatatagcttttatacctgggaggaatattatggagggtgttgttattcttcatgaaacgatacatgaattgcgttgaaaaaaaaggaccggtgtactttttaagattgattttgagaaagcttatgataaagtaaaatggtcttttgttcaacaaactttgagaacgaaggggttctcgcaaaaatggtgtgactggattgcatcttttatcaaggtggacatgttgacactaaagtgaatgaccaagtgggatcaaatttttaaacatttaagggtttaaggcaaggggatccgttatctccaattctttttaacatagttgttgatatgttagctatattaataaagagagcaaaagatgatggtcaaacttctggagtggtcccacatctggttgatgatagtttatctatcttacaatatgctgatatttttttagagcatgatttacatatagctaaaaatataaagttaattttaactgcttttgaaaatttatctggcctggagataaattttcacaaagaatgaattattttgttttggccaagcaaaggaatgtcacgagcaatattcatttttttgggtgcaaactaagagattaatatttacatttatagatacccatgtagccaatattgtgtggaagaatgaagagtcacgcattaaatccgataaagttattaagtggattggtagttggattgaaatatgcctatcaaaagtaaaattttcagatttgaaaatatgcctatcaaaaataaatggaggtagtaacttcctgtttggaaaaagaaagaaaaaaaaaagcacacactttaagtagtatgtacatgatgctacatatatcaatatgctacgcaagaagcgtatatctatgtagctaaggctgtgtttagttcgtgtgccatattttttttaagtatacggacacacatttgaagtattaaacgtagactaataacaacacaaattacagattccgcctgtaaactgcgagatgaatctattaagcctaattaatccatcattagcaaatgtttattgtagcaccacattgtcaaaccatggcgtaattaggctcaaaagattcgtctcgtgatttacatgtaaactgtgcaattggttttttttcatccacatttaatgctccacgcatgtgtccaaacatttgatgtgaagaaaaagttggaagtttgaagaaaaaaagtttgaatctaaacatggcctaagataataagctaacctagattctttccgagttgtacgaaagcacaggtattttagctaatctctactattataaaaattaaaaatgtttttgtcggtattttggtacgtcatccgtgtatgagtcggtttttaagttcatttgcttttggaaatacatatccatatttgagttggtttttaagatcgttcacttttggtaaatacataaggaatcatataagaaatctgtttaagaaaactcacatgctaacttgagacgatcgggctccagcgaactcccacagtgaatttcattttaactaaaccatataacaataataagtgtcgacaagtgatactcgtagaccggatgattagggtattgggtatgttggaacgaggatctacgtaatacgacatcaagcaaacaaaagacaaggattatactggttcaggccctttatcaggtaatagccctagtctagtttatatgagattgatgatggaaaaccacaggttacagtgtaagtagtttcgtaaactactcggcgacttggctccgtgtactccggctacgtaaactatggtgggtgtgctggcgatcagattcgatgccttgtacccctcgctggggtcccttttataccgtggattatcttaaccctcaagtaagacttgagacattggatcttgtacattataatagaaactatatcccttccaagtagaattttagaaatcggttgactcgaggagatattttccataatttgtaatagattccaacaatgtccacgggaacaatccgtatacgtgaaagtatgccatattcatatattccataagtcgtaggatatgaggtatgccttatctgtaaccttgataataagattaaaatagacttcatccgttgcaacgcacagatattttttctagttatataaagaaataaaatcccaagctaattaagcatgcagatctatatatattgttattaatttgtcatgtacggttaacttgactgtgcacaaacacatgcatcagcccaataatctatatatggagtagaaaactaacatatcctataatattatacaagtggtcttgcttagtgtagttattacttattaggatttttctgagccgtggttagccacgtcaccctttttttccggtcgttcaatcaaatgctcaccaaccgttcgattgcaatccatcacacagcgcacatacttttgcctcccttcgctcgcttctctccttcccccgtccctggcgcactctgctagccgcgccacgccgcttctcctccacacccccacccccgccgccccaggtcgtacagacgctgccgctccgcctccctctccccggcgattctttctccacgcccaccaacgagctcctatcagagtatcaatcattaacctcaagttaaaagggcatccatcattgttttcttcctcatatcacagttcctcaaagacgattcatcgtcttctgacctcttcgctggaagctccagattttgcaaacctcaaatccttccttgaagttgatacatcctcatctgaggagtctggtctccatttcctgtcaaatcatcctgctgcaactgattagaacctctcttaattaaacagggagggtgaaatccgaccactggcaacaactctagcaatcagtggcatcaccaatgcatcgctagactcctgatgtcagaaagatgcctcctttgttcgcaaaggactaccagaagcccagctccattgccgccaccatggcatggattagactccaaacttctctgatctatcttgaatctagtgccacttgatgacacttgaagttgcctcagctctgatctggatggcaagctctcttgtagtagggcaaaggataagggaaaaaatttcattgcaacaaaaaacaaaggaagccagaatattcagaacattcaaacatattactattgtatagcatgcttacatatggcctgaaaccaagttgcaggaaacaagagaaaattaatgcatgccttgaaacgtttgaaactagagtatttcattgcaaaaaaaaaaaaacgaagtcagcatatattattgctactaagcaaatcacatttttgtgccaaggatttaagaccggaagtgaattatatgaggtgacgccatcaccgatccctctgtaatttgcttcttcagcaactcctgctcctggatggcctccggataccctgtcgaagcaaccttgatcttgggatccaagtcttcgcagcactcgagcaccttcctgtcgtacagggatacatcctctaggttaacagcagcttccatgatgtgcctgatgtatccaaggaagttgtcatttggttggaaaccatagattgtgagcttcgtcaggttgtaatgcctaaaaccatcaggcgcagatgactcccactccacgtctgttttgtcacagaagccttgtgcttcccgttccacactgtctgtctccatctcacaccaatggtcccaaactgttatgcatagctccttcaggacaggtgcagcttcaataaagaagcgtgtccaagcgatatcacatccttcagggagttcatccagattcagaacttgcagattccgaagaacatgtgcaagcagtttcgggcactctggctgaacccaaatctgcaataaaagtaataatggaagaatgcagattaagttgagaatgatgaacaaataacctgctgaggacttgcttaaagtaattaccttttcgctcaagaaattgaggtgcaggtctcttatggaaaggacattaggaaggaattgacttaacctgataaccttctgccatctcatgctttcatcagtgaggcttaggctcgaaagcaacgggacgttgccaaaagacaagggttcttggggacagttccacagactaaaaacaaggcgtttgaggtttggtagggagctgagctcaactagttctaagcccgcactagagatattaagctcaacaagccgcgggtgttcaaacttcatctgcaacacgctatcctctgtttgacacatggacaaacgcagatactctagccgtttgcatgtggcgatgatgttgagaatgtcagtttcagcaagccttaagttgcgtaggtggagacgcgtaaggccggcaaatgcatcagtacaggcaccaaaaaatgtcatgagctgcttgccattgtggcggagatcgtcgatagagcaatgttgtgcccgcttaccagtcagaatactgaattcagcgctgtcgaggttgtggctgtgggtggccattgctcgggcaacagttttgccaatggtgagacaatcatagtacttgaggtagaagcatatggtgagttggcgaaggggaatctcttggtttctgaaattgaggatgttgtctgttgcatcagacacagcagcgttcatctgaatctgaattgcgtccttggaggtggcataataaccataataatggggcacaaaggaatcaaccgaaatgtctaaatttgagagcaaatggcggaggtggatcgtcctcttggaaaggaggcaggtcctgacagcatcgggggttgacaatattactcccctagcctcacaaataaattcctaattcctttatgatacttcaacaaaacagttgcctcagctcttagctgcatgtcaagctctcttctagttgtagggcaaaggataagggaaaatatttcattgcaacaaaaaaacaaaaggaagccagaacattcaaacatattactattgtatagcatgcttacatatgccttgaaacgtttgaaactagagtatttcattgcaaaaaaaaaaggtcagcatatattattgctactcaacaaatcacatttttgtgctgaggatttaagaccggaagtgaattatatgaggtgacgccatcaccaatccctctgtaatttgcttcttcaacaactcctgctcctggatggtctccggataccctgacggagcaaccttgatcttgggatccaagtcttcacagcactcgagcaccttcctgtcgtataaagatatgtcctctaggttaactgcagcttccatgacgtgcctgatgtatcccataaaattctcatttggttggaaaccatagatggttagcttagtcaggttgtaatgcctgaaaccatcaggtgtagatgactcccactccacgtttgttttttcacagaagccctgttcttcccgttccacactatctgtctccatatcacaccaatggtcccaaactgtgatgcatacctccttcagagagggtgcagcttcgaggaagaagcatgtccaagcgatatcgcgtccttccgggagttcatccagattcagaacttgcagattctggagaacaggtgacaacagtttcgggcactctggctgaacccagatctgcaatacaaagtaataatggaaggatgcagattaagttgagaacgaggaacaaataagctgctgtggttaaagtaattaccttttcacttaggaagctgaggtgcaggtctctaatggtgggggcactagaaaggaactggcttaatctgataaccttctgccatctcatacttacatttgtgaggcttaggcttgaaagcaatgggatgttgccaaaagacaagggttcttggggacagagccacaggctaaaaaccaaccgtttgaggttcggtagggagttgagctcaactagttctaagcctgcactagagatatcaagctcagcaagccgcgggtgttccacctgcagctgcaacacactatcctctgtttgacacatggacaaacgcagatactctagccgtttgcatgtggcgatgatgttgggaatgtcagtttcagcaagctttaagttgcgcaggtggagacgtgtgaggccagcaaatgcatcagtacaggcatagaaaaatgtcatcagctacttcccattgcggcggcgatcatcaacagtgcaatattgtagcttcttatctggcaaaataatgaattcagcgctgtcgagcttgtgggtggccatggctcgggcaacagctttgccaatcgtgagacaatcatagtagttgaggtagaaggttatgctgagttggcgaaggggaatctcttggtttctgaaattgagtatgttgtctgtcgcatcagacacagcagcgttcatgtgaatccgaattgcatccatggaggtggtataataaccataataatggggcaaaaagaaatgaagcgaaatgtttaagtttgagagcaaatgtcggaggtggatcgtcctcttagagaggaggcaggtcctgacagcgtcgggggtgttgaggcggtccaggatgttgagcaagacatcatcaggaagcttggtgaacctatccaccactggtaggtggttattgtgagctgctgatttctgcatcaatataattgcgaaacaaaattaaaccgtgcatgcatgcagacggcaggcatacaaatgcaaagaaacaacaacaacaacaacaacaacaacaacaacaacaacaacaacaacaacaacaacaacaacaacaacaacaataataataataataataataataatatagaaatatacaagaagtaaatagagaaatgaaaaaaagaagaaaaggcaagcggcttacattgcggttgcggcgactacccttcttattcttcatggtggtggtgtaagtagcttaggtgatggatggattgggtaacagtttattgggctattgcgcttattgtttgaggtggatagtatgaacgcgaacgtcagctcctccattatataaggaggaggagccgaggagaagaccgacgggcaactactcatcatccgtctccgtctccaaaacggaggacgactctggattggagtctggattgggattggaggaggcacaagggcacaagggcacagctcagggtgcgcctgcgccatgaccatgcacatactcctagctagcttgccgtccgtctggctttaatttgacacatcctatacggagggctttgcctcctttcagaaattttaaaaatatatattactccataattgttcagcacagatactactactctctcactcaatctatctgccatctttcagtaaaagaaaaggaaagaaatgcaattgctatttcctgattcgaatcccaggtacatccttaaggcccatcttcagagcagttttcctgtacagtgctggaggcttttccaaaccgatggatttacagaacctgttcgctaggtcaacaagcatggtcttgtctcttccaacatcacctattgaattgtagtagccaagccatgcgtgatatgctgcctccttgatgctcatatcaactatctttattgaaccatcaacctgcattacaaatggaacatgcatgttcgttcaagctggagatacaattgacaacgaatgcacaccgctgtaggggggaaaatgtcctacttatatttactcaaatccccatagacggtgtaaaatggttatactaacagaatggaatttaaaatgataaaatggttattcgtacaaacaatggttcaaacagaaactaaaatggtatagttcatagcatatgtcatggttagtgcaaaatctatgcaacagcatttagctataacttatgaatctttagattagactcctatccataagcgatatataagtcccaggctaattagtgccaggctcacatcaactgttttttgaacaccatagtacgtctctactcattcaacctaaatacaacgaatcgtatcaaagacagtaaacaatatggcatggaggctaatgcagtctgcaaaaacgaaacatgacaaaagcaatagtgctaggaatgctggttattttgtgcaaaagtaagaaaaatattcctccaaaagaacgtatcaaagcaaacaaagagaaaaagaggagcttaaactagctatcacctatcagtagttcagcctcaaagtagcaaatttggcggggtacaagacttgtatgcccgagtagcagtagtgatttaataatatctagctctgataatatgctagctcatgctgcactaacagaatagacaagttaaaattagctcattcgaacctttcgtttcatctcctcgtcaatgtttggtgtttgagacttctgcaccgggagatcatgtatctcatttaagaaatactcttcccatggcgcaagcaaaagaatccctttaccagatttaccttctcttccggtccttccaagtcgatggatgtagtgctctctatctgaaggaacaccaacctaaaccaaaatagtatatatgttaaaatagtaattgcagtgaagaagcagccatacaatcagctgcagagaggtccactacagcagttgcttttgcttcagcaaagtagcaattctgtcctgaactttcacaactacatttttaaaagaaaaaagactacctgaatgactaaggtgacacctggataattcactccacgtgttgaaacatctgaggtcaccagaatcaagcgactagaatctcgaaattcttctgatatccgagttctatagagctgaggctttcttgaatggatttctcggacatttagcttcaaatctcgaagcattatatacataaattcagtcaccatggcagttgtgcagaaaacaatcacctggaatgagaaaggctaagtaagtttatcatattttaattcttaatcaattgtctggtcaaaagagagggatgagagcaccttatagtccacttcctgatcaatatgttctcggagaaggcgataaaccatatgaaaatgcagctcatgtggcataacgagatacaactgctccacctaagctcaagaaaaccacatatcaagggatcagtaagcaactgaaaaattatttccatgggagaagataaaaagagactacgcagcaatattttacttttgagctaaaaatcattagaaatatagtttatatgttatacaaagtgtacaaatgtatcaaatatccaaatggtcgacacaatggcaagaaagacgtatggtctaggatatctgtttatgtgaatgtctgtatgtgtatccatggaaagcaaaagtgctgaacaatgcagagctaatggaagtcccttccatagatgcaataatgcaatgggacctcttttaattggcacattaaaataaatgctaacagatgctctaggtaatgcaaaccaagaaaattgatcacatcacatttctgtacttgcaggagtcagaaaaaatgagcacattgcagatgagaaaaatcgaagattaagttgatatgcagtactaaatatactagagtagaactggaaagtatagaccttagtaggagtttcaacagctcccaagcccactgtatcaacaaaaacatgatccctttttaaaactagctgtgaaacccttcgaacctgtcattggcaaattcagacatgtggttgtcaatcaatacagaaatagatagacaaaaatttacagaatactagtgcttttgcccatgctgatcacagtacctcctttgggattgtagcagaaaatagtagtgtctgtctttgacgtggcaaactatcaacaatcttttcaatgtctgtacggaaacccaaatctagcaaatgatcagcttcatccaatacaagcaacttcaatcccatcaagcgaacagagaatgaagatttgttctcaatgtgatcgagcagtctaccaggtgtagcaactaaaatcttcaagggggaaaacacaagatatagttcagacaaacgacaaacatcagcagctattaccttgatctatagtaggtcagtaaacattacaaacctggcatggatcagattctaaacgtctttgatctagcttgaatctagtgccaccaataagagattgaacaccaattccttgatggtacttcaacagaacatttgcctcagctgtgagctggatggcaagctctcttgtagggcaaaggataagcgaaaatattggagacactcgatgatttgtatggctcttcatagcattcaagactgattcaattgcagggagctgtttatcaatacatttatgaataaattggttgaaggaaccaacaataaaaactaaacatctcaaagtatctccttgcaaaatagtattaccagaaaagctgcacttttgccagttccagttttagccttgacaagaacatctttgcctggatgcatacagtgatgagtgaggggcaacctcttgattgttgaaggtttcagtggtaacatgttcagataaatcaaaagataaaatggtgccacaaggtgctaactgctaagtagtatgtgtggaactactgaagtgagtaacatggtcagtataaacttgtgttgttagtagcacatattcgaatgaaaataaaaaaagaaagtaccttcaagacacataggaagtgctgtttcctgcacaacggtagtctgtacatatccagcatcagtgagtgcttttactgttaggggagagataccacattcctcaaatctgatgtcaacgaaacaatagggcttattaatcacatagtaagtatctctgtttcggagcatgctaggaggaatacactctctatttattatggttaattcttgctgtagatcagtgccataaaaaatgaaactccaagaagactatgtgtagcaacttcttagttcatataccatgatcggtatgtttcaaattcttttgttgttttgcctaaaagttcataataacaatacatatatgatgttctaaagctaataagctccagaacaaataaatcaaaactacatgagcaaataggcagcaatagaaggtaaactaaagtgtaaccttttattggtaaacaaagattcgcccctcgactcgtaacgcctccgctcagcacccaacacttccctgttctttatctcctctcgcagctctcggaagctaccagcgagatcgttgttttcttcctcataggacttgagcgctctcctctccttcttcatatcacagttcctcaaagcagcactgctccatttcttcctgatggcacttctcgcctccaattcatcgtatcctgattcctcctcactggatgctccaaacctcgcaaacctcatatccttcttcgcagttgatatatcctcatcatcctcatctgaggagtctggcctcaatttcctgccaaatcgccctgctgcgaacgagtagaacctctctccattcaactgcgagggagcaatccgagcactggcaagacctctagcaatcagcggcaccatcgatgtaccactggactcctgatgcgcctggaacagaggcatcactgagtaggatctcttgggaccgaagaaacagaaggatgcctcctttgttcgcgaaggaatggcggaagacgagctccattgccaccaccagggcgcggccgtctggaaatccctcctaggattgaacgcagccagacgcggctccttcccacccctcggtagctcctgctttgtagagtccaacttacggcggtcgccgccattcccgccaacggagacgatcctcctcggcggccgcggccggtcggcgcggtggatgggcccgtcgtcttcgttccagagatcctcggcgccgggcaagaggaagcggtcggcgagggcgcggatgtgggcgcgcgaggaggtgggcccgtcgccgtcgtcgggaggggaggcgccggcggcgggcaggcgggaggcgcggatctcggagcggaggcgggcgaggtagagctgcttctcgtggcggaggagcccccgctccttgtgcctcgcgagcttctcgtgcatccgcttgtgctgccacttcgacagcccgcccgggaacgtcctcggcccgccccccatcccaccggcgtcctcgtcggcggcggcggcgagaagcagtagggtttatcaatcaattatcactcgctgggatttttcccctatccagggagggttttgacttttttgactctgacaggtcgccgtttccgccttctgagaatacgtttccgccttcgcgtggggtttgcagaaaatgggtaccaactgaatcctcaactcgcagatctctcgcggggagagcagaagcagagatggagaggaagcgtgtgctcgtcgtcgggggcagcggctacctgggccagcacctcctcgccgcgctcgctgccggcggcgaggtcgacgtcgccttcacccaccaccgcgacaccccgccgcagccgctcctgcacgcgctccccgggcttcgcgccttcagagtagacctccgctccggcgatggcctccgcgccgtctccgagtccttcggccaggtacctgctctacgtttcccatttcaagttgtgatgctactgctagtcagaatgtgcgttgctacttcactctctttgcagcatggaaaatgtaatatgttcttactgcgagaatcgaatcgtttcctttcctatgaaaatccctgcaaatgtcttatgaaattgtgtagattttagaattttctagagctaatatttcaaaaggatggaacacttgacacaacgcctttgctgtatccagtttggtggaatcttgaagtgctttattactaaataaataatgtatgagacagaccgctttattccttttctaaatggagaatttagactatttaccatcaaattcacgttccttaatttttttaccacctaatccgtatgccctctataatatgtcattaggactgctaattagcctatttggtaacactttatctatttttactgtatttttcttttcttaattttatttgtatatattttcaagatttgtggacatttttaccctggacccacctgtcagatcaaagagagatactctgggtctagatcgattcgctccctccaggcgtagcgccaccgccgccgccacacgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcatcatggtgagtgagtgacaagattcattggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcgattggggcggcgagcttgcgcaccctggcggtggcagcgttctgcggcggggtggtggggcggcgccgctcgggggcggcaagctgggggcggcgctcggtggtggggcggagagctgaggcaagtggcggcggcggcgatcggcggcggggtggtcgcggtcgatggcgccgatgccggtcgggggcgttgcctggagggatcgatcgatacggagaaatatctctcttttggatctgacaggtgggcccgggggcaaaaacgtccataaatcttgaaaaatatacaaatagagttaagaaaagagaaatacgaaaaaaatagataaagtggtaccaaatagactaattaacagtcctaatgatatattatagagggcatgcggattgggtggtaaaaaagttgaggcacgcgaatttgatggtaaatagtctaaattctcttctaaatgagtttaattaccatgttcagccgcatgtgattgtgaactgtgctgcaatctcggtacctcggcaatgcgaaacggatcctgctgctgctatggctactaatgtaccttcatcacttgtcacttggttgttaagctttgggaatgacaacactcttcttatccatctctcaacagatcaaggtgcactgctctctcaactctcatccttgataatctgacgctatcgaaactcttctgcaggcattcatttttttcgtttaaaagcctagctagagacaaccgaggatcttatgaaaacccagagtttataggttacttgctaatttatgcatttgtggtctatatagtaaccagcaagtgtaggaaattccttcttttgatcttaccaagtcactctcttgtggtaccagtttacgagggagtaaaatccttctacaaagaggatgatgagaccttgccagtgaacatgtacggaaaatctaaagttgctgcagagaagtttattattgaacaatgctcaaactatgcaatcttgagaagcagtattatttatgggccacaaacaatttctcctgtggcaaaatctcttccaattcaggtatggttaaatgactaatctgcagcagctacaatacttcctccttaaagcaagttaaacttttagtcttatcatagttgtttagaaataagaactacacctcatagattggattgtctaactaaaaaagttcttcctctgtatgcagtggatggatagtgttctttcacaaggccaacaagttcaattctttaatgatgagttccggtgtcctgtttatgtaaaagatatggtggatgtagtgttgtctttgacaaaatcatggttagcaggtataaaaaggttaccacatagtgatgttattgtctttttatttgacaatttttaaaatcattatttttgcctctcgaggaacgactatttctcatttattggctccattgatgctgaggtactgacatcaaagcacatgctgcagatggtaaagctgttcaagtactcctgaatgtcggtggaccagatagagtctcaagactgcagatggctgaatctgttgctgatgttcgtggatatagtcattctataatcaaatctgtatctgcttcatcggtattaatcttctccgtgggtcacagtaatcaagaatgcatatttgct

SEQ ID NO: 61794 - DNA, 2443 bp, Oryza sativa
tgattgtattttaaaaattaggaattgagctatgaaaaatccgagcaaattctagagtgtaattaacctcggagaatgtaataaaaattaaatccagccacgttttgtttaggaagttttactttacaagcaaattaatgcaaattaatgtacacttcaatataaattctataaataatttataaatcaccgaaataaaaattaaggtgtgataagcagtcgtagcagcagccgcagtagctgtgcacacaaccgtttgggaccaaccaccgcaaacatataaagaaggaggctctccttagcaaagcgcgagtcgtggccaccgggagcagcctagcagacgctaggacaacattaccagtgcagaccactcctctaactataatggaatacccccgtcgtttggtgcatgctgctctttctcaggtagaggttatcatgaccttgaatcgagggtttgcggacatcacccaacagctgagagcgagtataatagtgagctataagcctactataaatttagatggaggagagatagtgaaaaattaagagtgttggagcttatcataaacttcaaaacaattacattaaatgtataagaaagagatagaaagaagagaaaaaaattatagccaaccttatagctaatatattatatatgttgactttaaaataagctaatagtaagaagtgagctgtactattagctctgatacagcttgatctctgaaccgaccagaagcagaacccaccgaacagcatgtccatgagacccacacatggcagcagcataccgatggccagtcggtgaacatcagcgccaccgtacagaaaagtcaggctaacatgttggcctttccagtcaaagggattcaatccctagcttggaggaggatccccacactaaggtaatttggatatatatttcaatgcattgcatttaaaaagaaaaacctataaaaatttgcaaaagttaaaaataccaaaaatatgtgctttccatattcagtaaggctgtgtttgctccttcgggttgggaaccatctctaccacacaaaaaacgaaacggtgcattagtgcgtgattaattaagtattagcaattttttttcaaaactgaattaatttgattttttaaagcaacattcgtataaagaatgtttgcaaaaaatgcaccgtttatcaatttgaaaagcatacgcgcgaaaaacgagagatgtgagttgggaaagcgggagaaagaactcagcctaagaatgctctagttctaatagttgaaataatgaatagtttctctattttgtttcctccagtgcttagtttataacttagtctttgcttaagtttttgagtttgttggataacaatctttgtcttgaacttgaaacttgtgggttgcacacgcatgatctatgtctaaattgttacgggatatgagatggtgaaatagagactctatgatatttctccaagcgatacttgaactccggagtccttattttcaaaagaatgaaaaatttgtaagttcctcaatgatgaaaaattcctaccaaaaccatatgatgagtacaatgaaaaaacctttacaaatatgctacatgttattgcattgagttttttgaaattgttgtgacccttgtgagattgttttcgtactttattaatcaaggtcacacatgcgcacccaccatatatgcttgacctctacattggaggttagcaaaaaatgtcatacacccaccatagttgttttgcctctacactggggattagcaacattccatctaccaaataaatgctccatttatgtcagtaaaaaatgtctcacatggtagtttgcaaaagagatgactgtgatagaagaggaaaaaaaagaggagatagaaaatagaaaatgttctcaagcattatgagaaagaaaaaaaaaagaaaaaggagtgtatgcgcacgattgttcttgagcagcatgggacaaaaaatagaagaagaatagtcatgtctccgattaggaataaaagagagtctatgacaaggattaccaccaaacactttccaccatatagccacacagttgcacatcttgatcacatggtatttgtgttctccatggatcctctttttgattttgcaatatatgtgtgatacaggtattgcctcatgtttttttccaccttgagctcgacatatgatccttttatacgtaggatgaaaacgaggcaacataatgcattcgtgaggaattatacacattaagtgatctgagagtaccatttgagaaacttagattttatttgcaaaattctttataacctccggaaagaaagttgaacaaagaatactcgaggactaagaaaactattataattctactccactggcactagaacactaaactaaactttgaagagagcttgattgttgacggtccttaaatcataatatct

SEQ ID NO: 61795 - DNA, 4413 bp, Oryza sativa
tttcaataaacactgacctttgacagtttgttaatcacatagattaaattaccaccttgatttcacaaccgcccccttgatgaacacattggccatattttgaaaatgcaatttgtgtttttgaaaagaaaaaagaaaaataaaaaagcacaaagactgaaaaataaaaaaaagtaaaaaagaaaaatctccccatatttgcaataaaagcacaaaattgactattttttaaaatcgaaacaattctcccctttcaagaagaattcattttgtatattttcctgcatgtctaatcgtttagtttgatccacataatatgaatcgctctagtttatccggtacccgttgataccaccacactgtaaacactgagtgctacctagaggtcacaatgatgtctttatattatttattatctactccttgcatgagcatgacgagtgttattccacactaaatgtagaatcttaatgccgttaggtttggggggggggggagggggagggtaccaacataacgctgtaggcgaactggtacagttgtcccctttttaatgccaaaatttggtatgattctctagtggattcggttaatgatggaaattgattggtagatgaaactttatccagatcaagctgaattcaaataagaatcgtgaagaccgtgacaaggctgtttcatatttttagtatatatcttaaataggcaagattagttattttcgttttcttgttaggagtcttatctcgtgtccaatcaggacttgtatcaatccaagggtataaatatgtacacccggggtttttgtaaactatctcttgatcaatatacaacttttggtgcatcgccaccttttattccgacgagttgttagtttcgagcggggttgcatcggttaagtttgactccggcaagaggtaagttccatctagttcgcctgtatcagcgtggctagaacttccacggttaggttcgatattctattcaagttaatgcaagtcttgcctatatgatatatcgagtctatcttccacggttaggactttcatggttaggttcgatattctgagtaagttgatatttctctaattaaattgttgttttagatttatcgatatagatctgtcggctaaataggtttttcttattatcttcaatcttatagtgtctcggttaggtttgatctatcatattgctgctaataagtttatttctattaagctaataagtttttatgcgatgtttcatcgaagttttagctgatgagttatcatgttactatttctaagtgttgcatccgctcatattgatgatcatacatattttggttctagccgatgatagcatgaatgtcgacggtggatacccgtagaccagatatagagggtatcggggtacgctggtatgaggatctacgtagtatgacatcaaacaagcagaagaccaagattatactggttcaggccccttgataggtaatagccctaatccagtagatatgggattatatgatggaaaccacagattacaaaggttgcggaactcgatgataccgacgagaccgtaatcgagttggttcgactagatcacccgatgacttggctcctgtgggctccgactttgtaggctgaggtggatgtgttggcggtgagattcgatgccttaggacctcccgggggtcccttagagacatagagttatcgataacattgtacgaagttcaacggtcatgagtgaatttaaattgaagtctgaaaactgctgcgcgtaacggacccagaaatttccggcggccatctctctcctttccttggactacgcaccgtcggtaatgcgcttatttaaaggagttttggggatctattttgaagttcgtttgccgcagaactctccagccttcaagcgcccctcgtcttctccgctcccacagaaaaaaccctagtttgctcatctcagtttgttctccggcgatctctagcggtgttggatcttgataagtctacctccactaccgcgtccttgaagaagctgcaggacgacggcgccctccctggtagcgggaccatggagagggaagcaggaggtattgaacctgaacccctcctgggccgcatggttgcggttgaggattatatttcttgcggttttcttcctccgccctccgaatttcttcttctcgtattgaatttttatggcctttccttgctccatctgaaccccaattccatcgcattcctcagtatcttctcttatctttgtgaggcctacattggggtagagccattccttgatttctttcgtttttactacgagttgcgctggatggaatccaataggatatctggatgcgtcggattctgacttcgggatggcgggcatccccttctagtgcccctcttctcgtagcaaatggcgggcgaggtggttttatcttcagatagaaaactcggatccagtctttgttgtccctgaggagcaaccagacaagattccggaatggaccgccaaacccgccctaactccctcccttcagtctttcatcgatatcatcgatgacctctgagtacgagggttgttggggtatgaagttgctgccgacttcatcggtaggcggatccaactgctccaggctcgagcccacccggcctttgactattctgggccaaaggacgcgtcccgggttctcctcggggtatttttctcgtgtttcagatttcatttcttatgtgcacgttcctcctgacttattgagttctggttctcgatctcacaggtttgaatagcgaaaccgtggagcgccgcgtcggtaaagtgatgatcagcagccctacgatagcgagcaacatccccgtccccctttgccagaagggggtggccgaatgcgaggctgtgatcaacgtgagtatacttgatgactcctttatttctgtcatcctaggatcgcgtcgtgacttcatgtatgcaggctctccctctgacggatgtcatcgggccgcttgcggaccatcaggcggcggcgtcattgaaagagggcgtcgccaaagaggcgtccgacgttgctgctgctgccacgacgagtggcagcaacgttccgaagaaggggaggaagttctcctccgtgcccgggacccactggaaggcgcctaacccatcggtaagcctctcttgtcctttaacacgtagtcggaagatcttgacctcacaccatgcttatcatacttaggcctcggacgcgtctcccccgccttagcgacggcaaaggctggtgacgctcagcaaaaagtaagtagatgattttgaggtcctttaattcgcaaaaccttggccgcctgactttatgaaaatcgtggaaatcattcgcagggcggcgcgggcaaaggcgacgcaagacgggtccggtgcggcctccagcatgtcccctgtggcggcctcgacagatgtcgtggtcgtgactagggactgggaggcgacgctgagtgggcccgtcggcggccttgtgcccgctcggggcccgcccgttgatgccctcacctagggggagctccaagccgagataaagcgcatcctccaggctggtgctcgcgcgtgggccgcgagatcaaggaagccagggcggcggggtcgtcggcaaaccacagcgccgagcagctggcgcgtggtctggcggaggcccgcgaggacctcctgaagatgagggagttggtggctggtaatgaatggcggcgacaagggctcgagcaccggatgtcagagctcgagaacttgtcggagatccgcagctcgctgcgggtgtcttacaccggcctacaccaactcgtcggggagtgcggcgtgacgaccactatcccggcgacccctgacgagttctcgctgacgtcctcgctcgcggacctggctgtggcgatggaggagatcccctccaagcatgcggccagaatcggcgtggagacgtgtaacgggatctacaccggggcgtgccatgtcctcgcatgcgtgaagctggcataccctgacctcgacatcaagagggttctggatcaggaggtctgttctccccctttttgaagagtaggattctgtttcccttgtaccccttaatcaacacactataaaaacttctattggcccggacctcttttatgtatgcagctgttttcctttgttttcttagcatgtgattccgagtaccttgttgtcgttgtagagatgtcgacattgaggatgtccagcagcgcgggcagcctgagacgccggtggtcatcccggcactagcgcttgagccgtacgtgccgcaggatgacgtcgatcagagcctgtccgcggaggcgaacatggcgatgacgtctttaggtttgcaccttgggctttacttccttcactcttttgttcggattgacttaatttgctgggttc

SEQ ID NO: 61796 - DNA, 11849 bp, Oryza sativa
agatcgtcggatccaatactggaggacgaagttcgaggtggccgaactcgagaggaccatggtggaagtgaaaaaagaccaagctgtggaagcactccgaggtcgcgaggtgtagtttaactcgtacctcaggagctgttgtatggcgatggctggagtctgtagggaacgccgagtacctcgcgggaatcccgaggagtcggtggctggatatatctcatggttgaatagggcctgtgctcagcttgaaggcatcggcaagcgtatcaacgaggcgctgaagcaggagtgtcgtcggtcgagccgatatgccagagggcacgtgctggcctgtatctgagatcaccgcccgtagctgcacctcgagttcctccacgaagggttttcacgttctcggaggactcccgcagagatagagaatctggcgaagtcgattgtgccgcttgccgagaatgtctttcagtccatggactggcgtttgccgtcctggtagtctttgtatcctgtaaaaattatctcaaggagacatgtaatatattttggagcaattatgaattgtaagaagtacttgtgaaatagacaaggaatctatctaactaagttttcttactctggatatgctgtgtgtgagtgttttctcatttcgcgacttcgatcaatcgcttgagtcatacactctccctagcccccagccttgttgtcggagaaacgttctcggaggataaggctccttgacccttgacctgcctcggttgaaaaagcattgaccctagcccccagccgtgaagttggaatactcggtttccgattacacgggttggttaatacgcacgacgagagctcttacatgacctgatcttacatggtcgtttgtctctacatgatccgacaaggccttatctgctctgggtgtccccagccgaagttccctgaggttccttagaggccttgtcaagacggcgtaaagggacatgagggtaggtttcaacgctaggtgtcgtcgtggtaagggatcgtcgggaagaaacactttgattgtaatctttacctgaaaatcaactttattgaagctgtaagatgtcttgcaagtatggatgctattgatttatacataaaatttacgtaattgatcaatgttccaggaatttgctaactcacaaccatcgccgtctgcaatcttgaatgcacctggccgcaagacttgcgtgatcgtgtatggtccttcccacttaggtgagagctcgttacgccctgcttggctttgaacccgtcggaggacgtaatcgccgatcgaaagcgtgtgtgctctgatgcgcttctcgtggtattggcgaagggcctgttggtagctggctactctgacggcaactctttctcgatgctcctcgagtagattcacattgtcgctttgctgctcctcttgatcctcgtcagagtacttttgtactagtgttctctcgatgtcagagcatggcttctgaaccatacatgtggaagaagggtgtgtccttgttggatgtcgtcggtgtggtacacacggcccatagcacagaggagagttcttcaacccacttcttgtcatgtgacatgagtctgtcatagacacgggtcttgattccttgtagtattatgccgttagccctttcgacctgtccattactctgagggtaagagaccgaggcaaagcagatcttgactcccagcccaatgcaataatcctggaagtcggcactgatgaactgggagatgttgtctgttatgatgcggtgaggcaatccatatctgcagaatatccctttaatgaatttgatggcgttgtcggccttgatttcccccgtgggcgtcgcttcgatccacttggtgaacttgtcgatcgccacgaataggaacctatatccgccctgtcctcgtgggaatggtccgagtatgtcgagcccccagcatgagaacggccaagtaagagggatagtcaggagcgcttgtgctgatagccttgtgtttttactgtggaattggcaggcttcacaccgctgaaccatgtcgcaagagtctttgagggcggtcggccaaaagaacccctgttggaaagctttttcgactaaggtctggccagcggtgtgtgacccgcagatcccttcgtgtatgtccaggaggagatgtttgccgtcgtcggacgagatacatttgagaagtaccccgtttggcgcctttttgtatagatcgttgccgatcatacagtagatcttgacttgtctggataacttctcggcttctgtatcatcctcgggcaactcgtcgctacttaggaatttaatgagtgggatccgccagtcgtctgtagtctcgatgttggcaacggcgcgttctgcctctgtagcccctgagctgatgtcggggacgaccatgctatcttcgtcgtttgccactttcaccaatggctttgtcaggacgtctaggaaggtgccgggttcgagtggctctcgtctggacgcacgccgtgctaggtcgtctggtttgatgttgtccttgcggtatacgtgtcggaccttgattccatgaaaccttttttccagcttcctgacttctgcgaggtacttggataactcagggctagagcacttgtagtctttgtgcacctggtttgcgactagttcggaatcccctttcacaatcaatcgcttgactccaagtacggctgctgctcttatcccagcgagtagtccttcgtactcagctgtgttgttggtcgccctgaagttgaggtgaattgcgtgcttaaactgatcgcccgaaggtgatatcaagatgtgtcacatcctgattttcgttttaggatttataaattatttaataaattattattagaatttatattaaatattcattcatttacaagagaagttaaatgtgggaaataaaatttcctaaatataaagcatggatggatttattttttattaaattctccatggttaattatactctctggaattttctcggatttttcggagctccattcctaattttaaccatacaaagaacatttcagtaattatccacatattaaattaatcattaaatggactgattattatttttttaagtactttgagtgtacaagtattttcaggatttttcttgaaactagttgaggattggaagtatttttaacaattcaaagatcatttcagtgattattttaattggaaaaagtttttaaatcctctcctaagccgttgggctgatttcagcccaacatctctctccctcgcgcgcgtgctgtgcggccgaagtcggcccagccgagctcctccttctctttctttctttgctttgttttcagccagcccaagacgaaaagtctaatacgcgtccctgctacagtgtcgtcttcaagcttggacagaagcccgagctgccgtcctgtgccctgtagccgacgccgcttcctccaccaaatccaccgcatcccgtgctccgtttgcaaaattagttgaggggaaatatttctcttatcctcctctatcatttcctccaagaatcggactttatcccgaagaaatcaacgcggaatcgaattcgttttcgagtttatctctgcaactaaccctcggtttttccggctcaaatcctctcggttggagtccgatctcttcaatccaagcctataaatagcatcccctagtcgtcctcttccgtttgccccaagtcctgagctccctcgtcgcccgtagcgccgccgccacgttgccctagccgccgccgtcgtcggtgaccttccagccgcgtcgcgccgccgcggtagccgtgtccgttgccagccgtcgccgccgttgggtgcgcacggaggaggggaaccccggcctccccttcgcagccgccgaagaccgccggagcgccgtcgccattgttgacccgagccgagccgccgtcgaacctcgtcgccggccgtcgttcgtcgtcgtcagtcgttgttctttgcaccggtgagttcgcgttgttctcctctacgcgtaggtaccctccaaaagtccggccgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcgtaactcggattcgagtggttcaagttgctaaatttttctaaaatcaagatctacatgttaaaaatatccacatgtactgtttttgcttgtttttgtactgttttgttgattttgttctttcattttagtttccgaagttccgaagagagcgttttcgttgaggaaggttcggaagtgtttgcggaagctcaaggcaagtcacacagatcccaaacaaccctttgagcatgttgaacccatttaaagctattgttttatttcaacttatgcattattttcgaatgtcatcgggtggtgagcctttcccaattaattaatggccgaagatgactttattttcctatgggttataatttgattagctagaaccttatatattggtttgggttcagctaaatgctatatatatataattacttagccatgcttagaaacattagcacatgattgggataactaatattacactatcacttatggttatatttaatggtagctcacgatggtcaatcgtgattggttaattaattattgccaattaaaatttgtcaatggtgggttgtgagcacatggttgtgaaggtcgtgctcatggcaattaagaaccggttcgcgagctactgttgtgaaacattaaccgtgccaaccacaagccagcgtgggcaacggctttaccttttgtatagcatgattcattgcggggcactagactgagaagcggcgagaagtccgtgtgggtcgctggggagtccatgtctctggttatatttatagagggggtgattatgatccaggtatggtgcactgtggtgagttgtgttgtgcagagggtattgtcatagcctctattcgggtactttccagtatcgcgacgcatggtagacatgatgttgaggctgtgtcttgtgggtacagtggtacacctctggccagagtaaaactattcgaatgagcttatattatgccatcctttggtatccttgtgcacttgcatatttgctgtgtggcttgttgagtatgtcatatgctcattcttgcaataatcaaatctcagttgaagaaaaaggatccagaaggagaagacgtttggcttataccctagttgagttgcctgtgggagtggagctgaagccatcgctagaccgttattccgctgctgttgtttttcttttcttttgtaagtatgtaacgttattattatgatggatttgtatattaaattgtcagtttgtgtacctcggctgattcctggacgaggattttatgcacaaattagttcggaaattattagtgaatttccgggcgtgacaatatgaaccctgcccctgctccttgactgttgagtgcgccatcgaacgccattgtccatgtttcgctgtcggtttgactgtccgacctattttcaggcatagtccagtcagctacaaaatcggcgaggagctgggacttgatggctgttcgtggcacaaagtggacatcaaactggcttagctcgactacccatttcgcgatgaggccgacagcatctttgtttctcacgacttcaccaagagggaaggaggaaacaactgtgaccctgtgggtttggaagtagtggtgtagctttcttgatgtcatgattactgtgtaaagcagcttttcgatctgtgggtatcttgtatttgcgtcatggagagctttgctgacgtagtaaactggtctttgcaccttctctctcgacaacaatgacggtactcacagaatatggtgtggcggcaatatagaggaataattctttatcaggttggggagcaacaagtacagggggatttgacaagtagcgcttgagtgcgatgaatgcctctttggcttcctgtgtccatacaaatttgtcttgtttcttcagcagagcgaagaaaggttgtccgcgctctcccatcctagcgacgaacctgctcagtgccgccatgcatccagttaggatttgccttgatcttctccggatttgcctcgatccctcttccagagacgaggaacctgagcagcttgcccgatggtactccgaatgtgcacttctctggattgagcatgaggcgatatcgtcggaggttgtcgaacgtttcccggagatcatcaatcaatgagtcgcttgtcttggtcttgacaacaatgtcatcgacgtaggcctcgacattgttcccaggctgatcgttaagtgccgcttggaccgtgcgttggaaagtatttcctgcggttatcagtccaaacagcatcttaacgtaacagaatacactgaacggcatgatgaatgctgtcttctcctcgtcctcttttgccatgctgatctggtggtagccagagtagacatcaagaaagcttaacaactcacaaccagctgttgagtccaccaattggtctattcgaggaagagggaagtgatccttgggacacgccttgttgaggtcggtgaagtcgacacacatcctccacttcccgttagccttgtgcaccatgactggattggctagctactctggatggataacctctctgatgaagctagctttgagaagcttgtcgagttcttctcgtatggcttgtttccggtttggtgcaaatctgcgcagtttttgttttactggcttggcatcgggtcgcaccatgagtttgtgctcaatcacctccctagggaccccgggtatgtcggacggctgccaagcgaacatgtctacattgtcgcggaggaaggtgataagcgcgagttcctatttctcgtctagtgacgccccgatcttgacggtcttgtcgaggttggcgctggagagtggaacgatcttgattgcgctgtctggcttcggcgtcttgtttgttttgctcactttcttgggtggctcagctgtggcaggtgggttgggcgtgtgttcgaccatgtcgaggctccgcatgtcgcactgcaccgccagctttgcgttcccctgaatagtgattgttccctttggcccgggcatcttgagcacttggtacgcgtaatgagatgcggccatgaacttcgcgagtgcagttctcccgatgatagcattgtatgctgtatcaaattcagcgacaaaggtgatctgctctgttcggaagttgtttgcttggccgaaagtcacaagcaacgtaatcttgcccaatggcttggacgatgactgaggagtaattccatggaagggttgatcagtgggcgtcaagtcacttcgtgggatccccatcacgtccaaggtgctggcgaagagtaggttgatggagctgccgccatcgatgagaactcgtgcgaccttgatattccgaatagtgggtcgaccacgatcagatatcgacctggggtgacagcagtcttggggtggtcttcctctgagaattcgatcttctgctcagaccacttcatcttggactcagccccttgccatgtcgaacaaacttcgcgctccactttcttgtactctcgcttcgaggagtatgccgtggaacctccgaagatgtgcgaaacatggagatcggaatttgggtatgctgagtccgagtcctgagtagctgcttcagcggccttctcgactacatgtactcgcttgcccttctccaatgcaagttgctttgcgagtgactttttgaaaacgaaacaagcttctagggagtgcttgtccgacttgtgtatagggcaccatattttcttcgtatcgtcgccttgtgagtctgggtacttgggtgggtccgcatattctgctgcgaggacttccatttgagctttccttttcccactcttgcaactcttcttcttgcttgactcaggtgtgtccttggctggttttttctctccccccgtctttggcttgtcgttattgcgtctcagtgcgtcgtccgcgtgagcgcatcgatcgacaatctcgaatagctttcgagcagttgtgatctgtcttgtcaccaactcctgggtggtgtagcgatctctgacaccagtcttaaaagcgcggatcatggaagcgttggtgatctcggggatcgtatttctgcactcattaaagcgccgaatgtagtccctcaatgattcgcccggattctgtgtcaacgcgtgtaggtcgtcttcgatcgcgtggcgcttgtatgttccttggaagttagcgacgaactgttgccacaaatctacccatgaagaaatcaagtatggtgggaggtggactagccatgaacgtgcagatcctttcaacgccgccggcaaataattcgctaacgcgttgtcgtctgcttcggcagcgtagagtactatggaatagacctgaaggaactcctcagggtcggtgctcccatcgtacttctctattgctcccggtcggaatatctcaggccatcaaacatctcgtagagcacgactgaaagctctacacccaccaccgggggcggtgggttgtcggcgattgtatgtcctccgtggatgtctgtatgacgacgaggatgatgaggatgatgacgatgacaatgagtcacttggttccggggtacgattacgaggatgacgtctgggttctcgagaatcctgtcatcgcccaccgttgttgtcccgacgccgatctccgtcgtcgtcatcgttatggcggcgtcctcgaccattatcgcctggcatccgttgtttgcgatcatcgcgttcgtggtggttgtggcggttatcacggtcttggttctcgctcgggtgtcctcctcgctcttcgttctctcgatgtcgtgaagagacgcgatgccgggaacgatttttgttgtctcgcgcgcgtcgtgcttctcggcggccattcaaatggtcacggagatcgttggtgccgcgaggtggtggagtggcttgacgatgtgattctgctcaggtagttcgccattggcaccgccaattggcggttgttctagcagtactccagcggcggtctcctcgaacgcgttgctgaggttagccacttattctcgtagtcgttctgtccattgtgcgagatcattgttcagaacgggatcataagaggtttccctcaatattgcgttgatggccctgatgtgctgggccggtgtaatcacttgatcctccgcttctgtgttagcgcgcgcagacgtgctggtcccatcgatagcaaacacatcgcgtggtgtactcgtcgacgatgtgccctggtcttcaagcaagtgtagaactgacaactcgtggggatcgatgtcgattaccccaacaaatcgatctgagataactgtcgctcctcgttccttgttcgcatctttaagagagatttgtgactgctggaccttaggaggtgacgtcctcatggcgctgagaagaaccttgcagcttgagaggtcgtgattctttgtcttgtgaatagggcaatagacatcacgggttggagaagtacgttgaattccacgctctttgcaggcacggatctcagcttgtacatcgagaaaaacccagcaagtttgcaaggtgtgtttcctggttttgtagataggacaccaggaccttgttgcctcggaagttctccttgtcggctcgtgattctcatcggaaggacaagatttggctgcattaggatccttatcgggctcaaacgtcgtcgatgttccgctctccacgtccgcgggaggatccttcgacatagagccgtccggggtcgtaaccacgacgttctcgcttccggtcattgatggaccagccgagatcggcaccgtggtgaaaactgggaagacgatttcaccgacttgagtccacaccagcattgttgaaggttaaactccttggttgatgctggtgttgacgttattgttgatgaggcttgatggcatagtagtagaaccttgagcaccaagtccccgtacctagcgcgcaactgtcgacggtggatacccgcagaccggatatagagggtattggggtacgctggtatgaggatctacgtagtacgacatcaaacaagcagaagacaaagattatactagatcacccggcgacttggctcctgtaatagccctaatccagttgatatgggattatataatggaaaccacagattacaaagggaatagcggaactcgatgataccgacgagaccgtagtcgagttggttcgactagatcacccggcgacttggctcctgtaggctccgacttcgtaggctgaggtggatgtgttggcggtgagattcgatgccttaggacctcctggggggtcccttttatatcacgggtcagttgatctccaagtaggactcggagatatcggacccttcatgatacagtgacgacccagtcttgtccgagtaggacttctctcatatgtggatactgctcctattacgtgatggatttccttaacgtgtacaggaaacatccgtatgcgcgcaggtataccttatcggtatacaacatatatccaagggtagagggtataccttatccgtaaccctgacaatgaacttcattttttatttgattatttgaatctacgtcgaacctatagccgattgatcaaaactctatcgacattggctggcctcgctgcatcacatcggcctattgtccgattggctcattgatcttgtacagtcaatttattcatcttgttagttgcaggatcaaactaactggcacgccctgaacctgattaatagggcctgcactagagataagtggatctcccaggccttcgtgtgtcgtgatgaatttcatgttaacacctctatgtggcgctgaacgttgtacgtgaggtggaacagtgaggcgtcccctcaagcggaacaatacagtcgtcccctaacaaatcataaataaatgtgaggtagaacattacagtcatcccctcataaacaacttacacagaaaaggctgatcaatgcactctgtaacaacccactttagttctttgttgcataaaaacttttttcatgtgcattgcaccgcatgccttatttcgtgcatgaaaaatcatagctgagcagattaatgtttgtaccatcgctctaaacggttcccactgccctaaccaaccttcagttttgaaacttctccaaaagttatggttaaattcctaaaacttccataccttactaccaaccttgactccaagttacattcagattgaagcaagtctgcccatctaaccatttagtcaaacgctcagccgaaattggagtcctttctctcttcttctcgttttctcttgtttcgttgacctgttggtccccacctccaattcgggcgccacagcacagccaaacacgagctgtttcctcctgcgcagggttgcgcaagccaggctagccctcgtgcgtgactgtgcgtctcggctgggccacgtcccaccagaccgccctggagaccacacgccacgctgcttcagtcgcattgcactcgccctaggcgatattggctgatctgtccttctccaccataatttattgctgccaacagcacctcctcatttactcgagtgtgcacgagagagaggcctcctgcctcaggacctcgcgagattccctctacgagcctctgcaacaccctgccctgtcccatttgtttgccgcatgcttgcccgcacacataccatctcgagaccgagggtgtagagcaagcaccggccccatctctccccttccttccctggcttccgccttaaccgagaccttgt

SEQ ID NO: 61797 - DNA, 7791 bp, Oryza sativa
tgcaaaagtacacggtggacggacgccactgtgtgacatgattgttgtaacatcacaagacaaattgcaataggaaagacaaaaagaatggatagtgcatgggctcaaagcctgagactggtgcctatgcatgaagggatgcataaatgctcggttgagatgacaattaagctagctggcggctgtcttcctatctcggaatctatccccattccctgctatttattctagagttctgtgaattttgagtaaaatctaacaggttggttccacttttccaatcccgcacatcaattgtaaaaacatccaattaaggtcactaccaccgtcttctctgatttcctgcaagtcatccagttattttattctacaccatatagagaacctggactaaaggaagatgactacatacccgccgtctgattctagaatctatgtaggcataaagtttttcaaaaataaccagcatagtcaattccagttcaaaaaatagatatcgataatttggaccacagaataaaataagcacacattaaccatcaaacttttgggttacgagaatcgacaatgtattagctagttcaaaatatgtctactagaaaatattttcttggagaatgattaacgagttcaccatttaatggaaaatgttttgtaaagacacaacatacttcctttgatgatttctttagtttgagctagttataatttttggcaccctccctcttggccactttggtctcatagtttgatttgttttatgcaatgcagcttgttcactttctagcctttcctcgttttgggggcctccctctagggcgcttgacagtggttgaggccattacttctttgccttttagagtagtcttcacatgattgaccttgttttgtcctggctcatgcagtttatctgaacaatcagagtcgctatcttcacctatgaaaagaaataaaagtatattaggaatcgcaaaagatgctagaggcagcagttttctgaaaacataagaaatttattaaagatggtcaagggaataaatcctcggtacatcgcatgaagcaaagcatcatatatagcataccatccttttgacatggaagggttaatgaatttcgcagaacaaccttgcaactgaaaacatatagcagcagaaaggatgagatcgacagggggcagtggcattgctgcgatgactacatccacattcatatgcctctactgtaagccagcagactgcatgcttgataatctggcatcgcatccgtcggcctccattggagcagcacaatttgatttatttttccttaagtcatagattttgagtaggtttcaccagataaaacaacggattactgtagagtttcctgataaatctgaatagcactaactgcgaacctaacgacaaaagctgcaagggcagtctgcactcaacccgaatggaggacctagcatggatattgttgcaatcaacagaagcaagagacttctctgaagtccagccaaccttaactttcaaagccttaggttggtggttagtaaacttctgccttactagaccaactacatgtattgctagcctgaacatagcagtgtatgacctaggagtgcttcacagctgcttcacacatgctgcacctatggccggcaaccagccagcaaagcaaagagaagagccagctttccttgaatggtcacatcagacaaccgacgcaatgaggaacaacatttgcttctccaaactcgctgtcctcgtgaatgatggtcactaccgccgagcaagccactaaacaagggggttggccagcaatcaaaacacaaccttgctgaaactgccgcattggacaagtcctgccacggggattgaaggggagaagaaggtagactggagactgaagaagaaaactgagccaagactacaaatccaggcctctagcagcatgggctagcatatctagcctctaccagcaactgctacagttagtgtggcctccagcaccgtgtagccaaatccaccacaaatgccgtcactagcactgccaccaaagccacaactgcccagacgaccaccagcaatcgccacctccagcaccaccaccacccctccacaccatggagatgacaccagcagatccaaaataggactaggcgcccgacacagtacaacactaaacctgaagctaaagtacacaacattactagatagaggaggacacccaaaccccttctagccatcattagcaatgatatgccagaataaaggggggaagaggggtcgagagggagggtttactgtagtgctaccttatagcctatcgagctctccagatgtttgagtctcgttttcttttacaaaatataatatcaattattgccaaagatgctgatagtaaaactctaaataaacccatgcctcaaaaaaaagaggtgtcaccgagccaccagtatcagtcataggaaacataacccatgtgaccatgtctacagacaactagtcattgtctcctttttcttccggtcatagcttctaataactgtcactttgcacaacgattaaggtcgtaaaatatatatcgtatttttattttgcgcaatgtttaaggaagtcaaaagattgagaaactaatgttacatgacaatttttaaattatttcagtacgatgatatagacaaccataacacccccaagactctcctttttgcaaatatttggaatgctagatctaattgtaaataaattggacctagttttaatagtactactttataataaaaaaatgaaaatattagccaaaatgtagagtttagttgcgtggaagttaggatgtgaaaattaattaaactaatggtgtatgattggggtcatacggatttgcttcttaggtgcactatttaatcagttatcagagcttatagcaaaattgtcacctaaaatgatattggccttctagctaggatcaatatgtcttattttttgggctatattaattattatcattttttataacatagaatttgaagcatattattgtagtaaaattatactggatagcacaacctgaagagagcattataagaagcaaatatgtctaaaaattgatttaacacaagaaacctgatgaacttttgttcctcaggaacaaatttaccgctagatgaaccttgctcatcactaagaatctcttctttcagtgaaagcttttggagtttcgacaatcttgtgcgcagctggtttgtcccacctaactctagtcttttccataagctttcatgctgccatgtgaaacatattgtaaagcatattgtaatagcacgtggatgcagcatattgtagaaggattttattgggagtattggtagtaacatcattatagagagcaactatagttaggtttgtgtcctagatatacctttttaaagtagatgggttagaactaatacatttttcagaatatctacagatatgaacatgattgttcgatataactacactcaattgtgtgatttgttttatcgaaagtaaaacaagcatgaagtgccagaaattttgaggaacaattaccaaatgtgtgaacttttcaaaagagtacatctcatggacacttgtcttttgaacaaaggcacgtattgttactttccctgtttccacgtagagagcggctgacctcttggtatggaatacataatttttaatgggatcggtgtagtgctgcaaaagacaatgtgaaaaacccatgtacattcaaagtgaataataatgattaactgcaatcacatacgcggtctcttctaattctgccggtatttgtttttctaaagaccacttctttcacccatccttgtggcagcccttcagggttaaattccagaattgcaagaatctacaaatcaatcaactataatttcatttaggaaactatccaaacattagtactgcaaagtgagaaatcatctagtcgacactccttctatcctaatatatagcaacctagtacttaattagacatattctagtaatataaatctggacagactctatgactagatttatagtaatacaatatatctaatctggtactttgttgatacattttaagacggagggaataattattactattcaaataagagaaatagttccaacaagaaacatatacttgtgttgcattgtccatctgtatcaaattcagaaatcttcatttctttaatgtagagtagtacatcatcttttgagaacagtcgaactctatctggtgggtacacatagaactgtgaaatagcaaaatgaatgatcaaattcactcacatggaggagcagcctcaagctctcttccaacaatgtttggaaatgagcagccaacatggcaacaatggtgagcaaatccttcatatgcaaatgttttgcggtatattttcgctgaacattcccaatggtaatgattcataagattagagtaatcagttgattgtgacacactcatattatgtcacggttcgccgctataagtgacttaatgaataaattgttaaccaatagttaaagatggctgcagtgactataaaattaatcttttgctttgttacaatatgttggaataaacaaattaataacatgtaagcggtaggtgctagttcaaatgtcattggcaaaatttgctacatgacactcaatatttatgacctttgctgtgagacagccaaagaacgtgaattttctcgtagatactgcaaaaatgtggtaattaactgctggacactggcgggattattttattatatccgaaggaattggagagagaaacagctgtgtaagtacggttctacccttcgaatatttttttctttattcttccttattcttttctctctcttgttcttttttctcttcctctctctgctatttgttcaatgcgaggcagacggagtgtggcgcctccgatggggcgtcactacgcattcgtcgcccacgtcatcctcctcctctccattgcccacgctgctccgaggccaccactgccgcgcatcgttgccgtgggggcggtgctgtgcacgccagcgcggccgttcgcgtcgtcggtggggaacatcggaggaggcacgtggggctcgacgtacgcgacagcgagggcggtgaaggccgggcatggggcgctcgagtgcgcggtctgcctcgccgagtttgtggacgacggcgagaagctctgcctcctccccgggtgctgccatgtgttccacaccgcctgcatcgacgtgtggctcgccgcgcatgtcacctgccccgtctgtcgtgctgacctcgcggaccgggccgttgctgcagccggccatgtccttgccgctgaccaagctgctccgcaggtcggtgagcatggtcaccacgcccgcgaccgcatcaagcgggcggtgggcttcggcggcatcgcggacaatgtcggtggcgcgtccgagccggtgatggtcgccgctgctccgtgtattgtccaggccacgttggagtgacatggacggtggtggcggccggagatggcgccgctgcaaacccacaccaccggcacgagccacagtgacagcggcaggagaaggagaacaacatgccaacgccgaggcaggcagagcaggagacgctagagcggtgcgcacgcacaccccgtgcgtcgactccatcttcgctgtgggagctcaccgacgatgccttcagcggcaacgaaagaaagaggaagaagaggatgggagaaagaacaagagagtatgggagtgggcccatgggcaaacttgtctttaaccaatatttctctctccgttttcatggaaaataataaaataattccgcgagtgtccaatagctaattaccatatttttacagtatccacgagaagattcacgttctttggatgtctcacagcaaatgccacaaattttgagtgtcctgtagtaaattttgccaatgtcattttagcattgagcttatcagtgcggaggcggttcgtgaactaggcccttctggcgtactgcatagggcggtttaccttatacaccacttgtgcagtacaagggggccatttgcaaaaacaattttatgtcccagtgtttatgatttcctagtaccgttgcattcaacagtcgaagctttcataataaattagcatagagttaatatggaatacaatcaaaagctaccttgtacatcttgtccatgttgtctccaccagctctaatctcaaccagctagccctttggaagccattcatgtgtcctctacataaatcatggtagaactcacatgtactatttctaaacacaactaaaatcttaaataatatggtcatatatatatatatatatatatatatatatatatatatatatatataactcaccgtaaggttgttgcctacaacacagttctttgattccaagaagcgctgatccatctctgagaaaagataatacaacacctctggcttcattgtgaaagtgattccggaaaagggacatatgtaatactgtaaaaacacatagaaaattaacattgcaacaaaaatcttttagaacaaacaataaaatttaagttcaacaaaagaaatagatggccatctacatatttttatacccggcagatggtgccatcatcaccacgatagacctccattatccatccatctggaagccaacctggtcgctcatccacattctcatcatcactttgcaaattctttcttggtttctcaaagaatttgacttcatcacaatcatcttcatgtaagacaccaacagatggtgacttgcccataattaagccaagatcgaagaactctctcccctctcccgccctccctccctcgctgcctccttgccctctatctctgtatccctcctccactccccctttctctctcaccctccttcgcttcctccctctctttatctatctctttgaacttcgcacttgcttagatatatgtagcaaaggatgttcagctggtattttaataactgcggtttttagtaattaaatagtgtgtgtttatgcctttgagggacagcccatattgcgtattggacagctaatgtttaatgcaatgcatttaatgtggtgagttatatatgtttggttaagatatgttctagatagaataatatctgatgccaactgtcatatattttccaaattaatttatactactactaggcctgacctggtagtaatttaaataaaaaattaatttatacaatttatcataacattgtaaccatgcatcgtactatgaacaatcaaattaattaaatccaatgtcacctccaaaatttaacaaatctaagagtaatattattgatactgggatgcccaaccttctcgatgtaggatccggatacaccatgaaatcccataaactcgatgacaaacacagtgcccgtgcagcaccatgaattcgtgaaaccacacgcgatccactcaaccacacaaaagagtagatctattgccccctcaattccttgcaaacaaataaaagaatgcaagaaattcccaaactatggcataaacaaggaaatgcaagaacaatctacgacagaaattcccaatccctctctctcatttggcaatggctgtacaaaatctaggagaagaacaagagcaatttccgttgtgtaatttcaatataataaatgtggtctaccctcttgtgaacaatacatgtattagatagtcaaacagcctacatatctgactagaaatacaaggtgggctagatccatacgtaaccctgcaaattaaaaagattaatttggatga

SEQ ID NO: 61798 - DNA, 3780 bp, Oryza sativa
  unsure (1)..(3780): unsure at all n locations
cgaaggataacctggctaaaaaaattgggggtagacaaaaactattgtttctttcagctatgcacaacaaagaatccaacatcttttctttagctgtcttgttacgcgttctatttagagatatgtgttgtttgcttttattgtcccccacctcgtaatgccataaatatttttggtaattggtttagaaaagtacctaggccatgaaaaatatgattttaaaatgagctagagctttatgttagtcaatttgacggtgccgcaatgatagttttcaattgtaaacaattgtctaaccctatgcaagttatctttatgtcttcctagtatctctccttttggtttacgatgctaccatagaaagagcaaagtactatgtacaatggtgctatacttttgaaattggtaaccaaggttctcttaatgcagtatgggtggcatagtttcattaacattgttggctgaattatgtggtttaacactagttaataataacatggagttgggggggggtctgtaccatcacattatgttttttctatgtgttgaacatgtgaaatcaaagtgtgttttgattattattttgtgataaacaattggcttatgcgatgattggtttgatatttggagataattggtgaagtgttggttttgtctttggaccggccgatctgaccgggatgcgtgtaatggtcaaacttggtggttgtggtgaatagtgtttctgatgatgaacaagttttgacttgatggagccggtcagaccgagtcgtatgcacctattagaccgaagtagtggtgacggtcagattggccaacctaatggtctgaccagcttgctcctgtttggagttggtttctggttgtttatttggatacttgtgattacttcatgtgttatggattaccaagccaacacaaatgctacagaaacaaatcatcaaatgatgaggttaggcataattcagaaatgattacactgacccaagagtttgctaaggaggaccaaggactagttacaccattccaatgaccaattacacgtaccagagccaagaaatgacaactagaggtgaacttgctcctaggtgaacaatatctcgatattgacgagcattacatactacctaagtcttgcactttacttttgcttaggttgacacacaaatgatcaagataaagatgaattacggattacaccatgctaattttggagtccactgttgtattgatcagccaaggccgttgacacataatctgattgttgcacatctatgcatggctaaggctatgcttaacgccgaatgtcagagatatgggcccaggggtatgcaaagtaaggggaagttcccttcacttcctcatacgtggctgtacagcctggcccagcccccgctcctcgcaccgcgcaaagcgcggacacgttcggggggcctcggggtgccgtgtaaggcccctcggggtgctatgtcagcccctcggggtgccacgtcaggcccctcgggccctcgccctgcctggacccgaggcccttgcccagctgccatgtagcgagaggaaaccaagctgggcggtcattaatgggcggcgctccaaccgtccctcgaagcatttagtgcgatcggggcagacgtgtggagccccaccactggcccacgtcaaatcgggcgtaaccggtctgtgaccggcctgtcaccggtcacatccgattgacacgcggccatgccccacgtctcctttgtccccggtgaagtgaaggtaggtatgtattgtcacatcaggggcatcatctggactcctctccatgagaggagggtagccaccggtcttcgctcatttaagagcgaatgacagggctgccccccgtgtcaggtgaaggacggcgctgggcctcactaaagggccaaccgcggcttaacttccgggcgaagcattcgctcatttaagagcgaatgatagggctgtcccccgtgtcaggcgggggacggcgctggccccaccaaagggccaaccgtggcttaacctccgggcaaaggcacgggccgcggattggccacgagagggtgcccccctccatttttcatggaagagtaggtagaggccgtgcatgtggtatccccttcaactataaaaggaggaccttgcccagtgagaaaggaggagacaacactaacaagaaaaaagctctctgaagtttgagggactcttgtaatactgatcgatattcccacacacaggagtagggtattacgcttgatagcggcccgaacctgtataatccttgtgctcgtgtaagattcaggagcttgaaccgcggataatcgacgacctcggatctcacccgttgcccccggccgaactcacgaaaggggaatcccacgatctcccgatagagaggatcactcctcgataaaccttatcaagtttttgcagtgccaaattttggtaaggttaccnaaaattttggcaagatttcatatgtacttactaaaatttggcaacaaactaaatgtagttatttttttggtaactttgccaaaaaaaaggtaaggttgaaaatagtaacaaagtgaaaaagcccaacacctgctaggtctcgacctattgccgctgcaggtgtccatcgctcctcctgacctagcgccgccggccgccaccatgacgacctcccccttcgcagcgctgcaccggctcctcggctgccgcctcgatctgcagtgcgcgatacctcctcatcaccaagaacggaaggtatccatctattcatcccacacctaaattcccctcgttttgagtcacaccctaaatttctagcataactggaagataatttttgtgctagtacaactttgtttctaacaaaagaaaagattcgcctatgtactggatgcttcgtctatgtgcttgatgttgcttgcatgtagcgatgctagtaggttagaattatcacagtccatgccttttggattcagtttcaaagagtaaatgctgattactttcaggattttccttttggatttagtttaacatttacatttctcatgtgttttctttccttgcttatatgatagtgtcgtagttggctcaattacctttgtcgatagagatcagattatggtgtaaaaggaatgaagttctgatagttgttctcaattgatctgaacaggaaatacctgcattttttagttacagttgtttggttcttctttcctttggttccaagagtgtacaggtttgaaaatgtggcctaggaagaccttccatctccttcaatttcttgtttttgtcattcagggagaaacctgaaaagctgaaacatagtgtatggattcaatctttgttttcgtgttgagttctactgcttcttgctgacacaaatggtacatcatgactatatgatgttaaagtgcagaatataatccattttattagtgcagatgccagaagctgctgagtggaatgatgagaacactagattttatatatctgtgaaccctcgccgtggcacgacactccttgacatttcccttgtaggtgcagcagcgccgcccagtgccccactgggtacaatggtcacatgcttgttaactcgtccctctggtggttcacaagtagtttctcttttcttttcaaaaatctatatagatatgctatagattttactgacagtgaccagctcagcaagcacgcaaaggggagttagcaaagcttttgtaggatctagaagaaatggatggggttcaatcctgataattgagatggtggcaaagcattccacat

SEQ ID NO: 61799 - DNA, 1720 bp, Oryza sativa
gttttgtgattgtatcaaactttttactacctcaagtaaaatagtcaaggtagtcaaactaaattaattagaaacctaattggcaaaatgaagcaacttctaaatgtgcctaagttgaacagaaggatataggttttataatttattcaaatgctacagtatttatcaggagttaatataatttttcaagaattgttacccttagttttgacctcctaaaaattcaatttagttctcagcataccccttttcatctttttgtcagaattaaaatgtttcaaatttttgagtgaaactttgagaaatggaatctaggtagcataggttataaccacaaaaatcaccaaattgttaacatcattctaacttggttaatttgaacttcaaagaaagagaaacagaaaaatctctgaaaatcctgtaaactgaataaaacatgtgtttacctgtgttcctagccattctcgtcacccttacgtagcctaccacgacctggacccacatggcagtgcctttggcttgctcacacttgtgttccaccattttatcgcgtgggacccaccttgaatatagagagaaataccgacacgttggaacatcgtgacagcttatccttcttcgcccccttgctctcgggtaagtctatcgcgcgaacgtgcgccagacgcgaacggattggtaggtctagtatacgagccaggaatctcgcgaattttgcgataccttttcatcttttattcctcatagctaattacatgcctaattacgtgcttaaatcatgattagtttaatggccaatgtcctggtagtttgtttcttcggttaaaataagtccacacatgctttatgttttcttgttacgacttacgaggtttgtttggattggactgtagctattttatttttaaaaaatatcctgtgatgatcaacatttatatttctattaaaattaatacactaaacttttaattccagagatataaattctatataaagtttatataaataaagtctacacatagaaagtttatatacataaaatctacatatacaatctttacatatataaaatctacacatagaaactttacatgtataaaggaaataattcatataaaaaagtttccgtcaaaagaaacaatgaaaaaggactaatgaaaaaaagaaatctgaaaaattacggcgtggaaaaatatcgcctatatttgttgcgttgtccaatgctaattactatataataatatctgacaggtactaattacacgttaattaggtggcgggatgcatgctaattctgtaattcagttgggttgccaccggctgagatccgttggaggtgttcgtgacggacgaatgctcgcgaactagactcgtcccttgctctctagctttcccagccatccctcctcactctgtagtccaccctagatccaagaaaccagagtgggagagctccttcttgctctcctcgccatcatcttcttgccggccgccgggatgatgccatcacgccgcccaacgggtcatcgtcgtcgccatctttctttcgtttccgattcacccttgcacgccatagcctctgatctgatcttgccccgtttcttgcagccgatctctgggaacgccgacctcgccacgggagctctggagcgcggccacaccgtcgtcaacgcgcagccgcgggttcgcgcagctggttccgtcgcctcgaggcgaatcc

SEQ ID NO: 61800 - DNA, 1461 bp, Oryza sativa
cagagtataatctattcgaatagtcgcgtcctcggttatagacaatgcttgatgtgttagttatgttagcatcaaatgtggattattatggatgggattatgtttgatggtggtgttggcatgttgtgccatgttgttatggactttggtagtccatggttgatgatgagagcgccgtttgggctcatttgcttatatatttcagaattatatacttgctgtccataaattaaaatgatgctagatttacttgtccttgcttattttactcattaattgctcaataaaatttgcttgatgcaaatgttgaacctagagacccactataggctagaaagcttgcatacttctctctcccttttgtatatataattttgggtaagacttgcgagtacaatcttgtacttaatccggtgtctgcaatttcaggagaggattccggttatgagttatgcttcttgtgtggtcattggtctgccgaggacggcgagggcaatgagtgatctcttgcagcttggctcttgcccggttggtttgccctagtggggttgtggcaccaccggttttatcttttgcttatgaactctatttgagacttccgctgctatatttaggtgttgtatgttgggacctcggaccctattatgtgtcatgtacctcgctgcactttaaccctattatggtacttgctatgtttattaattgcttgcgatgaaagtgtgaggctagtcacattcctggggactagctaagcatgagtaacgggttttgatcgcttgagataatcggggatagcgctttggatcgagtcactggggtatacttttggtcgccaccttcgagtggttgacgggcatatgacggagtgtactggcaagctgtcttacggttatctcttgcgctcactactcgacattccggttattataatagaaggttgtcaaccgcgatcatggacacattgaggacgagtggctatttatgcgtgtatagatcccattccttcaatagtatgtggtggtcgtgttggacactggatgatataatactcggggtgtccacaaaaaatgccgtcgttaataaaatagtgaccaaaaaaagttgcgtggtcgttagtactattacgacggagcttttaacgaccactgacgaccacacttttgtggttgttaatgatctttaacgaccacatttaagcttttaacgaccacatttcgggtcgttaataatcaattctccagtagtgtcatggtagaagcagaggtcgtgttcaaagaaacaatcactcagttgaattttcagttgaatttgataaaagggaggactggtacacgcaccctagtgaaaccggcctgtccaaagacaaaatcactagcagccaattatcaccaaacataaaaaccaatcatcacaaaataataatccaaacacactttgattacacatattcaacaaattaaa

SEQ ID NO: 61801 - DNA, 4918 bp, Oryza sativa
ttcctgcagcccggctcactgctgataacagctagaatgggtttgggtgcccttagcttcaggtttagcgttgtcaggtttcctttgttgggcaacttgtattatttttgatctgctggtgtcatctccatggtgtggaggcgtggaactgctgctggtggtggtctggcagctgtggcttggagggggggggggtctctttggtggcagtgctggtggtggcgcggacggcagccgttactggtaaaaaagctagatctgctagctcgtgctgctataggcctagatttgcggtctttgctcagtcgactactttggtctccccgtcccattctttggtctccactccaccttgttctcccctttctccactcctcaacgtggtgcttgcccggtgcggcttgtttagtaagattgtggtttggttgctggacaacccccttgtctggtggcttgctcagtggcagtggccattgttcacgaggtagcgagtctagagaagtgagtgttgttcctcgttgtgtcggttgtctactgtgaccattcaagcaaagttggctcttgtctttgctttgctggctggtttggcaacaacgatctacggtcatggggtagcatgtgtgaagcagatgtgtagcactcccaggtcacccgttcgtctaactactctgctatattcaggctagcaatccatgttgtcggtgtagtaaggcagacgtttactaaccaccatcctaagctttgttcattaaggttggctggacttcaaagatttctcttacttccgttgattgcagcagtatctgtgttcggtcctccattcaggctgaacgtagtctgcccatgcggcatttgtcgttagcttcgcagttagtgctgctcagatttatcggggaactccgcagtaatctgttgtcgagtctggtgaagcctactcaaaatctaagacttaagagaaaaacctcaagttgtgccgctccagtggaggccgccaaagggaatgccgttgccccttatcgatctcatccttttctgctgctatatgttttcagttgcagtgttgttatcggtagttcattcaccctttcatgtcaaaaggatggttgtgctctatatgatgctttgcttcaggcgatgtaccagggatttattcccttcactctttctttaataaatttcctatgtttccagaaaaaaattatgatatgttgcctctcccacctttggctattcctgatattgttttatttctttccatagccgaagattgcaactctgacaattcagacacagcacatggggcaggacaaaacaaggtcagtcacttggcctcaaccactgtcaagcgtcctagagggaggcccccaaaacaaggaaatgcaagaaagtgaacaagttgcattgcaaaaagcaagtaccactatgagaccaaagtggccaaatgggagggtgccaaaaatcataactagctcaaaccgaagaaatcatcaaaggaactattttgtgtctttacaaaacatttccattaaatggtgaactgattaatcattctccatgaaaaaaattgtggcagacgtattttgatctagctaatactatgatgattctcgtgacccaaaaagtttgatggttaatgtatgcttgttttattctgctgtcaaaattatcaatatctatttttttgtactggaattgacaatgttggttaatttatacttgtggcataaagattatttttgaaaatcagacatcatgatggcttcgtagatcctagaatcagacaacgggtatgtagtcatcttcctttagtctaggacctctgcatggtttagaataaaataattggatggcttgcaagaattcggagaagacggtggtagtgaccttaattggacattttttactattgacgcgtgggattggaaaaatggtaccaacctattaggtttcactcaaaattcacaaatgtcttaaaaaacagctgggaatggggatagattcggagaaaggaagacagccaccagctagattaattgtcatttcacccgtgcatttatgggtgtgattggttgctcgtatccctttagcctggcacatctccctcatctaggctaaacctagcctaaattggagagacacatgcaagtgttggtttcttgtatcaggctagcctgactagcatgaggtcatgtttggttgctgtcacatcctgattttcgtttcaggatttataaattatttaataaattattcttagaatttatattaaatgttcattaatataaagtaaaatgtggtaaataaaatttcataaatataaagtatggctggatttaagtcttattaaattttccatgattaattacactctctggaattttctcagatttttcatagcttaattcctaattttaataatacgaagaacatttcagtaattattaacataataaattaatcattaaaggatctggatatagttttgctaaacacttagagtgtccaagtatttttcaggattcttcttgaaattatttgagcattggaaatatttttaacaattcaaagatcatttcaatgattaatttaaattggaaaagtaattaaaatccccttttccttttcgggttgaaactggaaaaagtcatttttccctcattagcccatccttcctctgtgccctcttctccattctcggagaaagcttatttcttgtcccttcttttcttttagccccgacagaagtctactttgctcccctgttgctacagtgttgtcttcaaccttcagccgtttctctcacgtgcccgctcacagtagcgctgcatcctccaccaaatccggccatgccgttgctcccaatctaaaattgatcgcggaaatagaaccctctcaatctcctctaccttttccccaagaaagaccccatcaaattcgtgcttaatcccatgaatttcggtcccgttcttatcctaacaaatcgggataaaccctaattttcggccaccaaatcccaccacatccgtatcgatctctacctcctccgcctatataaaggatgcactgggtctccccttcgctttcccctcctttccccgagctcccatgcccaagccactcttccccgcgagctccatctctctccgccgctgccgccaaccccagccgcaacgtgctgtcatgtcacgctagtcgctagatactctgacggacacattggcggtgacaacagaagagcaacaggggaaggcgtaaagtgtaaaggcgtgatacgaaagagaaagcgtactttgtaaaaggagtaggtgtgagtgccatgttgtgtgtggggccagtgttagctggcgtgtgaggggataaattctccatgagttgtactgagaagattatgaaaatagaaatggaaaaactaatcccacctactctgtatccttctccttcctctgttcttcctctgctattcccccaactccggcgagctccgtcgccgtgattagggccatgccaagttggtatcagtcgcttttcgatccccggctatctctcgcactctctcgactcttgatcagtaaatccggtgtttcgttcgtggtcttccttcaggttgatttgcggtaaatcaaggctaggttgatcgggtttggagaagacgacgacacggcgccagccaaaccaagtttgcaggttcggcagacgatcgcagcgatgaaatccatggaggagcgcttgttggatgccatgaatgcaatggctgccaaggacgacatcgccacgcacttgatgtagattgacctcaaactcgagcagcagggcgagcggttgggtcgggtaaaaaccaaggtggatctctccttgacctcccttgaccaggtgcagcaagagcaaacttgggtctaacgggctctgaaggcggtcattgtggcaccatcaccaccgccaccgttgccgccggaaacaccacatcaagcgccgttgttgtcgactccttattcgggttccgtggcttcaacctcgtctgaaccacaaccaccaccacctcctccattgggtaccttcacctcattactctccgggtgattgtgagcattgtgacatgggtcatcgtcagtggactcctaaaatggattttccgaagtttgatggaaatggggttaaggtgtggattgataattgtgagacttattttgctttctatcaaatcacggaagcatttctagtttcagcaacatctatgaatctcatgggtgatgccgcaaattggtatcagacatggaagttagaagtgggttggcatgattgggagatgttgaaaactgctatttctagggaatttgatgtgcacctttggtctgtgaaaatggatgagttactgttactcaaacaaactagcacagtgatagaatattgttcaaaattcagtgaacttgtttatcagattcgtctctatgacccgctcttgtgtggttctgttttggtttctcactttatgttgggactgaaggatgacttgaggtctttcgttcaggcagctcagcctactactgttacccaggattgtcttgttgctttggctcaggagggtgctcatattggacaaccaaggaagaggtttaatcaatgccgagataatgctgttggtagaggcaatgagaaacctaagttggctcgtggtgagttgtggaaagcacagcagctgaaggaatatagaagggctcagggtctgtgtttcaaatgtggtgataagtatgtttctggtcaagtctgtgtcaaacaagaggctgagttaaagttgctgtgcaggaagagccagtgatcttgtttgatgatattttggatgctgtcactgctcctgaattggtagaagaggattttaatctctccttgcatgctctagctggtacctgttcttcggctactg

SEQ ID NO: 61802 - DNA, 646 bp, Oryza sativa
tagagcgtgtttggttgcctgtatgtaggttggttcacacccacggatgcaagcaacgcgtgtttggttgcttgcacagcccatagggcctagttccactcatgtaaatttaccttccgagccagtcctgaaggaaacgcttgatttgagcttcgatccccatcctggccaagcgcgtgcaggcgcgggtgcgggtgggtgcaagtggggacacgtcaatgcatgaggctggagggggtcaagcatccattctcttccctctcccatttgctcctagaggccaccggattcgttgtcgtctctatcgtcacctcgtggagctcctcagccgagtggagccccttgttactgctagccgctatcatgtagctagccagaaagcaggagacttggacaggatgacggatctggatgctcgagcggtggtggcactgtcaccggcctcatctttctcatctcatcgccctcttcctcgcgccttcttacgcgttggccgccagcctccactccatttttagccgccggatccagcggccacgagctcgaagtcgtcagatctggtgacccaaagctcttgatcaccggatctagttgttccgatggaggtgagccgtgcggccgacgagatatgcgaggctgcatcatg

SEQ ID NO: 61803 - DNA, 5650 bp, Oryza sativa
tgaaaaagtcatcaacaacaaagttgtaaaactcatcaatatatataacttttattttggtcatttcttcatccgataaaacgacagtaatattgttcacaaaatgtagataccagatatctatattttgtgaacaatgttacaaatcactttgtcgcaaatgaccaaaataaaaattgtagatctagatggattatacaactttgttgttgatgacattttcagttgaagtcgttcactgataaaaaattctatttgaagtgctcaaactttgaatttcaatttcaaattattcaaatagagtcagatggagaaatgacaaaaataaaaattttgcatatcgatgagttctataacttcagttttggtgaagtttctatttgaaatcatttattaaccccattttttgttcgaagttgtcaaattttaaaaattcaaaatttgaattgttcaaatgaacttatttgtaaaaatgaccaatacaatagttgtagttctcgatgtgttctaaaattttgttgtttataatttttgcatttgaaacacaaaaatcagcctaaaattaaatttaagttctcataaatttaaggtgaaatgtccattttgtccatacaattttgtagctactacagcacaccagggacattttggtaaattcgcatagaattgctccctgtccatataatagctcaaccagtgaccaacgaaaccttatcctctccctctccaatctccctcttcctctcctcagatcggggcgccggctgagaccgagcggcggctgctcgttgcgatcggggcaggaccccgcttctcccgtccaatccggcggtggctcggtgacgagagtaggggcggcgagagctcggctcctccctcgcctcttctcccctccaatcccggtggcagcggcggcggcggctccgcgacaaggaagggcggcgggagcttggttcctccctcccctcttctccccttcaatcccggcggcggctcggcgacaagtaaggacggcgggagctcggctcctccctcccctcttctcctcttctcatccccgcttctcctctctaatcccggtggggtggtgtaggtgcgggacaagggcggcggctcggcaacggcggctcagcggcgacgacgacgacagcgacatgggaggggccttggcgactttgacgacgaccgtgacgacggagggcctcgtcgacatcgacggcgcgcggtggacggcgacgagcggatccggcaccacctcctccatccaccgcgccacctccatctccgcccccagccacctcgtcgcccttccccgcctcgctcccccagccagggaagggacggtggcgcgcggatctgccgcctcccggcctcgggagcgacggcggcgcatgaatccagcggcctccgtcctcgggagcgccctggcgtgagcgggagtgccggcagcacgcagattcgcaacgacggtgacggtggctgcaacgacgacgacagcggcgatggtagctgcgacgacgacgacggcgatgacagcggctgtgatgaaaacgacaacgctgtgatgcaagtagcggcggtgctctcttcctctgtcctccgccatcagcagcaccagtataccctgatcataagagccgtagtactatggctgatcctgcacttgctagtgatccagagttacacgggctgtcttatatctatgagaggaatggtcgtcattattgtttaaccatggcaactcctactgtagtacctaatcctccagccaaattttcagaaagtgcttagaccttgtattagggatcttcgaaaaattgtaattctcttttaagggcacacagtagtatctcgatataaactctctggtagtccaattttgtaacaccatgtcttgtacttagtctagaatggctaccatctatctttatgtatgactaccatatatatcaatgagaaaccatgtgatccatcaagattattctcacatttcgaattaaaatgcttgctgtccagaatttattgttatgtaaagttgagcttaatttatttaaaatgggcaaattgcactattgaaacgtaaatctagtgctctattcagctatcataaaatttagcacatctttgtgcggccagctcatgtactcttttgtactttgagtgcaggatgacttgcaccctatccatggctgctgcaaccgggagtcagggctccgatcgagacaactccttccaatccaatccgccccggtactcattcgtcggggcaatccagcagcagtcggcgagctgctgaaggcgatcgtcatgatgaagagccctctctacctcacattttagccacacaaaaccagctgtttgaacggatgctagcaaacagtgaaaatatgggttctgccatggctcacaatgcaaatcaaggacagtccaaattagcagatgttcaacgcacccatcctctacacttctcctctgctagttgcggatccacttgtcgcagatgatttgcttcgcgatattgaggccaagctcaatctttggctgttcatcaggaggtattcaggtctgctcatattctcgccggcctcatggaaatcaataagaaggaatttctcaacctgaaacaggcaaacatgccttttatggagttcttggatcgtttcaactatcttggtcgttatcaggaccgtcccgtgaaattcaggggcctgtgcaaaatcttaatagaatgctaaacttaattgctaaaataaaatgaataatttaatacttcataatatatttcatagcaacataaaatagtcaaaaaaattatacctatgcgtaatcttcacttgaaaagcatcgttcttttagtgtttcttgagataaaatcttcaattatatgttcatattgaatattcttcagaatgtatgttcatattgaatcttcttcagaatgtcaccctcaagtgctattatcaacacaattaggttcattggcaacgttaatatcaagtgtttgattattggatggaccttgtgattcttttgtaatataactctgcatagcttctttctaagattgagttaaatcttctattctttttttttcttcttacgattataatacaagaaaggcggataggcctaaggtactcagcccaccctatgctaataactcgatggttcactatgaggtacccaagtaccgtataccctacagtagccccgggtactaagcttggtactagttttctgtatcatcaaaaccgtcaaagaagaacaaaacgtgatgagtactcaaagcctgaatgccgccgagctatatatcatgaccgagtaacctccacttgaactgaggaattgaatcatcaaagaggtatttcagactttatcgaaaaaacttctagggctggcccattgaagcgccttcttactctataaatagcgacctagacggaacgaatctcacccaaatcccaatttgagcaacagtagtcgtgcctcttcatcttcttcacctcacccatttttcttcttgattccaactagggttttttaaacctaaaccaaacaacttatccacccaaaatctgaaactttccaaccttccggattcgaatccccgaacttctcctcctcaaaatgtcgggttcattgggtgaatccgtgtttctaccagatcgcaatctcatcaatgaccgtcgggcaccgcctccctagcttccatgccatcgcccgcacctcccggcctccataaccgccaggcgccacctccctaacctccacaacaaccatgcaccccctgccagccctccacaattgcaagggaccacctcaaaagcctctaggccatcgccggcacctccacgctttggccaatgaatcatgtcctcacccacaatacctgataataaataataaagaactatctccgctttttcatttacttgtcactttttgcacttttagtacgcaaatagttgtcactacgcgcttacggaagttgtggttcctatattcttcttagtgggcctaaaattatatttatgtggcatatgtgtttagaagtttatctgttttatatcccactaaactcaggggcattttggtcattattaattaagttttaggttgagctgaacggtcgcacacgaaacgagagatcttcaggtcatgattaattgagtattaactattataaacttcagaaagtgggtatatttaacttttaaaaaaataagttttatatacaaatttttgtacgaaacacattgtttagcggtatatggaaagcgtgctcaaaataaactatgaagtacctgccccccaatagcggataagaactcacccttaaccctgttattgcataacggagtattacttacgagctatttggtgcagagctaatccaggaagaaattgctcttgtaacctattcgccactccaaaattcgttcccatgttaatgggataatttgttttttttttaaaaaaaaatctggagagactcaatgtttaagctctctgccgatccaaggtccaatgctcactatacagacttcattcaatcagtagaaatccacttatgcagatgaaaaaaaaagcaactcttgattgcaatcaatgaatgatccttacagaagcctgtttagttactcatcaacggtagtgtatttgatgtctgggtatatatgagtggcctctactccgaccgttggtttgatctcaaagttgatgtgatctccatttatatatacagaatgaagtatggccagatcgatgcttagtggtgaacactctgcaagaccaaatacaatgatttttatatatattccaactatatagacactattaagatttgatatatagcaacaatcagacaagtatagaattcatttccatggtgtttctttaaaaaaataaacaacattgttaacttatttcaattattcaaaacaaatatgtagtaaatgggaaggtttaattctaattggaatattttataatctcatattagtaatttcagagtgatattggtatattgttgtgatggagtcgtgatcaagtgcatgagtctatcgagcaggatataaatcgtggtgtccacagtaataataactttgggcattctagtttatgcaaaaaaaacttatacttctataatctaaaaactgttggaaacaaaaacggaacactcagttactgagcctaggagcaccagtactgacctgtgatttgcttgaggattgcctcttcagtgagatatgtagaatcgaatcacaagaactaagccaaccagagagggggggggggtgaatggttggtatacccaaaaaccgaaaacttttagcagaaataaaaggtaccctcgaaatcgatggatcgtggtctgattgaagtagttgtgtcggtctgaccgcttgatgaacgtcggtctgaccgatgtagatcgatcggtcgaatcgccgaaaacgcctgccgccgactcctgtcgccgccggtctgaccgcgtgtgcccaccggtcggatcgccacgatgccgccggtctgaccgtcggtgcgccaccggttagaccgccgaaacccagtgaaccacaaatcgaagaactcttaaagtagataacgactttattacttctctctatgttttacaaagtgcaccaac

SEQ ID NO: 61804 - DNA, 10691 bp, Oryza sativa
ttctttagggaggagaaccaatttttatcaccggtcatgtgccgcgaacaaccaaaatccacaatccacacgttctccttccttgccaccaaagcctacacacaagcagaagtcgaagcctcagtactggggttagatgataataaaaatttaggaatccagtactgagacacacgaccagaagatccaatagacaaatatccacgtgcaaaatcaattttagaattttcagaaaaattcatccgaggccggtctgaccgaggtacggtggccggtctgactaggggccggtctgaccgaggcttcaccgccggtctgaccggtggtcggtctgaccgaggctgttcaaccggtctgaccggtcgccagtctaaccgcgggacccactgcggtctgaccggtgtcctcgagggaaaaccggatttttgccactttgattttgcaaaagcaatctctctctcctttttctgttatgagctaatctgaaacaaaaatcaacaatatgtccatctttgccaaaaaaaagaacaagtatatttttcacgttgtttagacacattgttagagccagaagatttagcaacacaagcagaaacaggaggttttgcatgcacaacattggattttgaagaagatgcattcatggtagacatgataccagcagatttaaacacagttttattagtatcatgtttaatcaaaatctcaccacttctagcaccaacacctaacacaataggaggatgtctagaattatgagcataaggatcaaaacctaaaccacggttatgtgtgctaacctttgattgatccaaaatctttttaccatcagaaaatcttagcaaagaatttttcaaataagaaacctcttttttcaaattagcacaattttttcacaatctaccatgacacctgtcacgtccggaaattcactagtaatttccgaactaatttgtgcataaaaatccttgtccaggaatcagccaaggtacacaaattgacaatttaatatacaaatccatcataaaaataacgttacatacttacaaaagaaaagaaaacagcagcggaataacggtctagcgatggcttcagctccactcccacaggcagctcaactagggtataagccaaacgtcttctccttctggatcctttttcttcaactgaggttgattgattattgcaaggtgagcatatgacatactccgcaagccacacagcaaatatgcaagtgcacaaggataccaaaggatggcataatataggctcatttgcaaaaacagcatttagcaaacatttagaagtaaaacagtagagtaatcaatcatcaattttaaccaacactgcacaacaccccaatgctgcacaggcccaaccatcctgaacaaccatacccggctgtacagatctaactccaaaccaggagctaagcaaatcattatcagttataacatccataattattgtgagaggtgtgagactaattacgaaaaacattgctcaacccgcccatgaccgcgggcacggctattcgaatagttttactctggccagaggtgtaccactgtatccacaagacacatcctcaacatcatgtctaccatgcgttgcgatactggaaagtacccgaatagaggctgtgacaataccctctgcacaacacaactcaccacagtgcaccatacctggatcataatcaccccctctacaaccagaggcatggactccccagcgacccccacgaacttctcgccgcttctcagtctggcaccccgtaatgaaccatgctatacaaaaggtaaagctgttgcccacgctggcttgtagctggtacggttaagtttcacaacagtagctcgcgaaccgatccttaattgtcatgagcacgaccttcaaaaccatgtgctcacaacccaccattaatcatattttaattatcaattaattatcataacacgattgaccatcgtgagctaccattaaatattaccataagtaataatgtagtatatatgattcatcccattaatgagctaatgtttctaagcatggctaagcaattatatatatatatatatatatatatatagcatttagctgaaccaatccaatgtgtaaggtccaagctaatcaaattataacccagaggaaaataaagtcatcttcggccataatcaactgggaaggctcaccacccgatgacattcgaaaataatgcatacgttgaaataaaacaatagctttaaatgggttcaacatgctcaaagggttgtttgggatctgtgtgacttgccttgagcttccgcaaacacttccgaaccttccttaacgaaaacgctctcctccggaacgtcggaaactaaagcgaaagaacaaaatcaacaaaacagtacaaaaacaagcataaccagtacatgtagatatttttaacatgtagatctcgattttagatgaatttagcaacttgaaccactcgaatctgagttacgatgatttagttatgaatttccgaagtttaatcgattttcatctaataaagaaaactaagaatagggattaatgatgtcatcgctgacatcatcaatgtcgactcgacatcagcgacgacctcgccggcgctagaagactcggccggacttttggagggtacctacgcgtagaggagaacaacgcgatctcaccggtactaaccaatgcgacgaacgacgacggatgacgaccggcgacgagcttgtgcggcggcggcggttcggtggacggcggcggcggctctccggtgaccggtggcgacggcgaaggggcggcggagcttctactccaccgcgcgcatctaacggcggcgacgggaggcggccgtgacgacgcaagcggcggcgtgaggcggctgttcgccggccggcgacggcggcggtttgggtggcgcggcggcggcactacggggcacgagagagctcgggagatgggtcaaacgaaagagggcgactaggggatgctatttataggcttggattgaagagatcggactccaaccgagaggatttgagccggaaaaaccgagggttagttggagagataaactcgaaaacgaatccaatttcgcgtcgaattcaaagggataaagtcggatttttgggggaagagatagaggaggataagaggaatatttcccctcaactaattttgcaaacggagcacgggatgcggcggatttggtggaggaagcggcggttgcacaggtacaggacggctggctcgggctctgtccaagcttgaagacgacattgtagcagggagacgaattagacttttcgtcttgggctggctgaaaacaaagcaaagaaagaaagaggaggagctcggctgggccgacttgggctgcacagcacgcgcgcgagggagagacatgttgggctgaaatcagcccaacggcttaggagaggatttaaaaactttttccaattaaaataatcactgaaatgatctttgaattgttaaaaatacttccaatgctcaaatagtttcaagaaaaatcctgaaaatacttggacactcaaagtacttaaaaaaattataatcagaccatttaatgattaatttaatatgtggataattactgaaatgttctttgtagggttaaaattaggaattgagttccgaaaaatccgagaatattccagagagtataattaaccatggagaatttaataaaaattaaatccatccatgctttatatttaggaaattttatttcccacatttaacttcacttataaattaatgaacatttaatataaattctaataataatttattaaataattttttaaatcctaaaacgaaaatcaggatgtgacaacacctttgtttttacgacatttggggcaagaaagcacttcattgtttttcacaacatcttccatgtactcaacacgacctaaagcatcttttagtttcatcttattcaaattacatgttgagcaatccaaaacaacatgaggttgttttaactttttagcagaaatcatgttaaacatcaaactagcatgaaaggcaatttgatatttttgcaacaactttttagttaaaaacaactcatccaaagtgcgtgtgtgcaaagcaaaactacaagcaagagaagatctatttttcaaatcatgtgcagcattaacatctctaatttttgaaatctcattcattaaaacctcacaattttcacaatcatcatcattaggaataagatattttaatctatcaatttcagatttaagagattcaatgataaattcctgttttctatacatcttctcacacttcttattttttgcactcaaaatagtaatagcttcctcaaaagcactcacctcattgtcttcatactctgtgtcagattcaccacgcgccatgaagcaaacatcggagacgttctttcccttgtcatcatctccactttcaccatctacattacttagtggctcgaagggggcacaaactttttgaaaagccttcctaagattctccatcttcctcccttggtaagaacccttcgacttgttgttgttggtcttctcaccatccttgtcttctcttttgcctctcccaagcttaggacaatgcgaacgaagatgatcaattgaactacattcaaagcaacaatttggaccacctcttttcctgttcctggcattattcatagctcgagcaattctgttagcaaccaaagccaaatcctcctcctcgatttgttcgagttgatcatcggatgtggcattaaaaatagcaagaaaagacgacttagatgaagaggcatcaacatccaaagaggaggaagaagaaaccaaagcactcgatttagaatcaactgcgagaaagaacattcatctcatgtgttttcaattttgtataaagtgaatccaaagtcaaagtagacatgttaacagactcctgaatagatgtaactttcatctcccaaatagacatgtcgagaccattcaaaaagtgacgagaaatctcagattgtggataattagcatcataagaagaatcaacagatctaagattactcaaaattttattaaacctaaaaagatagtcatccaaagcttctctaggtttcatctcaaatttaatgtactcctttttaaaaagatctcgacgaagctctttaatgttatttgttccttgatgaaaattactcaaagcaacccaaatctcatgagcagtttgaagatgagcaacacgatcataatccgaacgagaaataccactcaaaagaatgttgcgagctttgcaattttgttcaaaagcagttttttcagcagcagtattaatagcttcaggaatcacataagcatgagaaacttttctccaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaagaaaacaaggctctgataccacttgtaggatcgaatcacaagaactaagccaaccagagggggggtgaatggttggtatacccaaaaaccgaaaacttttagcggaaataaaagttaccctcgaaatcgatggatcgcggtctgactgaagtagttgcgtcggtctgaccgcctgatgaatgtcggtctgaccgatgtagatcgatcggtcgaatcgccgaaaacgcctgccaccaactcctgtcgccgccggtctgaccgccgtgtgcccaccggtcggaccgccgcgatgccgccggtctgaccgccggtgcgccgccggttagaccgccgaaacccagtgaaccacaaatcgaagaactcttaaagtagataacgactttattacttctctctgtgtttacaaagtgcaccaatagcactccttacaaaaattttgactaaactcgaaaccctaactcaaaactcaactctattgctctctaaaacgataccgggaagcctcacgctccccctctatttatacatgaggtagacagcctaaagccacgaaccaaactcatactaggagtcctaaacaccttaggaaacccactagtacaagaaagaaactttacataaccaatcgtaccaaatttggactccttccaaattcaacttcgcatcctatacgcacacaataactccatcgtatgccatatggaatctccatcaaccacgtgcatcaactctagcctaagtatcccgcatgatctctgaccacaacggacgtcgtcttatccccaagccgactcccggtccatcaccgcaaatactctcccgagacattgagtcacctacacatggaacaaacaaagaaaccatattccgagaccaagctatctccaacttgattcattagcagcaaacaatagtattacatacgtataaactcggatatccaaataaacaacccgaaaccgaaaccgacacagtgtcggccggtcagaccgcgggctgcaccggtctgaccgcgcattacacgccggtctgaccggctactagagcccggtctgaccggtcacacaaaatgataaaatcctgcgatcccctgtaaatctaatcatctccaaaaccactttgtgaataaattccaaataacaaaaccaataatctccaatgcccaattgttcatcatagaataataattgattttacaagatagactctctcaaaggtcctccccatcttcttctcccacagggaaacgagatcgttcattgacagggcattctctggtggccttatatgcaggaccttgttcagcatccttggatcatccactcctttgatggtaaacgttgcaatgtcctcctcgtcgacaaatattgctgaaacatttcgcaaagaacgaaggccggccatagttcagtgcatctttttttttttaaaaaaaaagtttgtgaatatccatgcagaaatgttgatcaatgatcaataccagctctgaagtagctaatcagtactccctccgtcctaaaaagactcaattcttgagtttccgtgtctaacgtttgaccgtccgtcttatatgaaatttttttatgattagtattttcattattgatagatgataaaacatgaataatactttatgcatggcttatctttttaaatttttttcttattttttcaaagaagacggacggtcaaacgttagacattgaaacttaggaattgagttttttttgggacggagggagtatataactagccatataggtgcgctttgcgtgccttttgattctatttaagacttctgtgtatggtctattagtttacattagcttttaagaaggttctgatataagttaatttgtttacaaagtatggattgtaagagaaatcactagaagccacctttgttccctctctttgaatcatatgcttaattaggaggagatacagaaacctctggaaatttggttttttaatacatgcactctttcgatccgatgaccattgtttatccgaactcttcatcgacggctaatatatttttgatgatatggcacatcctcgtgcaagaaagcttactgctttcactattataatataagataagataagttaagattagtctgattttgcttttttcctttaaaatgtttgattttgctcttgtggaaacaaaatccattgtcttttttttttggcaagcgtgcatgagaactatgcatcattttacattaaaaattattttctctcgaaatccatgatgaaaaaatccttactatttggcttctgcgacaaaaaaaaagaagaacaagaaaatactccagaaagaaaaaaatgttattgagaaattactttgaggtaaatatattttatattaaaaattttactaattataagcaccaaattttacattataaaatataatatctctaggctctttaagaatggtaaatttacctcagcgctgcatgcatctacacacattcattgtgatgttaccgaaaaattaagggcctgttcactttgatgtcattttcaaccttaccaagttttggtaaagttaaaaaaaagtgactacatttagtttgctgtcaaattttagtaactatataagaaatcctgccaaaattttggcaagttaccaaaattttggtataattaccaaaatttagataatactaaaatttggtatactaaaatttggtaagttttttttggcatcaaagtgaacaggccctaactgaagatttgttactccgttttctttttaccttttggtgttgccgtctcccagaatgacaaccttgtcagctgggaggccgctggctccaggctgcacaagcgtggggagatagtaccccgcgaaaaagttgcagctgacgaacgtgtaggggatcccctcggcctccactgttcgccggatctgcgcctcgacgtcgaaggtcgccttcgccggctcgacgatatgcgcgtggtcggcgtcgttgccgaaatccgacgggatgaacctctgcaacttcccaattatttacagcttgatcagtgtatatatacagagccaacggaagcaggggcagcagatcgacatgagggcgttgaccttgatgtttccggcctccttgatggcggcgatgatcttcatctgttcgccgacgtcatggtagccgacgaccgatatcacgacgtcggcggccctcaccgccttcaccaggagatcgtggtcgccgatgtcgccctatatgtgtgtgtgatcgattcggatttcggacgacaagcatgttattatttcagacgcagaaacgatcgaacagcagcacgcgaggtacggttgtacgcacctgcaggatggtgacgccggcgtccctgaagctctgcagcagccgcgccctggagctgcttcctccgccgcccgtcgccggaggaggcggcgcggtggcgcgcacgagggcggaggtcgggtggccggcgcgcgcgctcgcggccacgatgaacttgccgaggtgccccgtgccgccgatgataaggatcctgctcttattacgatctccaggttccatcggattatcgattccgacgacgcggcgacgacggtggcggagctaaattcagcgcgaccgtgtgcgggcgggtgcacctgccgttggtgctggatcaggattattctatttattttctatagtagcaatgttgcggatgattgtatgactttctgattgggtatttgtcatgggagaatttattttatgccactacgaaatgtccactctcatatataatatactaagaagattatgcatcatttgttttatcattaaaaatgtactttaagcctgacttaaatctttgtatcactagcaaaagtatatgtacggtgcaacatgcgaagataattttcacaattgagaaaaacctctgccaatttaaatgacaaaccgaaataatacaagcaaaacaaagttagaaatcatatataggccgtgtttagtttcttgtcaaattcttttttatgtatatggacacacaaagtattaaatgtagactaatcacaaaacaaatcacaaaacaaattacagattccacctgtaaactgcgagacgaatctattaatcctaattaatctgtcattagcaaatgtttactgtagcaccacattgtcaaatcatgacacaattaggctcaaaagatttgtctcgcaatttacatgcaaactgtgcaattgatttttttcgtccatatttaatactccatacatgtgtccaaacatttgatgtgacgaattttttagaagtttaaagggaactaaatacagccataacattgaatctggatgcgctcgcatcatcgtcatgacacaaagaatcccccatgtacacaatatcggatgactattccataagttgtcccatgtatattttgctatacctaatcaatcaaagattgtcgttttgatgattcaattagtgaaagttttttaactgttgatggaatgcatttgcaaagtaacaaacttaccacatacacaccttaaacgatcataatttcaaaaggaaaatatttatgaggagataaattcggaagagaaaatatttatggtgccacaattttaccaaaaatcatttaactacattataactacattgtaatttatgaaaaatacattgtaaattttaagaattacattgtgattttaatacttacattgaaatcatgctaatattcactgtatatgaggtgttgactacaaattattaattcattgattatatatcaaaatagcgttgactaaggagctaagaaaagaaaacggaaaagagtaagaagcgaagggatacagatgtatgtgatagacaatatcggacgtatgaatgcaaagcccatcaggtggctggtcctagatctgattgaaatcagttacgaattgtgacagcagatttttaccaataccaaaagagaggaggaaaaaagagaggatattggaacaagatggcgaggatcagaatgattgggagaaaaagaaaaaaagagagacaaaaagcgatcgggagaggggcgcacgtggcttcaagtggaggcgtataagatggggtggcgggatgatgtgagccgattgggttgggttgggctggaagggggtgtataatagtcacgtcgaattggataaaggtgatacacaaccaac

SEQ ID NO: 61805 - DNA, 23035 bp, Oryza sativa
tataatactagagattacactaaatatttgaacaagataagtggttttggtacgtcatctgtgttagagttggtttttgagtttgtcgtccgtatctaattcgagagtctagaataactattatacaccccccagcccaacccaaccgagccacaccatcccgcgcgcatccactaggtgccacgtgctcccctcccctaattggcatctttttgtttctctggttttcgtttctgtttctcctttttctttctcctgatcatcatgatactctcccgatccttccttgcatattccaaatttctatcctcataatattttccttttgaaattataattgttataaggtgtgtatgcgaaaaatttgttactttgtaaatgcttttcatctactataagaaaactttcactaattgaataatcaaaacttcaatctttggtcgatgaggtatagaaaaatacacatgtgtcaacttatagaataactacccgatcaatttgtgaggccacgaaaaggtgtacacgaaagattttttgtgtgatgacgcatgaagctagtgtaaccgggcttaatgctatatataatttacgactttgttttgccattgttttgtttctcttgtttcaattttttatttaaattggcagagtttttatcaatcgtgaaaattgtttgtagcgcacatatattttgactagtatgttcaaaattcaacaacatataacaaacaagggattactaatttttaaacctccgtcttatgccacaactcggctgttggacaagggaaaaggaaaattgagttaggaggagtctgagatggatcaaccgactctagttcaaggaataggaggggttctgttggagtcaagtcgagtcggttgattgaactgactctgaaggatctattttggaagttcagtaatgatgttgtatctttccgatttcgtacatttcctattttgtgccgaatactttccgcatttatcttccatattttcttttgtgcacattactcgtttacttgtcggattgacctttcagccgatcgtttatgaattgcaagtcttataaagttctttatgggtttgttgttcgagtttacttcacctaggtaaattaggagttcttccttttcatcagaggaagagttttagtataagtcttaggtgtggtgcctaggctttatattttcaagagtaaaatacatggaggaccacttaacttgtttacgtgaattgtgtaggtcaatctactttcaaaatggacatctagatcactagtgtgagttaagtcaatcaatttgcctttctaactatccacatgagcataccttgtacacatgttatactatctatgattgaaaaatttgctatcagacatgtgcaaaaaaaccgcatgtgtttcttatcctttctcacagtactagcactgagaaatatacaaaattaggggaaccaaatcatttcacttgtgtctattttgatgaacttttcagttctcagtcctctctctcgtttgccatcaaacctgacagcggcgacaagctatgaatataaacaacgacgaaggcaaaatcctaggcagtggcggcgacaagctatgaatataaacagcaacagaggcaaaattcgaggaggcagtggctagggtgtgcaacggctgcagatgcctatacatgtgccacattatgtgtacaaggtgtgctcacgtggatagttagctagctaaataactcagttaactaatcctatgtggcacgcttcaggggcggatttaagatccggctagcctgggccgttgcccgggctcatgggcctgcattagtggacctactacttattatccatactaggaaaaagtacactgatggtccctcaatttgtcatcgagataaaaaacgccctggaaccacaaaaccagatatacagggtcccttaagtatacaaaaccggtcacccgagattcttcggtggttttgaccctggttttggtctacgtggcggctgagtcagcgtgggacccacgtgagccccacacgtccacgtcagcctcctctccctctttcccctcttctctcccttcctcatctctctctctcacttctctgtcgagacgagcggcggccgagattgacgagatgagtggtttccagcagggtggatagcgtgatgggcggcgaagagatgggcagctgccggcgaggaggatggcgcgacgagcggcgaccagtggggagaaggggcagcgcgcggtggtcggcagaaggacctatggagagatcgccgtcatcatcaatatctcgaacagcgagccaccggcgtcgtcgctgcggtggcggacgtcgcacaccatgcacaggcggccgtcgagctcccgcgagcgttttcccaaccgatatggccggtcacatggaagccaggcggcgggggggagcaaggcggcgacgcggtgccggcggcgacgacacgggagcaagggagcaaggcagcggaagcagcctcctctccgtgcgacgacgcgggagcaggggagcaaggcggcggcggcagcgtcctctccgcggcgccgctagccgacatgtggtaaggagagaaaggcggcagcggagggagcaagacaacgacgcggcggtggcgggagagcaaggcgtcggcggcgggacaatgggagggcgctcgcctcactcactaggccgaccctgtgcttccccactaggccgctgccgcctcagcctcctcctcgccgtgctcacctcaccaacgccgcgcgcgaggaggcccacgccatcacatgcgccgtgtcccgcgtcatcgccgcgcaccctggcccgttccctcgccgcgctcccgacacggccgtgctcccaacgccgcctgcttccccaacctctgcgacctcggcttctccctcatcggcatcaccaaccaggacatgcacagactccagcctccccgcgcctcatcgccaccgacaagccgacgccgacgccggcctccccgcgcctcgccaccaccgacaagctgaccccgtgcttccccactaggccgccgacgccgccaccaccgtcgctgtcgcggcgccgccctcatcctctcccgctcgccccggctaggttgcagataagtgaaagagatatgaggaagggagagaagaggggaaagagaagagagagaggaggcttacgtggattaccctgacatgtggggtccatgtgggtcccgcactgactcagcagccacgtaggataaaacccgggtcaaaaaccgccgagggaccttaggtgaccggttttgattagttaagggacgcgggatatctggttttgcggtttgacgacaattttgtatctcgatgacaagttgagggaccttgggtgtactttttcctccatactattccacagagaaaaccacctcccctcccaagcaatgagtgaatgaggcccacgtatttagcgccaagcccacgagattcggagactgtttagcttcctgtagcccattttggcgaaccacgcgaccacggcgacgcttcatttctcacgagacgcgggcacttatttccaacgcggtggcaggcagccagcgacgctcccaattccaaaaacttaacactgggcttgctgtgtcaagggcttcagcttgagcagattgcagtcacatcggcgcggccacgcgcccggccggccggccggtaagctcggagtcagaggcaccggcgattaggcacttagattagctagttcagttggcttcttgcctacttgttcactgttcagtttttcacacaggttgcagacttgcagttgtagcatcgtaggcgaagcaaatggcagagcagcaggagcaggggacaaggaaaaagcttggccagagaggtaaaaacttgaagttggattgttaaccagtctattgtttaaactatgtcattttaaattttaatcaactgaaacaagtgattggattagatttggaattttggatcctatatgcagacgtgcttattcttggctcttggctcttgctaaaatttcaggaatgagggaattcttggttgatttgaggagccaggaggaacctgttgttgctgatcctaatggaaggcatgggactcaaattcagaacaagaacagccaccggaagcacaagatcatttgcaaccaagaccaaacatgagtaattctatcagtgagttcaatccaaatgaaatcatatgcgatccttgcttgtgtttaaaactgttgcgttttagtttaaaactgttgcgtttcgcaaccttgtttgtgtgtgccgcgtgaatgattttacgcatatttgttattcatcatctggcttgcggctagcttgcccaagctcatgaaatatcctggatccgccactggcacgctttgtgtacatgatgtgttcacatggatagttagatagctaaaatgtttcacttaattcacattagttatcaatatgtgtattctatatgacacaactaaataagttggatgaccctccatgtattttactctattttcaaggaagttaaattagagaaacggacagatatagtaaattggagaacagcatcctttcaccacgttagctctagcatgtcggtgttggcgaacagggtagtatttaccatatgtggttacctattaatgtgcccaaagtaaatacatctgtatgggtttacctatgctcagttttactcgatctgaagttgtgctcgaccccaactatctcctctgacttcttgaactagataggtgttttgctttatccgtgttctaaaaatcttgccacattctttattagataaaacaccattctagctactatagattttctttgacaacacaaggttaaagagagatatactttaaccatccaagtgtcctttgggatcaatgtgatgtcccaaaataatctgtggtgaagtactttattacatgggcaaccataggccctgagccccttacatccaaaggtttaaaataaaagatagcacatcaaagactatatggatcagcattcacaggcacttaatgatggcacaaactactatcaaagccttctcctccattatctcctaacccaatgcttagcaacccatattggaaatgcatagcaatgtatgagaacataatgaactagcagatagggtttattttgcgtaaaaccatagtttaaacagtcaaagcacatttttaaacatgttcttgatccaatgtcattattgtaatatcatcaattttgcgtaatcccacgaatctatcttaactcagctaatccacatgactaaaccatcataatccattctcccaagatttacaaagttgggactaacttggagtaacattattcaacatgctcattgtaggaacgaatacaagaacgaagcctcaaaaacgaaatctttttgcagaataaaagaaaccctttaacatgaaggagcacggtgtgacctcaagtagttatgaggtctgacctctcatatacctacagtctaacttcctgatctctgtagatgctctagtctgacctcctagatgcttccggtctgacaacccgggtgtcgccgatctaactttattgcatcaacttgtgtttacaaagtgcatctaacacactcatttcacaactcatgaactagaatcgaaacctcaaagcaaacctttacttttctctctaaaagttgccttaattttgagactcaacccctcgtctatttatatccacaaacatggctacctacaaccatgaatgcaactagaacaaagaatcctaatcaaatcaatgatacacgcatccgcttacaactccaaactccaatcttaccaaacttggtctcctgcttcccatacacacaattcttgttgtatgccatatgaaaacttcacctccacacacattattctttagccttaatatcttgtatgatctccttggtagtctagacctcaacttctcccaactctagtctcgatccatcattggcaatactcccgaggtctcaagagaccatatccaagtacaagttcttccccaacttgactcacattagcacacaacagtatatatcacatataaaaacatctagaaatcatatacattaagaaatcaacatactccataaaattaactcgaaatcgactccctcctgaagtctatcagcctgacctcttgccccatgtcgatcagagaaagatgatactccttacggaaaaaccgaaaagaaataccatcgtctgcatctagcaaggtgcaaacaagaacccgactcatctaccacagcaaatttctcccatcctacaacattccaaactctacgaaaatcaacatccatacctatcttccgaagtagtttgaggtcgtatgcttgggtgtgagcaaacgtcctatccttgagcatatggtaggcttgcatctctcggtcacctacgaggtcgaggtcggaatcatgaaggagtcttggcggaacattcgcatcctccatcgaaacatcagtcgacgaacgtgtgcttgactcgtcttggtgacggcttgatcgagaatttgatcccttcttgagcagacgggtgatccgtctcttcatgactacagacagagcaagaatacaaggcaaactcgagcgggggttaagttaatacaaaaaattatacctatcggttagtcttgtactaagataacttgtatatgcaagaaattaaatcaaaatgcaagaaataaacttgagaccaactttgcaaagcttgagaagaatttgagagcaagaggaagtgaaaatgagttgaatgtgtgttgaacccccctccactagctacttcacttatatagtgcatccataacggtcacaactgtgatgtggggcccactagccattgccaaaaaaaaattggcaggcgactgttgcctggtcggttcagccgaaccccctggattggtgaacccctagtgggcccaaccggccccacatttagccattggctcccaatggctaaattggtgggagccacattgaatttagccgaaaatttcattttatttttgctcagaaaattcatttttgtaaatttgtctcaaatttaatcctgatgcaaagtttgaaatctaaacatgctttaatgcaaaaaatcaaattgatggaaataaatatgtgatacgtaccaatttacctattggtgagggcaacgtcgttttgggtccgacgagcacgacctgttcctccatcatatttaccttgatgatgtggcacccggctccggaggtggaggagcggatgtcatctgtttctcccgccacaacttctttgtttttggtgcggcttgtggcttcttgactggtttcacaggctttttagcctgtgcatctagctttgtcgatacattccttggacagggcatgctcacgactgcttccttttccaggaagttcttcagtgaaagctatcaacctatccgtctttggtggcttcatttcgacctcttgtatgttctatggattcggccgtacttgattctcaccatagaacactgctctatccttggtcaaaactcgaacttctcttccttcccattgatgtggagccgtatactcccagctcccacgtcaatgttggcctctgtggtgctaaggaatggacgacccaaaatgagcggcgtctccttatctgagtccatgtctaacaccacaaagtctaccgggatgaagaaatcctagatctttactagcacatctccggcgattcccgctaggtagcggaacaaagaatcggccagttggagccgcatcagtgttggtgccaacaccgtgaagttgcttgtcgaagacctccttgggcgtgacgcttacgcttgcaccaaggtcatagagggcttggtcaaagtgttgtctcccgattgagcaagtgattgtgggacaccccggatctttcttcttttcctggagccagtggagtatagcgttgctacactcctccgtaagcttcactaccttcgtggttggcagtggtctcttgttatccagaatgtccttcaggtagcgagcgtatgtaggtacctgcattgcatccaggagtggtacgtttatgtggatcttcttaatgactttgacaaaattaattaacgagcgaattgctcgtcgatggatggcttttgatatctctaaggaaatggcagcagatttgtgtcgtattattcctgcggcactaccttctccttctaggttgcctcctcggtcccagcggtgttagttggaacagcttcctcgctattcctcctagttcatgcagtgttaggatatggcgaatcccgagtggattttcctcccctcgtggtgattgctttagcattttctatggagggttcaggttgccccggaatcctcccatattcatttgtaggaactagagcagctagttgcaccagctgagtttgtagcatcttattaaaactcggttggttttggaaagtagaagcaaagccatctagcttgacatttatattttccaagatgttatcattggtagctaacttcttgtttaaagcatcagtggttttagcttgagcaaagacaagatccttcaaggaaggctaattattaaaattaccgttattgttgttgttgctgcctccttggtagaatgggcagggctggtttcacccatgacctccttgtggacgatatccgttgttcatgaacattgcctcctcatgagtctctggacagtctgtcccggaatgacccgtgttcccgtagacctcacacatgatgtgtgagtctaaggtcttgatggtgccttggggcttgttcttttcctggtcgtccaagcgcttcattaggaggtccagttttgcggccagtatttccgtctccttgttggtatgcatgccacattaacgagtctagagtcgttctcgctccagcctatgtttgagaccattttctctattaaatcgacggcacatctaaccgtcttagagaagaaagctcctccagtagcaaccgctaggtggtcccagtacgaagatgttaacccgttgtaaaagctttgtaggatcagccagtcgtccttcccgtgatgacgacaggtggcgacgtaatcctgcagcctttcccatgcttcaagaatggactcatcccttgtctactggaagcttgagattcttccgcgaaaggcattggtcttgcccatcaggaagaacttcgagaggaacgccatagagcatttgttccatgtgtccaccattgcatggttagcgtaaaaccattgtttcgccttcccaaggagggaaaacggaaacagtcagagcctgatggcatttgggctgatgcctttcatcgtgtatgtgctacaaatctcaaggaactattgcagatgagcactagcatcctcatttggcttgccacagaaggggctagcctgcgccattctaatgaggctggtcttcaagtcgaagtaaccgtctcccaagtcgatgtgtggcccaatgggcacattgttagcagagggagcggcgaactcacgggaggtcttctcagccatattcttaaagctcggggacgctgggatgactggtttgtttgtcgacaaagttttctgtggagggacaacttgcgaattgacacctaaaaaaaacttattggttgtcttggaagtttttcggcaagtcaaaaacagtcatacactaccttgttttcacaacaaagtaaaaacaatcaaggttagcctgtaaaggacaatgattatttagaggtaaatataaagttattagcacgtagtaatctcttaatcattaaccttcccgagcaatagcgccagaatcgcttgttgatatttcttaatgatattactagaaatataatccccagtaatggcgctgaaatattcttggtatattatggtcacgtatatgatctgcaaacgcacgaatataccattggaacatttcacttggaagtattccaaggtatcgtacttatttaatcccaagggaagatatgataagagagcactatgctaataatttatatgttacttgtatacatcaaagtctatataggggttagttaattcaaaagggtacgtgacacgaagaaagaagaaccaagataatctcactaaatataatctacactaagtggaaaaagaataagaaaagaattcattcctatacttatgttacacagtcatctttagtttacacttactattatacaaccatgtagccaataccccccccccccaactacgccctcctgatgtttcaagagaccatccctaattgtcgagttccttacgacaatccgtcatggccatccaactggaaatgaatacggaggagtacccatacctggaaagtgtcttaggaatacccctattaagttgtcaccatcagcggcccacctctattgtccgcagtatataaccccaaataatggtatctactaatctaagcctcatgcttacattattaaatactactctatgtcctctagaatgacatagagcaatcatttgaatgaacattaaaccccacaccagtgcatatctctagtaagctagctacataattatattaagacaagtataaagtaaagtcggtactcagataatatggatgaagtaaaatactgaagctgaataaagaagaatatttcattaattctataagtcttacaaaagaagtagaagctaagccatacccgaaatctcctgaagactcgaggactaagagaactattctaattctactccaccagtacaagaacactaagctaaacttcggagagagcttgatcttcttcttggagtgtgtgttggagagtgaatgagcacccctttatataacctctcagtgatggttatggcagttggaaatgccagaaacgccctccaaccgtcattgagagtacatctggaacgtccacgtggaaggacgggatgagtggctatggctagggtttggccgaacctaggccggcccatccagcctccacttttggcaggtgcatcttttgttgggctttattctccgtaatgtggtggttgggcctatatttaatgttattttactagatttgtaagcccatccacccataagtttatctcttgatggacagtgattgattattcagttatttttcatagattctcctccaaatatgtagcaatatctgcaaacaaataaaatccaagtacaagtgaagatagagtattctaaacaaaatatgcattgcagatatagttagttgtcctttattccaattatatcgacggtcgaaattggtctataacgatcgtcaacacctaccctcctcaatggtcaataggagaacggcaggctacagtgcaagccgattgttggtcacactagcttgtggtaagtacagaatgtcccctaaggggaacccgagaaccgatccttaattggcatcgatgcgactatcaaaacaatgcatccatggtctaccattaagaccaatgaaccatggccaaatgtcatgagcttgcaactcatcaagtaactaaagtataaagcaagttattattccatttgtgacatagtgagactaagcatggctaagtgtaacctatttctagctaggtcaacttgagagccctaggctagtcaagttaacacccgaattatgaaggaataagtaaacaataaacacaaccacataaagtatacataggcaatccctatccttaagtaattaatgaaacagtgaattacattagcggtacatcaacttagcaagtaggtgcaatgtttttagtgcaacaactggagaagtgagcatgctaagaacttaagaactgatgtaacaatttaattattttgaacatgttttttattatacacattaagttttcaagtacttattttatgaatatgcatgcgtagatttgtaaatttgaacttagcgaatgagcaaaacagtacatcaaaaaacagaagcaatacatggaagcatttgtaatggaattttcacaatttctgaaaaattatgcaagtcacattggaccaattcaaccgatcgagatgatccacgggagaccgatggccaggatttgcctacacagataaatgaccgggatcagccgacacacgatcatgcgggctcatcgtatgatggcgcacggggcggccacggcagactggcgcactgaggtggcaccgacatggcgccactgtggtgccgacatgggcaaccaagggaaagggccacacggatggcccggatgaggttagcttgcaggacagtccgactggacagtggtggcacgtggcccaatggatgctggtgcagcacccatctggcttggcgatgagctcgggaagcggcgcaaaggagtgggacgggatggggtcttcaccgaacgacgaggaggacgtcacgtggagctcgacactgaggttctggtggtggtggccttcagctagcagtggtgacggtcgtctggatgcgcttgttgaggaaggagcagtggtcgagtgtctctgggacctagggattttagaggaggggttagggagaggagtagtgtgttatagatcgatggccagaacccgacgaggcgaagcgggcttatgagggatagcagccagggaggcacttgggttgtcaccgacatcgaggaaccggcaaccggaattgctctcaacctcaagaagacgtggaagggttttccgttttcatagtctcgtgaagcaaacttgaggcctgggatgcggagtgaggcgacctggagcgcatccacctcgtttctgcaaacgagtgggggaggaggcaggggagcagtagcaatgtggttaacgtcagcccagacgcctcggttggaggtcagggttggatccaacaagttggccccatgtatcggtgcacaagggcggcaacggtgtagggggtaagccagcctcactaaaagaggtatactccctccgtcccaaaataagtacagttttgcactgttcatatacaacatttgatcgttcgtcttatttgaaatcttttgatgattaatatttttattgttattagatgataaaacatgaataatactttatgtgtgattaatttttataaatttttcaaataagacggacagtcaaacgttggacatggattccaacgactgcacttattttgggatggatgtattaattggaagttttagtctacttggtagaatagactggtgatagaattgtttggtggtattatgtgataccactgcaatgtagcactatggatgcaattttctgttttaacatttgagtaaatttgaagcacagctgagggaaaaacaaatgatcatatagtactatttgcttgagtaacactgagggtattgttggtgatatgccttagaggcaatcgtagagatgattatatcacatactatgtttacatatttatccgacattgttccttgaaatagataactcattattgcttaatgaatatgtgattctttcatgagactttttatattgtatgttgctatttctaaaggatccctgatcaaatatcatatgtggaacaaatatgtttagatgatcagcacatgtattaattgatgatcatgtctcatagatcatggtacagagataccgaattaataatgtagacacatgttcggaaacatgttgttggatagacccaacatgagacattgcaagagccatatgtgttgtgtcatcagtgatctcatttaatgttagtattgaatcattagacctgagattatcatggttcccaacatgtgtagtagcttacttagggactgctaatcgctactccataattgggtagttataaaagtagttttcgggtatgctataaaacatgttgtgagatatgaataataaagataggatttgcccctcatatggagagatatatctgggcccctcgatgttattgattatggaagtgcatggccatgccaaaggtgattgaggagtcaatcataagctatataatctatcacaagttcgagtgaatgattgaactattagaggatgtcccatatctagccttgagcttaatcgatatcgtgaggcaaaggggttcatataagtttacactagaagttcaaccgatatgatctttatgtatgctcggtgggtcaatacgttctgctagggaccgctgttgacacgtggaccgaaaagaagttttcgggttgcagccgagtgtatatgaacctacagggtcgcatgtttaaagggctagaataaagagattggatggatggagagccaatatgtactcaatcggatagggatacgagtaggactcctatgagcctcgaagccccagtcgtggatcctatatattcgtgagggggtgtgactggcggaattaacacaccacgtgaaatcctagccgtgactcccctccccgagcaaaccctagctgcgcgcgggtgctagcacatctgcccgtggtgtttcttccctggacatgtggataccggtagaggcgcctctgctttgcggtgctgattggcatgggagcacggcgaggagaacgcacgaagaggagaaggtcgagccggtgcgatcgactacttcctctacatcgacgcgcactaaatcgcgagggttccttcaccttcttagtgcttacttccgctgcgcagtgcgtcgagtggtaacgatctatgatctaatacttgcatgattcctggtttacgcgctagaaaattttgatttatgctatcatagcctgtgcgtatcccaacgggtatgaccaatcatttgtttaacatcctgaaaatgaaaaatgatctactacagcacaaaacaggtaattatgcaattttaaaagtactgagcaaaatgctctaagaagaaatatgtgtatcgatctaggacaagcactaagcactctgatttcaggagttactctttaaacataaatcagaatggcgatgtccaaagttggtggcttttgtcagaagcgacaggttgatctctaggatttttttttttaatttttgctacaagttcataaggaatactgaaaaacattttacagcatgtgatgtgtataacagaagtagattattttacatttacaacattgcacggttgcaggtatacaggatctgagtcatgcccgttctgctgcgagagtctgatatacccggagagttttgggtactcagcttcatcaacagcttgcggcttgcccgcccctcacactgacagtctcttgatggagcctttaatttttactgtaccttaggatgattagggctgtgttccggaaacgagatggtttattaatgtataattgattaaatattagctaaaaataacttaaaaatggattaatatgatttttttaaaaacaactttcgtttctgacaacatggtggtgaatgttattagctttttttttttcttttttttgtaaaaaacacacgttcagtagtttgaattcagcctaaggccatccattgtattggatccaatgaatttgaatttgttgtactacgcctggtagtatgagtaatgaataatttgataggcataagttggaaataaagtatacggtaaccgaatactattcatatttaaacttcgactattcatccttttaaatacacacacgcacacacacacataacaaagacgccatattatcaaaggtgttgcatccttcagactgacatgtgctgcctgccccttcagattttcaactgtatatgcaacagcagagaataaaatgcaactttcgacataaaacctgttcaccgtatgtctttatctaaaacaacctagtaaagaaaagcaaaagtactgcaaatacaaactctagaagaaacactagtacatggggttgaaaaaacatcccatcaagcatttcatctggacactactatctgctacaaactgtacaccagctggttgggcagtgtttgaaaatgtacaaagctccaaccaaaatcaaactcgactcatcagacgagggtcagcgatcgaggtttcgagaaaatgctgagctttcttgagatataccgagctgattttgatattggttgtttgcagatcgtgccaatgggcgaattctctgctgcaccattgacagccacctcacttgaacatgaattgccaaactggtcgctttgtctagagtccctgagaagttgaagcaacttgattgaagaagcctttgcaacctcagttccattgaccgacaaatcgaccagcgcagggatgacaccttccttcatgacaagaacacaatcgtcgatgctgcgagagcataaggcaagaaggatacctgacgcatgctcgcgttccacggagcttcctgtgtccagataatctgaaatagaactgaggcattgatcagttctgataatgagatccgcagcttgtttcccttcacttaaatttagtagaatctttaggcaacactcaggcgatttcccttgactgagaattggagatagctttgagattattccagaagaaattaggaaagattgtacatcatttttgaatgaaagctcgcagatgatcttcaaaactagttctaggcacagggagtctgcactatcccaagctagaaacacagatggagcaacaacagatgccatgagacgagatttccgacaacttggttgctgcagcagttcatggagtatctccaatgcttcagtttttaactctgaatcaagaaatgaagcaacgagacgcactgcatcttcactaatggatggaattcgggtcctgtatgaaaaggaaatcagccgttacaaaagtttattggagaacaaacaaaacaaattgccataatctgaaccctttgtttttaaaaagtagcacaaaacaatcttcgtttttggaggataaatatagggcactcagttttatttatggatttttattgaaaaaggtagaaacaggaaatatcttatgtttgtcaacagtaaaatctgcacaaggagatttttagataattaatgaattaaaaccagagctctacatccaacatggttgtacacagccaaacacaaggagaatatattatacaagaatgctcacctgctattacgtagaaaagcaagaaaaaactgaatgccagttctttgagcttccattgtgcattttccattatcgttcttaagaaactcaagaaatgcttctaaaaaaccattggaaatcatagaacgccaaatttgatattcacgattcagaacacttttgaaatctctgacagccttcacttgaagttccattggaagctcggacagctcgtaaaagaaattcagaaacatctccttgttgaagctgctgaaggacaaatacaactggtaataagcgtttgaaaaaaactgagtagaattagtccttgactcttctgtttcccgcattggagatgatacataactagaaccagataatgcaacagatgaactgctatgatcagacatgtaatctctctttgttccagcaactagaggtgctgagatattgtgtagacttgaaacagagtaactatgaaattgttcaggtaaagaagtgaattcaagctcattatctttgcaccagttgcagatcacagccttcatacaagtatttggagtaatcgtgaaattttctaactttaactgtgtcctaggacaaatatcatatccctcactgaaccatttctcaatgttctctctctcataggtttgtccagatgctattatcacaggatcgtacatcagcttcatagatagtgggcagcagaactctggaggagtagaaaatcgtgacaaattattctgctcttcacatcttccagtccaagagtttgtaggtgaaaagcatttctgtggagcatcggtaccactagcaattaggtttgtactcgaagtaacgtttgcaacatccacaccttcattctttgcactaccctcaggcttcatagtctttccatatttcctaactagatattgaaaaaatttgagtattccttcctttttgggatcattaccattgatcttgtccagtagtttcttgattgctcgtctttcaattaagatagcctttggtgacgtcaaatttaactttgacgctgcaaacaagaaagtctggagttcatgttcttgggttgcatcagactgccgaagcatctccaaaatggctttgccagcctcatcttcttctgggtcaacaatgaatttcacatccccaagatcatcatgaacatcagccacctaagacaaatagtcaagtataaacatgttaatgtgacaatctgtgcgatatttagataatggaagaactcattaaattgcatcgagatgatacaattgtcctgagaattgatgtgtgtgtttatactcacacatctgccatgtaatctaaaaaatcttttggagaaacaacaaaaaacatagatcatgtttctggatacagtactgtctaaacctccagataaatgtttgtgaataatatcctgaaattgttaggttttgttgatgccccagaaataacagacgcaagtactgtccaaggagagcttcatctctattacagacgcaagtttgatgttgtttgtgtcatcactagcttcaaacttttaacacagcaaaccatgtggttaatgctgtgcaatgtagaaaaagtttgcctgttattatcagttcaattaagtaaactaacctgattagctaatgatgacgggaccatattctgaaccaggaacaagcttcgcctcagcgcatctcttatcctttcgcaccgcattgcagttgcctcccctgtaatagcctgagatgtgcaaatttggtatcagaaagcaattgttcagaaaccagggaaaacaatctcaaataaaacaataagataaaaacaaaggagtcattatagtttcctgaacataatgactcatttatcaatattaaagaacaacataccaagtaaagactactgcactcaatgcagttctggattatgagttttcctttgtcaactatgttgtacaggttgcatagttcctctatacccgctttacatcctggttgagcagtttcgattgagggaagaatagaagagactttatctaacatcattgtcaattcactgcacattgagctgtgaacctaagacagaaagacaaaagaataattgcattaactgtaataaaatgttgaagaatatataatggggagataatcactactgaaaactatctatgaagtaaatgataatatttatatgaaacatcaaataatgatcttattgaaatactgcagttttaactctgcctctcaacaggtacaaaggaatcacatcatatcatagataagcatgcaagaaaaaatgtttgtatcaaagatatgttctttatgccatacaaagatatgatctttatgaggaaattattgtgcatctatcttgaatcagacaaagaaaacactcccaaatttgaactggatatgtgaccaattgaggtagtctcaaattctttgccatggagtcacaattttacacagcatttaccatctatagtgatgtgtagtctaagatttgtgtgcatgttacacaattaatgatatttactcagggataaaaccttaaagaactcaaatttcatacccatagatctttctggtactaagaaagcaacgtaaaactatttccaaccaatcaaataatgcaaatgataaagcaatatcataagaacctatattccaaacaaaacatggacggcaacaggtaacaagaaacattactaaaagatgaaagtttcagcggtccaatatccatacctttggattagaattacgccaggatattccaatcactccatcattattattctccatcgactaacagtaatccgtgataaaagtatcaaactgcccaataagagtcaacatacagtataacaatatcagcagaaaataccaaaatgatcatagctacaaaatactatcaattgtatggcaatcgagaaccttgggggcttgtgctataggatcatattaaagcaagatgcaaataaaggaacattgtcaaaacaggcagaaaggttacgccacatcaagctaagcagtcagttgaactttatctgaacttttcttaacttattgtagatatcctttttgtatttgtacgtgagtcatgcaaataaaaaaaagcaagtgctcagctttttcgtctttttatttgcaattaggattttttttatgttagtacagcaggaagaaaaaaaccaaattgatatttgaagtagtacagtttatcatacgtactcctggtggtgactatctaggtccaacacacattgtccaatgcagttcaaggtgatgtactcaaattctaagccgaacatgtacagcagggtcaaatcttagactaaagactattaataacacaggagatcggtgcaaattgaagagtgattctgatttcaacatcagatccaactataggtgaaagttgattaattggtctgaatgctgatttgtttttcaaaaatctttcttgacagttggaagttttcagattaacctagcagataataacactaaactttcttactatatttattttttaaaaacaattctaccattccacaaaaaaattgtatttcagaagacatataagcttctatggtctattggagtctctaaatataattgacatgaataagatatttacagaagatctacaatgctccaagagaaatatgcatattatgttaaggaactgtttggttaaaaaaaaatttcttaacataaaaagattatgcggggataaaaataatatatttttaagcacctgtaacaactcagtgccaattggttggtgccaatcaaataatttctctctaatacatgcttcacaatcttggtattctatatttactggaaaagaaatcattcgagtgaaccaaaaaaaattgcaaacgtaactaaattcttccaaaagaaaataattatcacttgccactatgtatctagattgtagacgatcaatcgtagtcagtaggagtgtaggaccacctttttttttttgttttgaaaggtcaattatactgtacccttttctttagtgggaatatgctgtaccatatgatggaatttccaacctaaaggataacagagagctcatacacgaaaaagaagggaagcggtacgaaagtaaatattttttaaacagataaaattaacagagcactatcctaagcaagcagataagtacataaagggaaaaggtaaaggagaaaaagtatagtggcctagagaacaagagattcggaatagagagatttgaactcaaaaagtaaaaaggctttatttttgaaatttcgttctctacatctatatgcagagcaataagcaactcagaatactgctgaggaagagctgagaagataggcacccacaagcgaactccagcggataatcaacaaaagaatttagcaaaacaaagctcagcagaaggtgaaacttgaggaagaaactgacctcttttggatttgcccctcttcctttcttgtcccagagagcaaaagtgattataatctgctggaatacacaaagatagcctaaaaaaacagtgattcatgcgcaaaaaaaataatttaacatgtaaaaactgactcttttttttaaaaaaaaattaaaaataaaaagggatgtaacagaacaaaagagtaccagtaaactgcttctgtcctgagtttctggagcagatgaagaaaccttaaactgccctaattaagcagaggaaacattcaatagatgctgagaaaaaagaaagaaaaaagtaaagaagaaacaagacaggttggaaccctcaccccgcgggacagatagaaataatcttggctggattcttggctgacccagactagttctttcgttcacaagattgggttcttcccccctaaaattgttggacttagctgctgcagcctgcagctagctagctaccgcgggatcgattcggcgggactgcctgctacatcacggcgacggctgccgctcaagtgggaggaggagaagcaagacgccggcaaggggtaggatcgaggagggagagaggacgaaacacgaggacttctccttcctgcgccggtgagacctgagagtgagtggggagttaatggtacggactacggagagagacgaggagtactagaagagaacggaaatgcttagagcagttacagtagtaaactattagccagctacgactatattttaatgagataaaaaaggagagagctaccgatcgggcgcccgatcggggccggggaaatcgggcgctgatatcatgctgatgtcagcgtcagatttacgtgtaaaactgttttaaactgatttctcttaaattacttatctaaattatgatccgattacaccattaaattcgttgcaattaaatcttcaaaacaagaccacacatggatatattccgacgaaaaaaattagcttattattaaattatttttaaatattacacgatgttccaccaggtatatcggaattgtttcactaagtagtgcgaaaatgtttcactcgtttaaatcgggtgttgtttcaccttatataaaagcaatgtttcagcaaatagcgaaataatgtttcagttcactacaacattagatctatacatagtgaaacattgtatgtacactaggtgaaacatttttcggtagaacaaaaaataaaccaaattcctttaatagggagtttccaaaatatatggggttttttttccaatggaatgtttcgttcactataacattaaatctatacatagtgaaacattatgagtgtactaggtgaaatatttttggtggaacaaaaaataaaccaaattcccttaatagagaattttcaaaatatgtgggttttttgttgcaaaagagtattttaattcactgcaacattggatctataaatagtgaaatattgtaagtagactaggtgaaatattttttttggaaaaaagggagaaagaagtgggtgggtccaacagtacaagcgtggggagggacgcgcgggggg

SEQ ID NO: 61806 - DNA, 3647 bp, Oryza sativa
  unsure (1)..(3647): unsure at all n locations
ccatagaagagaaatccaagccgtccatgtgaagccagatagcgggaggtgccaggattggttcgcccaaactgncggttcgccgaaccaaaaatccgtcctcctggcctcttctttggtcggtaggttgcttattgggcccccaacatcttgcacaatgttttggcccagttctaagtagttttggctgacatatggtcctccaatccgtgtaaacgcatcctgaatgcgcggaggtccattttgtcgcatgacggatgtgttttctcctcaaaatacctgcatacacatattttaccaacactagtgaagatgattagtaatactacttaccactaagttggataccatgttttatttcattatatgcaggtattgacggttagatattatgatttaaggatcgtcaacaccatgctgaacacgtctccatttctgtagttgtgacaagacccctcgcataactcaactcagagaggcgcaactttcctggatcataatcaccccattttagccaaggtatggactccccagcgacccccatgggtttatctctggcacttcatagtttggcacaccacaatgagccttgctatacaaagtgtcaagttgttgcccatgctagcttgtggttggcacggttaatgtttcacaacagtagctcacgaaccggtccttaattgccatgagcacaactatccaaacttcaaaccatctactcacaacccaccattaatcaagttttagttggcaactaattatccaatcaagattgaccaccgtgatcgaccattaaatatctatcattaggttatagtgaagctttagttatcccaatagtttgctaatatttctaagcatagctaagaaattatatctaatatctagctgaaccaatatataaggcccagactagtcaaattataacccattggaaaataaagttgtcgatttctaggatcggtatttgttggcagtatgtcatgagacccttcgaccagacctgccgaaaccatgcgaccagtcaggattcaggtttaaggtgttaagttcaacggggcgaagccccacagcgaagacgccgaagccacatggcaaagacaatggagtgaggacggcaagagatggacccccatggcaaagactgtacattctagacgaagggtgcctgccgaaggagggtggcttcgccatcccggtcgctctggccggcccttgggtcggcattcgccaaccaggcccattagaggcccatgaatgcaaatgacactgtgtacctatgtaaatgtccccttcataagggcaaccatgtaaattcccctgtaaaacctaaaccctaaaaggagaacctgtaacagggttataaatggacccttaaggccatgtaatggggggatcccgaagaaaaattctcaatttaatacactaccattttccaaccactgttgagtgaccacgtctttcgatgtatgcatttgtcgcttcgacaatagtaatatattttatagggtacgctagatcaaagaaagtgatggtgacacaaacgtttatcctggttcaggccctcagagtgaggtaataccctacattcagtgtggtggaatatctgtatccggtggaaaaaggagatgatgtatgctcggttgtggagatgatcatacctctgtcctctcgggacccccgccccctcttatataggatgaggggtgttgatggtccttaaatcataatatctgaccatcaatacctgcatataatgaaataaaacatggtatccaaattagtggtaggtattattactaatcatttccactagtgttggtaaaatatgattatgcaggtaatttgagtagaaaacacatccgtcatgtgacaaaatgcacctccgcgtattcaggacgcgtttagacggattagaggcccaataagtcaataaaaacaatttagaattgggcgaaaacatagcctaggttgttgggcacccaataagcaacctcccggccgaaggagaggccgggaggagagtttttgggttcggccgaacccaccagttcggccgaaccaatcccggcacttcccgccatctgctttcacctagacggctcggatttctccactaaggcgattgcagggtgttttggtcatttcccatacacctaaccgtcatttggagcctatataaggaggctaccttcttatttccaagacacacaactttgtgctgaattacaagaggctctattgtattttttgtacattagaataaggtagagagtgaggggaagctctggaggagtgcccggaagtttggcactcatccaacttctacctcgacgagtgtagctttcataggaggaattcgggaggagtaccggagctgtcattacactctacttcgggatcggagaacttcttctataaagtaagcattcgtgtttctttcttaagttatttaattactttgtttaagtaagatagatttccatctttgcgggttcattgtttagttttttatactaagtgctctagtactaggattctggatagagaaggaagttcctgcgcgagtattagagtagtaattaataacttagacgtggtgtctaggttagggattacctttgtttcttgtgtatcccacggatttgttagaggtaggcagcaggtggtgacagccctgaatcccgtcgtagtaatcctccacgttgggataaatcatagagctatagccagaaccacgctggcagaccagcaggggacggtacccgaagcaacagatagagaattaccttgcttagcgtagatagttaaaacacatagaaagtcctctctagcctagcctacctttcatcagttgttgtacttggatagtcttagccttaggtagtctacacacgttccctgagttcgatattcttttggagtcacccgaaggtgaagtgctatagctgtattccgtgcgcttgcggatttatctgtggtcgtaagaaataccaacaagcatttctagcgccgttgctaatttatccgagtcgaggtcattctcgtgtctttattttttatttctcttcttttattcctttccttgatggagcaacccaaaattcaaaacctttctgctcctcgggttgatctttctgagccatcctgttcttcaaaatcaatcctatccgatggctacgaaatcggtcctggctttatagccatgattcgagagcaaaccttctctggtggtattggtgaaaatccatacctccatctttgggactttgagctagtgtgttcatgtttatccatcgtaggcatgacacatgaaactctaaagtggaagttgtttcctttttctcttagagatgaagcgaagcaatggtacactctgtctgtcaagaaatttcacggtgaatgggaggagcttaagtgcaaattctgccttgctttctttccattaacccgtgtaattaatcttcgattagacatcctttctttccgacagaatgagaaggaatctctcgatgcagcctgggccaggttctcgctgttaactcagtctggcccagacttgtctttacccgaccatgtgttgttacaacattttcggtacggttagacaaggagtctactgcaaatctcgatatttccgccggagg

SEQ ID NO: 61807 - DNA, 2763 bp, Oryza sativa
tcgtgttcctttcttatgttatttaattaatttgtttaagtaagatagatttccatctttgcggtttcattgtttagtattcgtacaatgtgctctagtactaggactctggataaagtaggaagttcccgtacaagtattagagtagtaattaataacttatacgtggtgtctaggttagagattacctttgtttgttgtgtatcccacggatttatcagaggtaggcggcaggtggtgacagccctgaattccgtcccagtaatccttcacgttcgaatacatcatagagctatagacggaagcacgctgtcagaccagtaggggtcggtgcccgaatcaccagatagggaattaccttgcttagctgtcacgcccgaaaattcactagtaatttccgaacttatttgtgcatcaaatcctcgtccaggaatcagccgaggtacacaaactgacaatttaatgtacagattcatcaaattaactaaaacgataaatacttacttaagaggcactaagtcctcaccatgaagaaaactgcagcggaaaataaaatctagcgaagctccggctccactcccacaggcagctcaactggggtataaaccagacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagcaaagagttaagagtagtaaaacagtagagtaattaatcaaaaattttaatcaacactggacagcacacctatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaataattttactctggccagaggtgtaccactgtacccacaagacacagccccacaacatgtcaccatgtgcctcaatacaaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctagcttgtggttggcacggttaatgtttcacaacagtagctcgcgaaccggtccttaattgtcatgagcataactctcaaaaccatgtgctcacaacccaccattatgaagttttagttggcaagtaattaatttaccaatcacgattgaccatcgtgaactatcattaaaccatcattaaataatagtgaatcataagttatcccaataatgtgctaatgtttctaagcatggctaagcaatcatatctaatatctagctgaaccaatatatatagctcaactagtcaagttataataacccaaggtatcaaggaataaagtaatcaatgcaaacaggccataacaaaagaatagatttacaccacccagtgacatttgaaaataaatgcacagttgaaataaatagagaatttaaatataggatcaacatgctcaaaggattgtgtttaggatctgtgtgacttgccttgtaataatcggtcttcaattaatcttcttgaatacttccggcgcactcacgaaccttcgcaacaacggaaacgacaagctaacacgcaaaacgaagaaaaagactaacaaaaacaaaataaacaatacataaaaagtaaacaaacatgtagatcataattttagatgaattatgagacttgaacggcctcattctgacttcaaatgaatttattatgaattttactagattaaatctaattaaagcccatttaaaaataattaaataaatttaattcaatttatggataattttaatatgtagatctttattttatacaacttttgcaacttgaaccacattaaactgagttacaatgaattagttatgaattttcaaagattaaatcggattaaagcatttatatggattttaattgaattatgacgcaataatgaattatttttgaaaaggaaaaggaggattattccgtcatcaaaggcggtccgggtgcacgggacggtctaaggaaacgaatggccgagatcgattctatccaaaacgggcggccgagatcaacttgatctaccgcggttcacgggacaaggcgacgatgacgtcaacggtgacgtcagcgatgacgtcagcaccggcggcggctcggcaacgcatgctcgccggtgaacgacggcgcgacgacgcaaacggaggacaccaacgggtagagggcgacgcggcgaactcaccggtgaccaaaacaacggcggaagagcaacggacggcgccggcgacgaggaagaagcggcgacggtcttcgggtcgacggtgacggcggtgctccggtggtcttcggctgcggcgaagcggtggacggggacggcgacgacctcgcgatcccaatggtggggatggcgaccaacgacggcggctgcaacggcggcgcggcgcggctgaaccgacggcaacgacagcgacggctagggctacgcggaggcggcggggctgcaggaat

SEQ ID NO: 61808 - DNA, 2025 bp, Oryza sativa
ggatttaaaaacatttttctatttaaattattcatgaaatgcaattccattgattaaaaatacttccttggctcaaataaatctcagaaaaatctaggaactatagaatcaagtaaagtatttaacaaaattttatctagcccaattttatattgagatttaacaaattaaaattagatcttctcttttaagatcatttctaattattccttttaaacaacaatttataatttaaggatttttaaacaagaaaagctcttaacaattataattagatcattattgatcaaataattactgaactattctttgtatcatttaggaattgagctctgaaaaatccgagaaaatttcagagagttgacttaatcatggagaatttaataaaaattaaatccatccatgctttatatttgggaaattttatttcccacatttaacttcacttgtaaattaaagatcatttaatataaattctaataataatttattaaataatttataaatcctgaaacaaaaatcaggatgtgacattagcgtagataattaaaacacataaaaagtcctctctagcctagcctacctatcatcagctattgtccttggatagtcttagccttaggtagtctacacacgttccctgagttcgatatccttttggggtcacccgaaggtgaagtgctatagcggtattccgtgcgcttgcagatttatctgtggtcataagaaataccaacaagggggagggttacaaggaaagtatctactagatctctattcaatctataaaagatatgcatgatcgccgaagtttatatcttatctcggaaatgtctttttctttatttacaagatagacacgtgagcctaggctgctggcccaccctatgccccatggcccaaaggcctctccttgatacctgggtaccatgtaacccacaaaagtcatcttcggccataatatagggaaaaggctcaccacccgatgtcatttgaaaataaatgcatatttgaaataaatagagaattcaaatatcggatcaaaatgatcaaaagaattgtgtttgggatctgtgtgacttgccttgcaataatcggacttcaattaatcttctggaacacttccgacactctcacgaacctccgaaacgatggaaatgacagctaacacgcaaaacgaggaaaaagactaagaaactccaaacaaacagtacatacaaagtaaacaaacatgtagatcatgattttagattaatttagagcgttgaacggcctcattcggactttaattcaatatgaattagttacaaattttacaagatttaattcaattgaacctattaaagaaaagactattcaaattaattaaaaaatttacaaataatttataattgagataaaagattaaaagcaacctccggaaaagattatatcatatttggtagatgacatatagtaaaaaggactaatatgccattgaaaagagagaaaaggatttatattgattttggacggctgcgattaatcttgaccaagagttgacgagatctaacatattagctcgatctgatataggtgggattagtttttccgtttctattttcataatcttcttagtacagctcttggagaatttatcccctcatatgccagctaacactggccccacacatcacatggcactcacacctactccttttacaaagtacgctttctcttccgtatcgcgcctttacactttacgccttcccctgttcctcttctgttgtcgccgccgttgtgtccatcagagtgtctggcgtgacatttgcccccccccccccccttccccctccgagcaggagcttgtccccaagcgattggctcaggaaacctggcacggaccacttcataatcttcccatgtagcccactctggtgccagagagccccaacgaacaagctcttgaaccaccaaggcattacctttttttgaacatacggtgatccaaaattgcagagggaacaattcagtaatgtccagctg

SEQ ID NO: 61809 - DNA, 11871 bp, Oryza sativa
tgacctggcgcacctgggagaagggtgcggccaccgcgtccacctcttgcttgggcttcaaggctgcgccaagggtgccgccgtagtacgggacgctcccttgactgtaggttggttcatggcatctcttgaccgttatgttgttgtgtttggtttatgagtaggagtgtgtgattgagctcaagaaccgatctttggcttggagagaatcattgagggaaggggagtagagacccgatctattaatcttggaatgacgacgcagtggttctccaatatggtaaatttttttgtcatctcaatgttatgttaatcgtgctgtggattcgagtatggtggtgtctgctgatatcgttcgatggtttctttggtggcaggtgatggatgagccaagcttttttcaccaatggcattcggatgggctactggagcagtacacgaagcggtagatcaccgaggcgttcgggcaggccagcgaggtggacgcggtggcgggggagcaccggccgtggaaggcggcgaaggtcaacactagctgggactcgtgcatcacggagtagggctctttcgcggactcctccttcggcggagagagccccgtactacgacgccccgtactacgacggtgcccccagcgcggccttcaagcccaagcaggagctggacgcggcagccacgcccttctcctaggcgcgtccagtcaagcggagctacaatgccatgatcgccgcctacaatgcccttggccgctgcctcccggcctgcctaccagaaccaggaacacatcctcgccgagaggaagcaccatggcctacggtggcagtgggaaatggcctaagggcatttttgacatttcacacgatttctcactcctcacccagaaattattattttaatgggttctgtgtccaccagcaaatattcaacttttgagagtgtcttcccccaaaagtcacttcgcgcggttgccattaaaataatatcaaatgggctcaaccactacactactgggctgagtaatcaacgaggagtgcacctgtcaagttttgggccagttgggctaggccagggttcggccgaaccctgggttcggtcgaatccccatatcggccgttgacatccaggatccctccccaatgacggttatgtggtatttccgaccattccaaccaccacaaccatcattggtagcctatataaggccatcatctcttccactccctcacacactccaacaagaagatcaagagatctctctcaattttagtttagtgttctagtgctaatagagtaggaatagaatagttctcttagtactcgagtctttaggagatttcgggtgtacggctctagtagcttttccttcttttgtaagacttttagaattaatgaaatcttcttcatatagcttcgttcttttatttattttatattatttgagcactgactttactttatacttgtcttgatataattgtgtagctagcttaccaaagatatgcattggtgtgggtttaatgttcatgcgagtgatttctctatgtcattcctagggatgtaaagtagtatttaataatataagcgtggtgcttggattattagatatcattaattagggttatatactgcgggtcagaagaggtaggccgctgattgtgacggctcagtacgggtagtcctccacgttagtatatagtcctaagacactttcctggtatgggtactcctctgtattcatttccggttggatggttatgacggattgtcgtaagtaactcgacaatcagggtggtctctcaaaacactaggagggcatagttagggggtattggctacatgattgtatactagtaagtgtaaactaaagatggctgtatactagaagtataggaatgactattttcttattctttcttcacttagcctagattatattttagtgagagtattctggttcttccttcttcgtgtcaaccttatcctatccttgaattaattaacccctgcatagactttgatgtacacaactaatatataaattattagcaaagtattctcttatcatatctttccttgggattaagtaaatacgataccttagaatacttccgggtgtaatgctccaatggtatatccgtgcgcttgcgaattatatatgtaaacataatataccgcgaatatttcggcaccattgctgggaattatatttctagtaatgtcactaagaaatatcggctatgcctatgcaatgtttctttgcttcacggggcaagatgtccgaacaacctgtctcacctgagaaggaggctaagtttgaggtgacggattgcctgttccgtgtagcattaatcaatgtactagctgacaacatagtggacatgtatatgcacatgccttcagggaaggacatgtgggatgcacttgaggccaagttcggagtctccgatgctggcagtgagttgtatgtaatggagcagttctatgactacaacatggtcgatgactgatctgtagtggaacaagctcatgagattcagatgctggcaaaggaacttgagaacaacaaatgtgtgttgtcggataagttggtggcaggtggcattattgccaaattgccacattcgtggtcggactttgccacttctctgaaacacaagaggcaagagttcagtgttactgatttcattggctctttgggtgttggagagaaggcgagggcaaaagacaaccgcggctaaaaggtcgagggaggttctagcgccaatttggtgcagaagaagaacccccatgcatctcacaacaacaagaaagtcaaacctgatgtcaaacccaagacaacaatcaattctaagaagaaaggcaaggaaaaagtgaaaggcgactactttgtgtgcggtaagcttgggcattgggccaaggattgtcctgatcgcaaggacaaaaattctgcaaacatggttgttagcaatggcagaggaacaatggggtacggtaatttttacctacaattctctctatttttcactcacctaattggcgggttgataatggtgctaatagtcatttgtgtgctgacattttcctgttttcttcttatcagatcgccggaggttcttccttgttgatggggaacagatcgcttgcagctattcatggtgttggtatggtagttctgaagtttacttcgggaaagaccttgcagctgaagaacgtgcagcatgtcccctcaataaagagaaatctagttagcggctctcatcatgtagagatggttttatacttgtgtttaaatccaatagatgtgtcgtatctaaatatggaacttttattggttaaggttatgatagcggaggcttgttccgcttttctttagatgataggtgtaatatagttgtgaaccatgtaagcaatgatgatgagtccaatgtgtggcaatagccactttgccatgtgaattttggttgtatgacacgcttagctaacatgagtttaatctcgaaattcactttagccaagggttctaagtgtcatacttgtgttcaatcgaaacaacctcgcaagcctcacaagcatcagaggcgagaaatttagcacctttagaacttgttcattccgatatgtgtgaaatgaacgtcgtgttgactaaaggaggaaagaaatacttcatgacacttatagatgattgcactagattttgttgtgtacttattgaaaacaaatgatgaagcattgcattactttatgatctgtaaggctgaggtagaaaccaacttgaaaggaaaatcaaacagttggggtctgatcagggtggagagtatttttctaccgagtttacttcattttgcgaagagtttggaatttttcatgagaggatgcctctctattcaccccagtcaaatggggtagccgaaagaaagaaccgcactctaactgagttggtgaatgccatgttagacactgcgggactttccaaggaatggtggggtgaggcaatattgactgcttgtcatgtcctgaatagaatttctactaaaaaaagaagtaacatcattcgaggaatgggaaaagaagaagttaaatctctcatacttgcgcacatagggatgtttggctaaggtcaatgtgcctatagtcaaaaagcgcaaacttagactaaaaaccgtagattgtgtgtttcttggttatgttatccacggcgtgggatatagattcttaatagcaaattctagagtatcacagcgttagaatcaacaccattacctttgcaacaaatgagagaatcaatcccgatttgattatcggattaactctgttgattgctctggtaaaggacctgtggtcatggcgagggcgaggcatggcttggcttgctgctgctgctctctctctctctctctctctatctctctctctattttgcaacggacgggaattgaatctgcaacggttgagaatcaacaccattacctttgcaacaaataagagaatccatcccgatttgattatcggattaactttgttgaccaatcacttggacaggcagagacacatctctcggctctgtcttctctagtgcactgtcttcttcctttgcggttctctatttcctctattcctgcgctaccttttgtttccccggttttgatcacctgagctcacgggtgctcaggacgagcatgcctccagaactccatccgcttgtgtacctgcacgggtaggctggtgattaggtttttgggaagtgtcatccgacgcgacaactctgcatcggatatgtcctctgccacatctactcctcagcatcaattgtctgcgatgtctagtggagcgttctttggttatatctctattctaacctttgttttaatcatgttgctagatgtttttgtacctattagcatgatcatgtttagcactagatcacttcctcctgcgatcatcatgattattatttttttctagattaaaatatgccaatttatgactaaatttccaacatatgttgtggtattccatttgtattcttattcagaacttttgcatccacatttgtcttttatcctaaagttggggggtcaatgtagtttgaatctttatttattcaaaccatgcatacatacatttccttttatgacccatatgattcaccatacattattcatgatatatattattcattttcatcgttgtagccaccaactaaagagttacatttcctcttaatcatagacagggggtcatgtagtagagtcaaaatggtctttaaataatagattggttaaacctattagcaaagtactgttgggaaaatcaaccaatttggatgaaggtctttgtgaaaagcatggtgctctctagctagctagcagctgagtcaactactttactaaggtaaactaataaccacttagcatcagtatctcactcatggcatccataaaatctgcagcgctttctaacattaatacaatagtaattacagataacgaccacatttgataaggaaattacctacaaaagaagagaacttttgggtgcacaatttatcttagtggtgcccaaaacaccactgggtaaattttcaaagaatatcgaaatcacgcatgctcgctccttcattccttcctttcccctccctttcggtcattgtcccactgttagttgaaagaattttttataattatttatgtaagaattgaaaatttcacatgaaattcctgtgttgtcggttgatcagattttactagttggacattgtagagtgcggacaccatcaacactacaacagaagatgcatgcacattggcatccatgctggcggctaagtttacggtttgtctacatcagcagtagtatcttcccagaaatatcaaacactacacttgttgccatttatattgccatgctctacagggagcatgtgtaggaacaagtgtacaagagactatgtcgatacccaagaacttaccagaatacagatgcttgtgtggattgcacgaaacaactgcaattacacgtgctaaaagtgaatatatttgttttatgtgtaattatcttcgtgcgtctggatcatatatttgttcatatatgtagaatggcaaattaaaactgaccatgtttgtactacctccatcccagaatacttgtttagcatgtagtaaggttaagagaaaaagattataatgcccctcaacaaatgatgtatagttggatgtgagatgatggttgggggtagaatggggagaaatttcaattggaagttgttgatgtgataagtactacttcaaagtgataactattttgggataacttttgaatagtactagaaagaaaaatattgtgggacaaaggaagtaataatatgaaaaccttgggaaagaataagataattaacatgatctgttcaatagcggctgcagagttgttcagacaaatcaaatggttgaggtatatatacaaggagatagacgatgctagttgtttgtgaagtaattgatgagagtttgctagctgttctccagattaattattagactagcactggttaatatttgtttgttcctctcccctaaagctgtctgtgtcatgatgactgggatgtcaatgaattaacccaaagatgggatacttttttatatataatttatttagatacttaagtacactggtgataccatgtttgtggcatttcaattcaagcccaaaaaagaccaagcaggtacatgcaactactccctagtacaacgaatttggacttgagcctttgttaaaaaaaccaacctagacaacaatgggttataacctactataatgaatctggacatgcagacgatacaattaatctggacatgactaggttatgtcccatcgttgtttaggttagcctttttctttaagaacagagggagtggatcactgtctctggtgattactaattcacatgtggaaagttgtgccttctctccattcatttttttttcagaatttccatttacaaaacatgctttactcagtacactggagagatgtttaactccgatggtgttggaatgtaggcacaaacctgttcttcagtctgtgtcctgcgatgtcaaatacgcccttgattcccaagtataagggattctagatttttctggaaatattaaggatagaggaaaaaaactataatatccattattaatgtaatgaccacacatgagtggttaggtaagatgcggagaaatttgaatgagagatgattgatggaatatgtagtactccccaatctcttatgtttggagaaaattttgaatatcccaaccacatttgggaatggagggaataactactactgttgttgttgttattattattattattattattattattattattattattattattattattattattattattattattattattattattattattattattattattattattattattattattgctgcaaattacagattgttgtagtttgagttatggctgaattgaaaggtgtaggaaaagttctttcaggcaattacatggataaggatcatttcgctcttgtcactgattctcttctgaaagttggttgtcccattgaaaaaaatgtcacaaactttggtaagaaacatgatcaaaagctaaaggcaaaaatgagttgttctagagatttctttcctttcatttcttaaaaggagtttctttgctgtgaatgggttcacacttatccaccaaatgggtggggctgatttaacaagaagtaaacaggtaattctaacaaatgtccaaatgcttcatcaaaatatttcttattccccaacaattagacctctgtttggaaaaaaagtcctaatggaattgaactgtctgatctgaaactccagtgttagaaatggaacctatgcccttttaataaaagggttagttctcttttctctgttgaaatgaagtgtaaaattgtactacagttattaagctgccaggtatgccgctcgattttttggcattccctatcaatgaaggtaggaagatgaaaagttcccgcttgaaagataccgagggtaggtttggatgaaaggattttcagtttgctggaatggaaagcgaaattccttccaactaagggcagagggtagagcttattaatgcttgttttgagtagtactccaatatcattctttctgtaatgtcgttctacagtccaccacattagagcttgacaagtgacaactgtggcaataagctgtaggattctcgtgcactggaagcaacatctagccaaattgacatagtgttatgtctacatgacatgcatctttgacaaatgtttatcactttgtctataggggcttcaagtggaagttaattgccagatgcccagatggatattctacatggattcttaacaaatggtgtacagctttcgtagagattgtttggaagatcaagtcattgttattctcatccatttggttgttggcaagaggtgttttttaaatataaaggaagattttattgatcttagatgattatatcaaattcatagaaccgtactaagaatactttcaggatctgcataactatgatgcacacggtcaaaacacacacgcgcccacaaaagagttttgtaacatatgaaagaaagcaataaaatctaaggagcgccgatcttcagactagaccgtcacctatacctttgggtaaaatactccctgaccaccttctccaagtgttgacacgccactgcaaccaaatccaatgaaccaggcttttaaaggatagtgtaggtatagagccagtggatagctaaaaaaataacccgtcaagaagagtacagagccagcgtagagttttctttcgtcaaacaccatctcattaatagcgacttcaagtctttcttaattcttcgtagccaattgttagcaagaggtgtgagtatgagaaaatataatctaattaaaatatggacacagtaaagaaaaataatgagtaccagacagtttcttcagattttgctgcagaatttgaactgctaaactgatgttaaagaagtccaatagccaatatgatataaaccatttactctgctattctcttggcaattgaaattcaatcctaacgcgaaaacatgtgtcacctcatgggccacgataaaataggatatcaatatcactataccagctgattgatcatagttggtgtgttgtagtgttgttggcaacattcgaaaaagagggagaaaagggcagcatagcgcgttttggtttcaaacaagatcttaacaaagattatgggctcgatggcgatagctcatgggctgattagctgatatggctatggccctgatcgtttcttcgtttccttgtttagcagttgtagttttctctttttcgttagcataatttctaaactattgaatggtgagtgttttttttaaaaaaaacttatattaagcttttttaaaatcaaataaacatatttttcaagtttgtaataattcatactcaattaataatgtgctaatgacttatatcgttttacgtgcaactgaaaagctaatagctagaattgagcataagtgctggatagataggccaagctttacttttcctctacttcttaatgttttaaggtctctctagctaggctaatgggcgccagagaggaggccacattcttcataggaaaggcggccttccactggcttcttttctcttctgaaggatcacatctgctttataactagcataggccataggttacaagcttttgcaggatagcgtggctttttggattttggtacacaacaatctttttccataattcttataggaaatgaactgctttctggagaaaattctacaattctgatttgagttgttggacctacacctaagaaattcagagattagggatggccggcctgcctgcagaaaatgagagaaaagacagcaattggaagtgaaatagctcacctcagtcgtccttgattctgtttctcgtacgaggagatctaataaaggatggtgttcgatgcatccaaggaccaaactagctagatcaccaggtcaccacagaattctgtgtcacctgtacagacttgtacacgatgatgctactgctgttctatcatctcaatcagtacatactgctgtcttgcaaaaatctcaacgcggccccctcttttatttttttgattttttttccgtcttaacagattatcatgggaaagcttctcaaactcctaaacaacagtaacacgttttttttttggcaaaagatttctatatgtaagttcattcaaacactattttgaaacaacttttcaactttgtaggtgttgatttattcgtttgtatccttggaatattatcacaaaattggatgatctatcagcttagataaaaagaacccagtacatgactagtagctattgtgagccatccatccatccatgctggaaaaatgtactgttgcaagcttgaattttgatttatagcattagagcatcgacctataatgtaaaaatgcttgacacacgctgaagaagattatcgtgtcctatcttagggctgcttgagattgcaggaattttatagaaaaaaatggaggactttgaaccttgagattttttccttatacagtttttttttcatcataagatttgtttcctatataggactttgaaaatatttttttcctggagaagaccgacaggaagatgagtggtgtcgattggccccgaatgatgtcctggcgacctggccagatcggtggcctagagtggccaggtgcatcaaaggaggtcggggtgggttccagacgtcaacgatggcgggagctcagggccgggtaccaatgctggcgaggccggtggtgtcggcgtaaataggaggcgggggaggagctggtggaggaagaagtcggggtagcagaggccgagatcgaagggcggaggcggagaacagcaggacgacgagtggtagcgttgatgtggtgggggctcacgcgtgcgtcgagggctgacggcagaggcggagagcatccgcgaagcagatcggatcgcatagctcgagctcactaactccctcgcctctctcctcttctcctcgtccgccatccctcttccggccggtgaactcccggggaagagggggaatttaactatttgccacttttaggtttaccgattatccaaatgtccttcttatgtttgtctttaatttttttcctccctataagagggtggaatcttaactatttgttacttttgcccatgtggtatgccaacatagcaacacagtgtaaaaatcgacgtgggacccacttgtcaaccgcaagctatcgccttccctcctctctcgctctctggcatacccgtcgactgccgtcgctactcctctctttcccggcagcacgccggctcgcggctgcggaggagggggagccgagcgctgctcctctctttcccggaggcgaaccatgtcagcggcagcgacagcgtgctggctcgcggcaacggaggagggggagccgagcgccaccgtagtcgaggatgtacgcgctggactggacgtgcaaggttgtgctcatgtcgtttgcaccgacggtggtcgccgtcctcgccaagcgcctatctctctcgccatggagccatggaaggaggagggggagccgagtgctgcaacgagtccgacctctgcctggctatgctcgaccgcaaccacggccttcaatcagccgacggcggcgtccctccctccccggccatccactgacgacgcggacgggtccgcggatctagccgactcgatcccgccgatgacgattccatccccgcggatctaagcttgagtattctatagtgtc

SEQ ID NO: 61810 - DNA, 707 bp, Oryza sativa
atttttaatccgaaatacagtatatctttagcctttgtaccgactgacaagtgggaccccgggtttattcctttttctaccgaattattttctaaaggaaattggatggtgctaatgacaggtggggcccacaacctattctcttctcttttctcgttctctctatcgtcttctacctccagaccgagcgggagcagcaggggagacgcggcgcgcgcagcaaggccggccgagggcgacccgacggtgaccaggggagggagcggcaagactccggtgtcctcctgccggcagtcacggcacaggacggcgcgggggcgagaggcgccgcatggccgccatggccgggcacgggtagctaggtgctagggcgatacggagggtttccgaccaaattggtgagggcgtgagcatttatggcgcatgagggttccgtttttctagaaaaatcgaagggagagcccccgggatggcatgtccacggtgacctccttgggcggagcttcggagctcgggcttgtcacgattatggccctaatcgacgaaatagttgggggaggtagttcctagaggaataggaggagtaacaggagtgaggacttaccgagggacggcggaacgacgaagttccgcggcggcggtggagccgggaagaagctacagcacgcccacaagatgttcgacgaaatgtgtagaagggtgaagaa

SEQ ID NO: 61811 - DNA, 739 bp, Oryza sativa
gcatcgatatcggcgacgactggctactacgactacgacaacttcatctcgactacatcgactatggcacaaagggctatcatccatgttaagcactcttgccggtttcttctccagtccaagtgtccgcgctgctcacgcttggactgcggggggatgttagagtatatggtagttagagatgtattaggataggattgatttatgtggattccttccttatctgtaatccttccttatctcctccacatgtactcctatatataccggccccctgaggctcaatacaatcatccaacgtttcatagtatatctctcctatactatccaacaatggcatggcgcggtgcacggcgcggggcacagtgatgggacggcgcgcggcgacgggacgtggcacggggcttggtgtggtgcgacgcgacggacgacggcgcagcagtggcacatggcttggcggtgcgtgtctcagggcggcgacgcgacgggcaacggcgatgggacggcgggcgcgacggcaacggtacgcggcgcgggcggtgctcgaggtggtgatagcgatggcggcgacacgacgacgtgcactagtagagatcggtacatctatgatgatctacttttgtcatggaagatgcaataatcgtcgtaaaataacatctatgatgaacttatgacgaaataggattagtcatagaactcgcgtcacataagtttctctatgacaaaatggtagatttcg

SEQ ID NO: 61812 - DNA, 1050 bp, Oryza sativa
gaaaataatttttttcctagctgtcacatcatagactccccaagaccatattcacctccatcttttgtcttaaatttgatttaatctaatccatgaccagataactgatgtcatcaccaaatagataaaacaaactcaccagacatgaagaactaaatattttcttccttgtcgtcttatgaaccaagctaataaatctaacatccacgctttcccgtatccgtagactgaattcctgataatttgaaaaaattcaccattgccttgaatccccgaagaaattatcactacagtgctcgctctacttcttcagtgacgcagattccgtatacctctatcgtgcaaaccctgcatatcttggatatatcatgtactgccaaacagacccgttgacgtccttttgctcgggtccatatcccgccaactccaccgcagctccacgctctagaagccgtctgtggagattatggataccccatacctacacgacatgtatagtccgactgggtatggggtgccatgtatagatagaatatttttaaagggactcgggttaaattccaaactcgtatgtcaaggaaatacccgagatcctagtcggttacgattgtatcttatcagtaactacctattccgttagggatatggattgtgctttgtaatacggacccctttccctatataaggaggggttcgggtgcctctaggggcacgattttctcccagatcaaacgatcaataatacactcggcggatcaatccccggacaggagtagggtattacttcttgattaagaaggcctgaacctgtataaattccttgtctttcaacccatccacttttccagcttgatagccacccccttttagtattgccgaaatcttgtttcgacagttgccgcgccaggtaggggtagcatcaagttcttcgccgactagtgcgatgggtttcgtctccggcattgacgacttcgtcttcccacctgggcaggcgtttcggtttggcagcctcgacttcatcaccaacgacttcggcaagatttctctcct

SEQ ID NO: 61813 - DNA, 954 bp, Oryza sativa
tttcaactcgagattcgaaaaccttcaaatcaagatttgaaaattttgaaaattttcaaaatcgagatttgaaactttcaactcgagatttgaaaactttcaagttcagatttgaaatttttcaactcaaaaattaaaaactttcaaactcaaaacatgctaaagataaaaaaataaaaaaaatggaaaaaaaggaaagaaaatggaaagaaaacgaaaaaaaaagtggagacgcgcgcacgtcggcgcagcggcgctaggcgttctgggtccgaaacgcgcgccggcggcgcgcgcgtattaggtttttcgacattatatgggctgtacacgggccaaatgcagaagcacatggacagtgggctcattccacccagcgattatggacggcccacggtccatagcatcgttgagaagtactacagatttacagctccaaagtacagcaactcgttgtccatcaattcctttgcttcaatttggaagatcattctgttgcttcgttcgttcaatcgataatattatttcatgaatgccatcttattcagatacaggtttctactttgtattttgacaagctacacgcatataaatgacatcgttcatctacttgccaagttttacagaatcgaagttgcacacttacacaaaagatgaaacagaacacagattcagaccacatgagaacaccaaccatgcatctctactgatccaacttaatttacttggatttagaagttattagaaccttcatctttgtggataaatcgcttcatgactcggattaactcgttggctggctcgctccatggctgcagcgacaagaacaggtgcttctcctcctcgaaggtgacgagctccaccggcttctccatctccttcagcctcgccgcgtagtgcacggtgcggtcatggaggatgtcgcgcccggccaccacgacgagcaccggcggg

SEQ ID NO: 61814 - DNA, 2420 bp, Oryza sativa
atggttacttcttcagtgtgccaacgcttagtgcctaattaaacacggttgtttcgtttaagtaagcagatgggctaattaattaattagataattaatcggttgacacgaagcttcctaatcctagtcgttgccttgatcgccaaaccatgactttggctgtcaagacttagtagatatttttctcttttttttttgagaaaaagatggaaggagtgttacttttcagaacgggacataataaaaaaaaagttttataagaaccacttggtacttttctgagtattatagaagaacaacttcactgaacaaaaactatgtagccatgcacctcttggctcttgcaacgaaatttacatgaccgtacttattactagtatagactatagagctatgattttatccggaaatttgagatacagtttgaatgttcgtgtgatgagatcagactcttgagtgatccaaagaagttattgagtccagcatcagtgatgctctgtctcagctttcgacttacgttatgcgtaagcgggtgatacagagtgcaattctgacattcttacgcgcatgaagctctttttctacaattttgctgccatttttacaaacaaaaccatttttacggcatatgaagggtgaggtctggagtcaatacttttgtttgtaagaatttctggagaactaacgagtctggcgttcggatgcacatgcgatacgacacaaccatacaatattttgatttcaatacgtttaaatcatgttattttgcgtttcaaaaggattgagaaatttacctcaaaattgcaaaagtgatggacgaagcctattatgagtactgttcgccgtctagtcctttttcgctgctagctttcctttacatttttggatttgtcccatttccgacgaatgtcagatgtactccttttcctactagtatgacatgataaatttttgtgtgttcgaaaaaagatggccgaagcccatatttccccaatcaatgggccgtgcagccgagagcctgagatggcagttattcctattgggccagaaatatggtccaatacccaattgaaaagcacttagcccaggcccaagcgcatgtactagtactcccgaaaggaataagtctgcattgagtcccttaaatatacatcggatctatccctcaacggcaaaatcaaatataatgactccaactgttaaaaccatattaagagaggaggaaacattgacatgtgggccccacatggtgactcgactattttgaccaagttaactagccacgccaatcgaccaatgaaaaccactgtcaaaacagtccagaaagccaaactacaccagtttttaagtagttggggatcaacatatctagtattgcagtcgaggatacaaattaaatcggacctatattgagggagttagagtcgacttattccttcccgaaaggccaatctgcttccgtccacgtgactatccaacggctgagattccgtgcagccggttttgcttgcaccaaaaggcgttttctgtgatttttcacaatacctttacaagttgtaaaaatgttacctataccttttctaagttgcaatcttttcatatccttgtaaaatactccgtatttcatatgagcaaatggataagtcaaaccataggctaaatagtaaatacatgggcgatagatattaattcggtccaccagtttcaccagactggtaccctcaactctccatcagttgctggccaaatggcaaaatatcattggacacttatagttgcatcatgcctaatccagattccagttaataataaaccttactttctgagttgacttagtctctatccccacaacaaaaagagcactaggtaagtagatataatggggtagtataaactagatacaagtcgctgcaatgatgcatgcaaaatatcaacgccatatcatgttgacctagcataaacaaaactcaaatccggcgaagtacgcttgtttgctatcaataatgcgagcaaacaaatgaatcttaatagcatcacactaaggaagaatggataatacatctcatccacgtctgttaaataatttatattcagccaggaggagaaatcacagccaagacctcgtctcattcactgatcatcaatcaggtccctgaccagtaatttttttttagaaaatagattttcattaatccggtctctatatccacgaaggatatacacatccaaatcatgaccagtaattgatctattcaaatattgatcgcggcaaattaaccattctaatcaattctaagcaaatttcgattggtttggacgttcatattgcaagatctctcaggtaaatcagccactggccggcctgaaccaatttcctttcactatgaacataagatgcccatttttccaggaaaaaaaaa

SEQ ID NO: 61815 - DNA, 735 bp, Oryza sativa
aatcttgtgtttttcctattcctccgttttttcaatcctgcgattcaaaaggccataaaaaagagaagaaaatggcattcttccctacccaatcccaacaagcgaagctcaataatttcccaatcccaaccaacgaagctcaataatttgctggtgaaatggactaataagaaattttcgccgtgtttagttccaaagttttttttaaaacttctaacttttccatcacatcaaagctttcctacacacacaaccttccaatgtttccgtcacatcatttcaatttcaaccaaactttcaattttagtgtgaactaaacacacccactattatggacacattactattaggaacacgacagttcggaggaaaggatggtagatgaggctgtgtttatttcagcgcaaagtttggattttggttgaaattgaagataatgtgactgaaaagttatgtgtgtatgataggttgatgtgatagaaaaggactgaagtttggatccaaaatttggatctaaacacagcctgagtcactggatctggacttggatatcatatcaccgatatgatctcgctgctgcgtgccagcgcggtcgatcgcgtgaggaaaacggcaggaaaagctgcgttccccttgaccggctagacagataaacgttcttcgcctgagcagaagatcgcgtcaactcgttcaccggcgatggagatggaggacgacggagaggagaagtgttcg

SEQ ID NO: 61816 - DNA, 1262 bp, Oryza sativa
tattgcgctggttatcacgcttaccgcggggtacggtgggggaaattggcgattgatttggatggattttgaccaaattcaaacttttggagaaaaaatgaaaaaaaaacatggatgtagttcttgatttataattgccaatgggaagattttttaaaaaatagagtaaactaaattcaaatttgagggtaaaataaaaaatagtttacaaattgaaaaaaggaagacaatattgggccttaagtatcctacatattctttcaattattctcaatttctagttttctacacatattcaaccgtattttttattttttccctatttatttttcatttacatgatttcaactatacagaccgcaataaccgtgcaaatatcgcggttatcacggtaaaccgtgcggtaaccgcggtgaaaccgcgaaactgccgagttttgaattcgaatttttgaatgtgatttctgtacgattttagacaattatcgcggttatcgtgctaccgcgaggtggcggtaacctcggcccaaactctgttgaagatctttatttatcggcagaaataccttcttaagtgacagcttctaagcataaaccactacaatgacgtgcatctaagctttatttaagataaaataatgaatagtatcaactaagcaaccttgtattcctcaatattcctggtacaatcatgaacactacatatgtatcttgcgcaacgcttagctcacagtgctatgttcttcatggccaagcatccaagacctgagatattcatctctgatacagcttctgataacactattcgttctctggttgttgctttgagcacgatgtgccgagcctaaaaacagacaccaagcactgttgaataattattgtttttatgcttgtgtgtttaacatctgaatcattttcttcttcttgcagccagattgttggatcagctattctagggggaattgagatcaatcccagccctttatttattgatccaatggtccaaattgtgagctacagtaaaattagagctgtacattttcttcttcatgcagctagattgttggatcagctattctagggggaattgagatctagtgcagttacacaatcccaaccctttatttattgatccaatggtttaaattgtgagatacagtaaaattagagctgcacattttttcattaaaaaacgctacactaatttgctacagtactaaagaggcatctaggccatccgttttaaatccaatgatactcttg

SEQ ID NO: 61817 - DNA, 1050 bp, Oryza sativa
tttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatccatggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccggagagtccgccaagctcgcgcgctacaacaagaagcccaccatcacctcccgggagatccagaccgccgtccgcctcgtcctccccggcgagctcgccaagcacgccgtctccgagggcaccaaggctgttaccaagttcacttccgcttagattccatctattggtagtatttagttctgtctactatctggtagtggtagaaatggatgtcttattagtgtgtagttggcggttgtggcgctgcttttggtaaactgttgcttatttatctgagatattaacgatgctcttctagacttctatgtgcttcctgttttgtgattgctcgatttcttgtttgtggtgttcattctgtttgagattactacgatactgtgaaattttctggaacaaaattgatgttctggtatgcatacgtagcaactgaggacatggcaactcacttcaggaataatgctgctcctggcttgtttggtgttctacacttttactca

SEQ ID NO: 61818 - DNA, 948 bp, Oryza sativa
catgcagccagattgttgagtctgctatctccgaagtgatgtctggaagagcatccttggtaaacttattcagatctaatgaatctctgaacacgtcatccgttggactctttcctgtaaacatctcaagcagtaatattccgagactatagaagtatagatatcaccaagagttgatatccagtacagctgtacaggcccaacatccagccgcgtttcggcctgcagcggcgaccttcacagcttgttttgcaactcgagggaagaggattgggagtttacacgagagaattgatggtgagattaagatgagaattttgatttttaatcaccagatttcaccctcctatacaatgcaatacatctactagatgcaatcgcggaggcctttgcacgtacgtacgtgcacacacccatggcggacaacgacatcatggcggcattgccggaggacgtcctcctccaggtcctctcccgcgtgggcaacgtcaagagcctcttcatgctggccgcaacatgccgccgcttcaccgatcgcgccttcctccgcgacctctggggcggccagcgcgccggcgacctcctcggcttcttcttccaccggcaacgcaactcggcctcgacattcggcttcctgccggcgccgccgcttcgcccccatcccctccagctacgacggcgagcccctgacggcgcgccgcggcatcctcctgatgcggctttccccctccaacgactggtcagaggcgaccagccacctcctcggcctcttcaaccctatcaccagcgagcaccacgttctcccgcatctgaagggcccctccaaccttggttccttcgccgtcaccagctgcgccatcatcttctccgacgacctcgccgggaagcagcagccgccatcttcaggccgcttcatgttctcgcagctgctcgtcaccaccaagcaca

SEQ ID NO: 61819 - DNA, 908 bp, Oryza sativa
tagatcttgtaggtctcgacgctcttcttcgccttcttccgccccgccttcttcccctcgccgctgcccttctcgcccttgccggcggggaggcgcttctccgccttgggcttcttccccgccggggccttctcggccttctccgccgcgggctcctcctccgcgggcttcttcgccgccggcttcttctccgccttgggcgccatggatgccgccctcttcttctcggggagaggagaggaaagggaagcggtgggatttgcgagattgcggcgtggggaaaggaggagacggggggagatgattttgtagaggaggggatgtgcaacctgattggtggaaagcacgcggcgcggatcgatgacgtggagggatgtacgacgttggatgccggggtcgacgggttggtgggatgccgaaaaatgtgagcgggaacgggaggagttaaggcggtttccggcgcgcgtcggtgggcgaatttttagagtttgagctttccttcggcgtacgcctacagcccagtccagcccaatttagttgtcaggcttcttggcgggctgtctttgtttatgggctaattgggcctatttctttgctctgaaagccactccacgacttgttaggctacgtattcggtaatctgcccacgtcaacatcccagtgagacgacaacgacgtcgtcgtcttcaagcaggcagctagcctaaacccatctccatctgcaagtaggcttatgtaacagtgcgttgatcatgcaagccttccgtcgatcgcctagccgcctaaatcgccgtgttctgaaagtcaattctctccgactcaacgaaaatactaacaacatgcacctggccgcgttgaccgttcgaaatgtatatattccctcgttcacgaaatacttttcattgtgg

SEQ ID NO: 61820 - DNA, 1340 bp, Oryza sativa
aaaccctagcgggttcgcatcaagttcaccttgggaaaaatccaaattaatctaaaaacaattcaattgtgggtgaataaattaataaccaaataaagcatttgaatttacaaatccaaaatatgttgagctacatttcaattccaaatccaacaccattttgcagattagcccttccacttttcctttttcctttccttcttttctctctttcctcctgtcggcactattcattgcccaggacgtattcgttctgggcccaagcctcttccctgtgtcacgcatgccatccctgtcaccatcgcgcgccgttgcagcgccgcacgaacgtcgccctcgcgtcgccgctcctgccgcgtcgagccccgcgtctcacgccgtcgtgtcgccatcgccttcgctcagccgcgcgctgccacgtaaatcgcccatctatgacgttttcctcatgatgttgtatattttcgtcattgaatagaccatatctatgacaaaattttctatttcgtcatggatcagtcatggcgggataggtaccaaaactctatgacgaaattaaaaatggcgtcaaggtacaatagaaaatttcgtcacaaataatgcacacctttcatttattaatacctgttggtcccacagcgcatacgtggatatccaaatttcatttattatacctgttggtcccaccgtgcatatgtggcactggtcccaccgcccgcccaaattatatgtgccactggtcctatatgtggctatcattttttttataaaaaaaaatacacctgggaatcgaacccagtccatgagcatttgcgtaaaaagctctaccaccatgatactaagatctttgagtgaaagcttgtttttttgttaattgtcctttatgcggtgaacctggagaggacgcggcggccgtggcgccaccatgtggaacacacccactcggcggtgtcgtgtttcatcatctcccacgttgggctgttccccaccaggtggtttggatctgaatccccttgaatagttgatttacgattgtgccctcattatatgtgtgttgtagtgttgtaccgatatgaacgaggggtaagtcagtccaaaccacaagaaaattcacaagaatagcagcaggtttttacttttaatgcatgaataaaattttaaagtagtttatctcactcatatgagttcgaaattagacgattcctttttcattattcatataaaaatattgtctacaatttcgagcacgtttagaatgttgtcaagtaaacagtgaagactcataaattgaaattcaaaattttgaattgtagaacaactgtgtggcttttcttttaaat

SEQ ID NO: 61821 - DNA, 787 bp, Oryza sativa
attttcttgaggtattcacaaaaattgcagtaatatttttttgcagttgaattttggcgattgatgcaaaatgtcagttatctgtgacatgagagcagtattaggttaaagtcagcgtcacttaccgtgttatagatggcattagggtggtaatagttgcctgcacaggccacataattggacggccagtcgtaagcggcgaacgaactttcacaaatcagtgaatcagatctgttgtgagtgcaaacaccaaatctaccatgttggacatttggttggccatttcctcttacctgattactccttcaattactactaccacattgagtgcaccgtcaacctgcccaatagtaccagtagataacaagttatagtgccactcatgtccttgtgtcagttgcgtagtcacagttaagtttagagtctaatctacgaccatgtgatattacatgcttcgaaactactgtggtataaacccggggaatattgcaagtatttttatgaaatgacaatataatgtcttaagttgcctctaaaatagattaaggctgtgttcactccagccggatcccaacccaaacagtgtgcacggaaaacgaagcggtccattagcacgtgattaattaagtattagctaaatttttttttcaaaaatggattaatttgatttttttaagcaactttcgcatagaaaacttttacaaaaaacgcaccgtttagcagtttgaaaagcatgtgcgcggaaaacgagggagaggggttgggaacttggggtgccgaacgcacc

SEQ ID NO: 61822 - DNA, 848 bp, Oryza sativa
  unsure (1)..(848): unsure at all n locations
gaaactaactaccaatgcgaactttagattgcaatcactagtggataatatttgtttcatgtagatgttgtagagtttcagttatgtttaaaattgctataatatttgcattttaatgtcaggcaatctttcgtcaaagcactgaaaccttttgttaaatggctggaggaggccaaggaggaggaataaatggtgctactggaggctgtgcgaatgtattgtttgaatatttccttatatcccaagtttccagctaaagttatgtatcttttgctcccttgttactgggccgaccattttatgatcacatgctgatcctaatagtctactgaatgttaaaatcccatgcaagaagttattccaggatttgctaaattattggttgttacaacttacaagaatgttccatatgttatttctcaactgttggtacttaagatattttaaattcttatgatttcattactgtgaccggacctttccggccagtagggactctaggaagcccatttttttttcactattttgctcgaaatgaacgacaaatttgccattcggatcgccacatgtaacgtggttttgcactcccggtggcatttgacggccgtttagagggaaatccacttatttatgaatttagatatggatgcgaattagtgcttatctnccgttcttaacaagagccatcacgactcaatcaaatgatgcttcctacggntttatngtttggacagcgatattttctctaaacatatanttgagtatgggtttaaaatttacgtagcgttaataaacgtgttttccagcgctcccctagacatgtacaatggtggctaataacggtctct

SEQ ID NO: 61823 - DNA, 3323 bp, Oryza sativa
aaaaaagcaaattcaacaaacactaagagcagtgcccagtgcacatgtttaatacctggttaatgaataacaaaattgtctgggaaagtgagagagagtggctcagcttgcgaagagcttggctcatcaatctagcctggagagcaacatgtgcatcacccatctccccgtcaagctcactcttagggacaagagctgctacctatgtcacaaaataagatgcactgcttagcaaacttctcatataaatgaagttgtatttattaacgttgagtgtcgataagcatgttccaactgctaattggacattgttattaaaattttaagcagaaagtgcactattatcaatttgaaagaaggcaatgctccgaaaagaaaaataaaaatgggagggggatagatggtcaggttcttacactatcaacaacaacaacatcaacagagccgcttcgaatcagtgtgtccacaagactgagtgcctgctcgccacagtctggctgagagagaagtaaattactggtgttgaccccaattgattcagccagagctggatctaaggcatgctctgcatctacgaaggcacaataacctagaaaaatagcaaaaacaaaaactcggtgaggtatatattaggttcgtccaaattctattttagatgaacttgcagttgtcagtgctcatgatttccagaccaaatggttcatggttttttgaaatgctccattaaattgcattacaggcagattttcccgagtaggttctgtgcgtgtttgaagaccaacattatttggtgaagctagtaatctagaagtatgaaggagcaaataacaccttcatatttaaatgtttacactgaattaaactatataacctctgtgagctcaaaacatagcattccctaacccctctgagcgaacgaggacaaaagcccacgacaggtactttgcatatgtagcttatcccatggttgctgggctttgagctaatattgggctacacaatgtcagcatattccatgttctaaaacactaaaactggtttcgtcatattccattctccaaactccaaatataaagacactataatgctattggctattacacagataccaagctgcttggtaaaatacatagcgcaccgtgggggcctcccctgctgatgatgtcaacaaaatactcaatggtacaatattttgaacagacaagtttaagaactatgttcacatcataattagcaagatcactttcactgtcaagcagttgtaagccagcaaaacccttatgcatactacataaaaagcatctgactgactataccatcacaagttcacagcattaagcacatggtaataatttttatacgtattagatgttgttagcctaaatctttggattaaaggagaacacagaataatctgtaccttttctcatgtaaaatatatgctattgctaaaatatatagattaggttcgaagtgctgatattaccgccatgcttttgtgcttctgcaataacgtgaagtgcaagagttgtcttgcctgaagcttctggaccatacacctctataacacgaccctacagagaacaatagcatgacattcatacaaaacaaagtatgttttgtccatgaaagaacatttgcacacttcatatgatgagagaagactaatttttagggtagttaacactcagcagaacttagatttgcaaagaatatcatgcaatacaaattaaacattgatacaagtgagattctacttacaagatattttgtaactacataggaatccttacctttggaagtccaccagttcccaatgccaaatccaaagagaaagacccagttgacacaacaggtacttctctacgaccttcagaacgaccaagccacattattgcgcccttcccaaatgcagatgttatttgatcaatagcctggtgtagagccaagtctttctttgacagattctcttcaccagagtcagttccactggactttgtcttctttttggctaagtagatgattcaaaaagaataaatataagattcagtagatggcagcaataaaacataaatcaaaagaaaaaaaatcatgcagttcaatttcatcacaaattcacaatgtaacttatgtgtcaatacaggtaatatcaagatttaagatgatagcaactgagccatgggatgcagtatttagtatatctaaggtaaggtatgcacataataaatcataaaaggaataagtgtctactacctttagacgagaaataccggcagtggaaagtagagccacagatcccttgcttatagctctgcacaaagattgatgcattagcaaaaccatatcaaggtttttatgtgaaagattaaacagcattgtttcattctcaaccggcatcatttaaagctaattatgaatacatatcttccagccgcattaatttcattatgcatactgtgcgtatcacaaatgatttcagtatttgttttgaagtgcacactatgagtgaatctcttccattctcatcaatttcattgtgcatactgtgtgtgtcacaaatgatccagtatttgtcttaagtgcatacaaatacctacaagtctgaaggtgcaaacaaatcgtgaggtcaggataaagatgacacggagatgtgttgcaacctcaagaaaacccctggaggctacactaatctaataacctaaatcacctttggtgttgcaggttaatctattgtaagcaaaaaatatatttatggcgcattaaagggcatgtacaaatagtacagatgcttaggaaaaaaatcccttagcatctgttcaagagccttgatgtccaatagagaacacctattttacggacgctttagttatttcaggtgcttctccactccatttttcatgcaggcgctcgcaagcatcgactgtttcacttggcggcaagcacctcacgcagcaccagcgtggcaaaaatagacacagtttactcccctaagcatctgtccaagcacacagattgcacatagccttaataggcatttctccaaaatcccggattctaggtttgtagtacaaaataaggggaggggtaccctcagtgatcaaaatgggggtcattcggtggcacagagcaaatcgccgagggcatataagccgcgcggttcaccaaacgcaagcgatcaaaccccagcaaggatgccaaatcgcaatcacatatggcacaagctgccagtaggaacactccatggccaccaaggggggcaaaaaaaacacagtcaaatacggcggggagagaggaggggagtttcgacctcggggcaaggcgcg

SEQ ID NO: 61824 - DNA, 1294 bp, Oryza sativa
aaaaaggaattaaaagaatgcaatcaacaaactgtcatcatctccaaatttgcttcaaagaccatctatactctccatataatacggacagccattggtactaagatatagcactaccactctcacaaaccaatcaagaaacacaatacgtcccatgacgatcatgatgagcctgaggcttgaattatccctcgtcctcatcctgacgccgatcgttgcagccgtcgctggtggtggcagcagcagcagcagcgatgaggccacgttgcttgccttcaaggcagcgttcagggggagcagctcaagtgcgctcgcctcctggaacagcagcaccagtttctgcagctgggagggcgtcacgtgcgaccgtcggacgccggcgcgggtggcggcgctgacgctgccctccggcaatctcgccggcgggctccctccggtcatcgggaacctcagcttcttgcagagcctaaacttgagctcaaacgagctgtatggagaaattcccccgagccttggccgcctccggcgtctagagatcctggacattggaggcaactcgttttccggtgagctccctgccaatctgagttcctgcatcagcatgaagaatctgggcctcgcctttaaccagcttggcggccgcatcccggtggagctgggcaacacattgacacaactccagaagctgcagctgcaaaacaacagcttcactgggccaattccggcatcgctagcgaacctgtcattgcttcagtatctgtacatggacaacaacaacctggagggcctgatcccgctggacctcggcaaagctgcagctctacgtgaatttagttttcagcagaacagtctctccggcatatttccgtcctctctgtggaacctgtcaacactgacggtgcttgcagcaaatgacaacatgctacaaggaagcattcctgccaacatcggtgacaagttccctggcatacaatactttggattggcggataaccaattcagtggagtaataccttcttctctcttcaatctttcatcactcacaattgtgctcctttatggtaatagattcagtggatttgtgcctcctactgtgggaaggttgaaatctcttcggcgattatacttgtatggcaaccgacttgaggcaaataacaggaagggttgggaatttatcacttcactaaccaactgcagtcagctgcaacagcttgttatctcagacaactctttcagcgggcaacttccaaactctgttgtcaacttgtcgaccacactccataagctctactta

SEQ ID NO: 61825 - DNA, 1521 bp, Oryza sativa
ttgcaagttttatccatgatgtccatctttcagttcgttgtttgttaattctcgaggacttctgtacacattttttgtggttatagtggggcttggtgtgtgcccttgcaaaagatgataaacattttctttcacttattttactaactactgtgcatgtaaatacaaatgtgttatctgagttgtctataaattttaagaaatatcattttaagctctgaccagggtagatcggggtggtggatgctacagttttatttgctgaagttagcccaattccagggcgtccaattgcaagaaatatgctatgtcagcccaccttgtcaggaactgttaatatttcctagccactctcctcaacaacagaaactgaaaatctgtaaacggtaacaatgtggaaggtttgttgagatgtaaattcatcaggcacctaattttccgtttaatggggtgttcactgtactgcaattaaaccgaagttattctggaaaacatccactgtgtaacatccctggtaagttgccttctgtactcagttgtgaaaccttactgctcagtgcctctgtggtgttgcagagccaggccctgatacataacctttcttgtttgcatatgcgcaaacaaccttgaaggtttggtatcagtctacttcatcattcatcgttgttttgttttctaaccagatgtatttcattgtacttatgcatagctgcagaatcatacaatccagctgggaaagtcacctggaatcaaataccaggtgaaaagaagtttaaccgtccccaattttatcttgtcaggtgagcaggggtgaatggtctatctctttctctctctgtgctgcctcacttttatcttgtcaattatcatacaaggtttcaactgctcaaacttcttactaaccacaacatagcagctaacaaacctcagtgcaagaggtgacctttggtcaaaagctttgcaggctgccattgtcccctatctgtactgctccacaagacaattgagcaggtctaaccaacaaattttgtttgctagtatgctatttaatttgtttcattcttttcatgtggcacatgaatgaaatccagctgaaccattacatgatggctattggaggcaggaagctcatttgatgaagaaaagctggaactaattggcagttggtggctgccaagcttaaccactacatgatgaagaaacagtatagttccagcccaacttcatgatatgcataatcttgggcctatcttgcaccttaaaggattcagcccatatacacactaatattgagacatcaagaacagtccagactgcatatacaggaggaagaatggttctgaaacaatattgagctttgcttaatcttcctgcttaatttgatcagaggaagacaattagttctcatcacatgaagcatggtcattgcatcaactctagctaccattgccccaatttacaagcaggatacctccatttctacccttctatatatatatggctggttaataataatcagga

SEQ ID NO: 61826 - DNA, 930 bp, Oryza sativa
attttttaagcctaattaatctataattagagaatatttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggctcagaatagaaatcagaatagaaaggatgaatggagagactattggagtaaataacaaatttgaattgctaattaaatggagatttggctaaatagacggttggagagtgatttggagaggctgtctggagatgctcttaagctcgaagaggcgctgcccctcgtgcatcgccgacccccgaccataagtatcacgagcaggcggccgccgccgagacatgtgctgctcagtcgctcagagcctcagatcacccacccgcttgctgaagcgctagtactagtgtactaccagtagtagtgtaggcggagaaaagcagttggcaaagctcgcgcaatggcagcctccaccaccgcgctgagcatgaagctgctcgtcgacaccaatgcccagcgagtgctgttcgcggaggcgagcaaggatgtcgtcgacttcctcttctccctcctggcgctgccggtcggcacggccgtcaagctgctcgggaaggactccatggtcggctgcgtcggcaacctctacgccagcgtcgagaagctcgacggcacctacgtccagcccggcgcctccaagaacgcgctgctcagccccgtcgtgctctcgccggcggccagctccaacacctccgtcctccgcttgccggccccgtcttcttcgcagcccaagagcttcttcagctgccgctcctacgactgtttctactacgtgacggacgtga

SEQ ID NO: 61827 - DNA, 8947 bp, Oryza sativa
aaacttgttatccccgtgttcttgtgttctaatcatgcttatggttttatagtggaaatatgttgatattgctactttccctaactgtaacgcttaaacatcaggtattaacagaaaaaaagaaggaatgagtaatatcacatagaagaagtcatttgttgcagaggccgggtgtaattttatttcttattaatgagaatctccccattatctaaaaaaagaagaagtcgtataccatataccatgttgttgtacaccattagtggtgtgcatctaaattgtacaccatgttgtcgtaaaaatgcactgtacacaaattacagtaaaacacaacaaagataatagactaagctacaagatggatagaatttgcaaactactcatggtttccctatacacccttctgcgtctcattgtcatttcgggcatgtttggattgctaccataccaatttgttgttagtgccaaattttaggcaagttttggcactaccaacattttggtaaaggtttctattgatttggcaagttttggcatcaatccaaacatcacacaagtactatttagactaccaaaaatttggtagggcaagatttggcactaaaccaaaacagcctttcatgttctgtatcatggtctgtgcaggagcaatggtcaaggttacttgtcaggctaatgaccaggcactggtgggtttcggctatacccaagacaatggcaagtacagcgtgagcatcacaggcttaccactcagcagcacatatggggccgactcatgtaaggttgagctccattcagcaccaggaggatctgactgcaacgtgccaatcgagctaaacttgtctgggcttagcgtttactcgaagtccaatgaggaagtggtgctccaagccaaccaagtaatggcattcgcgtcacagaagacatttgggttttgttcgaaacctcacattcaaccaccaatttttccatacaattcaccaccaccgtccccttaccagtatccctcacctcctttcaactacaagtccccgccgttgccaaatcagttttcaccccctccattcaacaagtttccacctccatctcaccagtatccatcacctccgcagagttcctaccattcaccaccaccctatcagtatacacctccaaacagctaccaagctccaccaacatcttacaatcacccgccacccccatatggatacaattctccgatcccaccaaccaacaagtatttaccacccccatactacttcaactccccaccgccacaataccagcattcgccacctgcaaacagctatgtatcgccaccactagctcaccaatatcccccacctccatacaagtcaccaccaatacctccttactacttcaactctccaccagcaaaccattattcaccacctccatacaactttggatcttctcccccaacctaccagtactctccaccattgcttccgaaaactccaaaatatttacctcctaaagttcctcttgagatgtctccaccggcacatgcaacatctccacagcctctggtccactatagccctccgccaccactgcagcatgctggcatatcatcgacaacaccatctgtgaactcctatcaatccccgccaccagtaaatcagctgtcataagcatcagcgatgaggctcctgaagtgtaagttttctttctgatttatatggcataatgcacgattttcaggagtgatgtgaattttcagactttaaggagaaactcaagaaatataactaaatttgctacatgaatgcgaggcaattgtatccacaaagtcagtgacatgttatctatatattactcaatctcctttcaggatcaggcgtctgcagaataaacgggagacttgaagtctacctcgagaagaagcagtgggttaattcgagttccaggcatccatctcagtatctaggattgttacgacagtaactagtattgtttcagcttatatctcattgcctagagctaatttcagcagggtaatcataagtccagtaagcattgccagtgtctctagttttcaactgaattcaatgtatgttgttggttcctagcagcccatataaagcttttcttatgagcacttattacataagaaaatcaatcatatgagaggaatatggttgcttggctgaatactgcactagtcccattttttgttccacattatatgtgcaatatataaatccaaatgcacctcttcaccacaatcaaacaaaagaaaaccctgaaatatattctgtgatcgaaaatgagcgtagaaaacaactcacgaaccaatcactagtcatcactaaatcagagcttcaggatttcagtaggatccagtgcagtgcagacacaccagcacgttcttcagcgggcataacatttttcagacgtcgcatctcttccacggatctcgcggtatctaaacagcatgatcctcccacaaacgagaaggaaaacctctacatcgccgattcctacgattttttcccaaatgcagccgccgaactagtaacttcaagcaacgggctccaaggacataccggagaagacgaagacgacaacgaagaagcaaccggtggccatggacgcggcgttctcccggaggtggcggttgaagcatcgccagaggccgcggcgacggcggcgggacctgccgtcgcgccgccgcagaagatccggatagtttttgggtgggcctgacaagcctttatctggggcttccatttgggcccgatgggccacgcgtggtgggccgcgacgtccctttcggcggttagctttcaacgtcacacgacgcaactgtagtcgtgagccaggcgatttgattaattgcttttgcattctactccctccttttttttaaactaaccaatgctacacattaggaaacggaggtggcactactatagaaaattcctttagctctgactcttttggagttggagaaaataaaatgagatttatgaggagagacgtccctccaaatattttttaagaataaattatgagcgtgttcaagattaaacacgaaaacttaggattgaaatcacatacctctagctattgcactatcaaatacatctctagatagttttagcttcatggagttgagctggttgtaatgctctcacaaaataaactagagatgaagtagattttaggttgcttcataactttatttcaaacccaactcttgaaataaaatttaagagatcgagtctgctaacatgtccttagaactagaactaattaaatttatcaggttattttttataattgatatggaggttcaggattctcacccatcattttccaaaaaagcgagcaactagacaaaaaaagtggccacaaaacgaaggaaaatggcaaaattgggggtggctttttgtatttctctgagccgatgatgtgcttgaggctggcattgcaggagggccagaaaagaaagaaaagcaccattccctgatcaactttgagatgccaacggaatatgagtgacatattcccttctcctgccattggaggcctgaggctaagccacatccaccattccattccatccataccccaactgccatacacacacatacaatctcctcatcatcctttttgttctcttctcagctcaatccatcacttgttatccatacacttcttaatcagcatcaaagcttatctcactcccccatatactgtagtataatccaatagtacaatcaccaatgttaattactgtaattaatgaaatgtggactagtactacacactgtactagtaatatgcagtgacattgctagagagtttgagtatcccagctactgtagtagtactgaaactttgtcatacacatgtatggtcaggtgtaggagtagtgcagctatccgtatttttaaagcaggaagagaactgccactatcatcatcatcatcaatcagtgtaattaagtaatgggaccagcagacactaaatgcagaatttacctcgagatccaactcgccaccaactccaatccaagtgcagcagcagctatgatattccaaaattcatcttcaatcttcatgctacaagactgaagcagtataccactactaccaatgaacattttactgtaagttggggataaaaagattagaaattggcagaagaatctgcagtataaaattgagcagcagcttggaggcaaaggcagcacagcaataaacttgggaactgctctgctactaaccctgtattattctgcaggagagaggcagattgcccaaaaagccctcacactgtcccacactcccactgctcgccaagtccaagaaagggaaacaaaaaaaaaaggggggaggagagacgaagagagagacaagaacaagaaagggcaaaggcaggggaagaaagcagcgaaaggattcaacgcagctcgcgaaggccgcgatccgccgcctcgcctatccttcttgacagccgaccttggggcggatttaccggtacgatgctgttgctgttcgtctcccctttccgtatttgatctgattgtagtcgctaatcggcatgatttttatggttttactcatattggattgtatgctcgtagaacagaggcaaagaaccgatcaagatggggtttctttatttttctctattgggggttgaacaactgttcgaggaacaggagaaaccttttttttttctcagatcagtacaactgttccgttttccctagtaataacatcctttggtgttgcttagagaatttggttggatcactccgatattcatttcatagatatggattcgtgatagtgtgcgattttgtgttaacagtaaaggattcattttgcaaagtgttcttgatccactggggccctccagaacgcattttgttcaggaattagggttactgggttaaggcaaatgattttttttttgaagtaacaagggataattttcaaagttggaggggattttttttccttattctttggtcctgttcttccaaagttggttctttcatttcgggggaatacaattcctaatcgatctgaacaacttcatgaatcatgaccacattgcccacctctttgttctctgttcccctcttgtgttgatgcaacttgcattccagaggaagattgctttttattaattattgaggaggaagatgcgcatgggttatgtactgttgtagaaaatattccctgatttgaattcatcattttgacttctgttctaatatgcgcggctccagttcatggacctaatatagttcgatggacaagatagggcactgaattgggcttactgttagaggagtactggttctgcttttgctgaaggaattatcctttgtctgatgatgtgatatataagctacttgtaagctggaaactaatctcacattttctttagttttgttgataaaaatacaatgtgtgttgtatcatcttttggttggtatggtgtcgagcacatttttagttgtcaattatgtttctctttgcagaacatatttgatcgttctttgctggagtttatcaatggcagcaggggtcacttttaactggattaaaaccccacttgacatccggagatttcatgacttttctagtttaaggtctctctctcattgtacaactgaatcatttgactggaccccttgcatttcgaaaactgactattgtagctaactattgtagttttcgatgccgaaatacttttggatcaatccaaccttcctggctgacaacagaccaggaaccatctttttccaaagttcgagtggctgcagattactcagattctgttccagattcaaagtacacaagagatcggggttaccatcctcttgaagaagttaaagaacgtccaaaaaagaaggacctgtcactgacagatgtggaaactgctagaactgtagtagaggtaccctggtgcatctatacatttgtttagttactgatgcatgtaaatcgttataattttgcataggaatgacttacaagattcctcaatcactcaaccttaggctgagtaaatatctgtaaactgtaaaagttaagcaataaaaaattattcctgttgtaaaacaattaaactggtgatcttaccttgtgtatcgaatccctatcatactctggataacttttctatcttgtctaggccaatagcaagggattacttgtgttccctgcaagagtgcataatgaacctcatgggcatgttgcttggtcagactttcagtatattgtagatgactatggaggtaatgccttaatgtgcagcatatatttttacagtagggcattcatagtcctcattttcatataacaagttctgtacttatgtacagacattttctttcaagtacccgacagtgagaacatcttggaagatgatgctgcaaacaatcctgtggtaagattactctactttagtactttcatgttggcgtatgtcttcacaagcacatatcatgttgaatgatcactagcgccatgccaaaaggatcagagttttggaaatgttgtaaactgttatgcaccagtattctagtgggaatggcatatctgcttagttcttatcggaatggcattttaattgcagacagttttgattggaatggatggccctattattggagaaactagtgtggtgactagtgattttagcgactacatggatgttgaaaattttatagacatgcctgatgagaacgacagcaaggtttgccaaataaatcatcgcctgctttcagctggttttatgacaagttttctatcagcaacaattactgtcattagttgttgatatttcctttgtgatatgtcgcagatcgatacagaaataactgacattcttatagagtgggggatgccagcaacaatgcgtgcaatacatccaatttattttgcgaagtgtttgacaaaggtaaaccgtcaaaagttattgcaagcatcagcaaccattgaaatagtggagcagatgaaaactttaactaggataactttcataaatgtattggcaatgtgaacaatgaatatactgtgagtgattagttaattccaacctacatcatattcttagaaataatgttgtgaagggtgcaaagtctttatcttctggtaacaaaagtaagagcctggacctcaacttgatacttcaaaaagggaaaaagaaggtagaaattcaaggtatggccttacctatttcaagatacactctgtcaactgtaacagaaaaaaaaatagagatctgaacttagtggtcagataaaaggaagacaaaaggcatttttgtctcttgttctgggatatgtattcaatcagttagtactggttgtatatgaaagatatcattaaaaaaatgagtaaaatggtaaacaaaagaacaggatgaacttttgaaccagcaacttgaacttactgttttgctccaaattttcctataacagttcatgaaaaggtagatgctttgggaagcatagttcgtaacctaaattataacgagcaccatattacatatcaaccacctagtccatgataaatatactgtgtattcttttgctatgcaggctgttcatgataaacacagggaaaagatggatagtccatcaaatggtgtctcaattgtaggatatttgagacctgctttcatagaagaagaatcttatctaaggagcttatttcatggtgagtgcaatggtgatggttattcgtctgattggagaggtaattctttgctttatcttggttacttctgttaatactactctttgattctggtttatttgttctaatacacaagaaatcaaatagatgaatgcaaaagagaacctgcaccagcttctggaaccaatggcctaattggtaagttgatcagttgtgatcaattcattcagtgcacacttttgtttaaattttgttgctaatgttaattcaatatttagatgatgataaatcgagatttgatttcacgaatgtgggaagtagcactgattcaacaatctacaaactggaaataatgacggttgagctgttttccatatatgggaagcaggtaaggacttccctcttctgtccaatgtattggatctatactggttcagaatgcatacatgactcgcataacggaaagttgaatccatgtctaaatgataaacaggagataattttctcaactttcttggcttggttggttgttctacgacattactttcattctgttaatatctgcagttgatgattgatccacaagattttcaagatgcagaaccagatattcttgcaaattctgcttcagaaattataaatcgcattaaagaaaacgatgatcagtgcgctatggcactcaggtccctctgtcataggaaaaaaggcctcactgtcgaggtatgttcctgttcatcaatgccttaatccatgttccttgttccttatgttttcagttggcatttggattattacttccatagagtaagctaaattttgcagtatggtatgttttacaggaggctagcttgattagcatcgacagtctcggtatcgatgtaagagctttctctggtttggaagctcggacagttagattttcgtttaatgcgcaggttagctcttactcttagactcaatttttcgcatgtcctgtcacctatttaattttcatggagcctataacaaatcatttggaacctttggtttcaggcactctctgaacgttcagcagagaagaagataaggcgaatgcttttccctcgtcgtaagaacgtgaaaccttctactgaagatgaatgttaacctatcaaaacctggttaggacacaagagagtaaagggattcagcataagatgtgcatccaatctgatgcgaattcgttagagatactgcaaatctgccgactatgaaaatgacctcatttcctgaagagttag

SEQ ID NO: 61828 - DNA, 604 bp, Oryza sativa
ttcctgcagcccataaaggcttgtgcttagctctagttgatagcattatgtatgtaaatctctgaaaatgaaaactgaaaatgtcacctagtggtctactctttcttgacctctctaactgcttctccttctaatatatccggcagagctcctgccgtcttttgcttaaaaaaatatatttcatcttttttagttaagttattttaggtcggagaaaatatatatctgacgtgcctatcaacaagacaacaacgtagagttgtcagcattagcttgccacaggtttgacttgcaagttgcatgtgagtgtagcttcgacgcagcaacctggtgacctggattcgtggagagcaaacgaattgggatgtgcgagccgagcagccacctagcaaggtgtcgcgtcagactactgacacatggcccaaacagccaaacgcacagtcgtctcagcccacctaacctaacgatggtcggcctacgggcctcattgctctccatgctcacggcccacggtagagggaggcatgggccgccccctatctacgccggcctttacgggatcaggtgggctctggctctgaagatcgagctcgacaggcaccgc

SEQ ID NO: 61829 - DNA, 11551 bp, Oryza sativa
  unsure (1)..(11551): unsure at all n locations
cccattttaagtgtagttcatccgtcttatttaatttttttataattagtatttttattgttattagatgataaaacataaataatattttatatgtgacttatttttttaaaaaaaaagttaaataagacggacgatcaaacattgaggacagacacccacaactgcacttaaaatgggatggagtagaaatctacatcagagagaaagtttgctatgaaaaatgtactactactaccaatctgtctgttggtgaacatactactacaacttttttaaaaattcttttccatcaatgaactgacaagtgataaggctgtgagctagtgaggttagcaggttaatgttcttgttcttgatggcatagtggcagtcaccatcctgaaacgaaactagtggcgatgcttttctgtactaagctatagctcgatcgatgcaagcacgagtgtcagtgtcatctcttttttgttttttctcgctttctgccttggattggtctggtcgtgcccgcttttttcccgcgaaatttgattcgggagagaagctgatggggagagcatttcggcgccatctttgattaccgcgtgtgtgcagaaaaaggcgcaccggtggcagagcagaaatgaaaagaggatgcattcacagatttaagagatattttacggtcgtcgagaatattttaagggtgaataacatatcgcctctggataatatttcgaggacattgaagaattatattgagttaaatgcaccgatcacttcaattacgggtaaaggtaaaagaattctactgagacgatgcatcagatgcatcaaatagttcaacctaaaagcttagtccgataaaaactctattaactcgagacttttggctcaatggaatatgtataccaatcaactgttggcagcttttttttcagttcgagcccggctcgcaacaacaaggcttttggtcatatcatatctcggcgcctcccttgacatgttataatgcatccgcattggcagcgagtggaagagttgggttcgattccctttatacgcgatgtggcgaaaaagactgattcaacgaaatatgccatgcctgcattaagatttaaaacgtgtcgtctagcactagacatcaacaccgtggggccattccggataatgagtttcgcgcagcggtttcgaagactgaagctcttcttgcaagtatcaaaaagtcagaatgccaaataagagtttcttgtgccaaaggtaaggatcatcccatacagagtaatgggcttcaccgctgcgcgccttttcccttttagcctttgacaaacctgcaggtagctcattagtgaccaaataatggaaaatatccgctgaggtacttgcatgcagaccggagaggaggaggaaaacttagaatgtcgtcttttgcgacataaccagggccctcttgcccaaattgaaacgttaaatccacgatgcgatgtccatctttttcatttcataatttcctggaaaaaaagaattaactaatgaatcaaacttatctttatggaagattcgggaatatctacacgagtactcattttgcaaacatagcagaaaatctaaatgcgcctttggtgtcttggctggtaactttctcgtattcttagtccgtcagaaggggatcgagaaaattaaatataaactaatggtttgcaaaatcaatgtcttactggatttcgtctatccttagcttactgccctaagatttatatgcttggattattcgtaatctacctcgtggttacgtttttttatcttagaaggagttgcaatctacaaggcctataacgccgtatcagatctttccattgccctatggtcacttgcttaaaaacggaaaagagactgaacttcacttaggctttctcgcaagcttattagagcattgaattgagctatactaagagtaagatggcttttattctactaaatccaaagaatgctggctagggtgacgctcgtgcttctttcgagtaaggcaaacttagtaagggggtcgtgttattaagtatatttcttagctacaagcctggcctttcacttttcttagttcccctttttccaaccttttccattccatatctcaccactcttctttcccggataggtgcagaagcacacacatggggagtggattcaattagtattgcactcgcaaaaggaataggaataagcctcgtgatctaggcatctttcatcccgaggtagttccctaccaaaccccccattggtctttaaaaggaaggaacggcattttttacgaatgggagatcctataaaatgaagagcggctcaggtgcttttttctcttgccttctggatggttctgaagtagtgaacagcttccgaccattatgaccttttattgaattttggattttctataggagctcactactgctgcatttcaaatgtgcccgcctattgccttaatttacagacctctgcgattcacatatagccccactaatgtaagacagctcaagcgagtttagcctgagatataaaatcacactagccaataaaaaaagtagccaaacaaagccaggtagttttcatccaggtgaacaagtagaaagagcttacttggtagtggggaactcttgctgcattatctgagtgtatatgccttttaaaaactagcatcgtaggaactttaagaaaaaggatattgttttagcagctcttatttctattttactgctcaactagaaggtaatgcctttttttttgtgattcgagcagttcttgtcacgagatgatgggccagagaaaagtttgataggaaaggaaggcgacagttaaataaaaaaaagaaagggaagatgatactgatataagagtactgctctttgccctaagattacgatcagtcactttttatgtttcaatcagctcctcacttcttattaaggttttcgtgaccgacaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaatagaggtcaggagctgccggcagggcgctgcttttaatctgactgatggctcaagataagttggagacgtacttgagatagataatttatgtatttcgctactccacagagggactttcctgaattagtgatacgaaaaagtaaacgaataaatgctggaaaagcaagaaaacgtatgcgcaggcgcaagggaatgaatatcaaatattatcgggacccaatcgaatatgaaagaaaaaaagggttgatcgccctccgatctttcctttgaacgagcagttagcgaagcgatgaaagtgcttcgcgcgagactgcgggtgggtgtgggaactgtggcggcgttgtgcggatgggttcttttccgcctggtggaggtttcgctaaataaagaccctctaaatccctgggcgagtaccgcttcactcgtcttatcaactaatagcgctaggttaactatttaatatctctagcgtattcgctcgtgctgatgtttaatcatgcgatgccaatgatgtaagcgcgggcccgcaggtgcagacaggttcgtcgggggttatgcaagcttcagaggtggggggtacgattgtggaagatcgcgtggaggcaggggttggagatgtgatgcacggatgcggggaattgggtggaaggacagtcgttaatgtggagtcaggtttgacgggcgtgaggcaagaagtggagggaagtgggatctagattagaagagataaatacgatattcctgatctgatacttttcttttcttgagaagtagggacccaagccaagaattacgtattacaagtggactagtattcataggggccttttctttcgagaaggctttaataagaaaagaatttggtttggtagaccaaaaaaaaaccttctatcgactagagtttgatgtcgatttatccacacttccatgacttttagaggaaagctaactgcttgctggctggaagctgtatgagcgactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaaccctgctatgatccctcctgccgagaagggtggaaggacaggggagcacgcctgtggttgagctagtgcttcataccttactggacaaggaaggaaaggcaaggaggatcagtacgggagagaaagtgatttaagaatgtgaatttgatttgataagtaatcaaggcaattagcttaggttcatcccgaatccattccatgtttcttaaacaagtccttcaaaccatcgtgctaacaagccattctcctccgaaagtcctagagctttttctggtccatatgcagccttgaagaatcgagatgccatgtagaacaaagaggcgctggtctgggcctatttacaagcgaacccgctctatgacggctaagttacatgcacacccccattttgaaggcttagttacacgtataatagtctgcttgctctcatgtttagctgtgtacccattttggggctttactctttcatgatggaacgaggagcttgagttgatttgcggcagcagcggcaagcttgtgtcgactgcagacaacttgaatccgttagcaacggtagtgcgaagcagcttgaactgacttgttctagccattggccggctgcgactatgagtcttccttttctagccgaagaaaactatcataatgcttccggtcgaggaaaggttgaaaccattttagagctaggcgtggacgtatcgaactgaaataagatctaagattgacatcttgatacaatgatttaccataataataaatagagtcaatggtgacaaagccgtgggaagagccgcttcttttttgcggcgggggcttccattcaccagcggcagccccaccccctgtagagttactcgggccagcctccccttgtagctggggtagactggtagtagtttcacctataaaattttgcatttgtggaatgtaggttggaactacctgttccgggattgtagaaaggaagggctccacagttgaaactacctgttctggcatttccgaaaggaaaggcaggacagctaaaaataattcgctgtcagccgcagtatagatacttcgagttttggtaactctggaagtagcgctacagattgaagtttttctgcccccgattataagttctcgtcactgcatttccttagttggatccgctctttctctctcgtgcagttgttgcttccggctatttattcagtcgtcaatcagcattgatccgggtagttagtcagtctctctcttttttcccgtccttctctatctatgaaattcctaattaagggctcaccatttcaatgtctatatctgtggttccagaagtggaattgcccggaatcaaaccagtgaagggagtcccgagcgcacccttccatcccaagcgtccttccttttttttcccggttcaccacccactcattaaagtggctacgtccggggggcttacttatcgaccacatacccactattctttcccgacgcctcctttctcttgcttgatggaatagttcaatgcccgagctcctgctttgcttgcgttcttcaccggcactcgccagatgtatcactcatcccgaaaataaggcaaggagtctgcagtttgttataatcattacnnnnnnnnnnnnnnnnnnnnnnnnnnnnnnnnnnnnnnnnnnnnnnnnnnnnnnnnnnnnggagttgtggcatccaagacttgtttctagcaagcgagttacataagaaaccgaatctctaagttcctatgactttcgacttgttgaaccaggttcggtacgacctataagcgtaacttttgacttccttgccgtttgtgaattgagtcaatcgagttacgtttgcaaaatgaatggaattctggagtggaccgaatatccatggcagaaccccttatttgtgttgttggttggtctttctcaacgtggtctatagcacgaaaaaccattctttacaagatagggccgttcacatgaaagataagaaaaaatccattcttcatggtcgggcgcatttctccaaatcctccaggatcacaagtggaacgctaagcaagggtggggaggctgcgagctccgcgtcgaacagaaagaagcaagcagggggtgttgccgtagcgcgctggggagcaagcgtaggcaaccaaactaaataaggctaaaaaaaagtagaatccaaaaatgttgggattgtattaatgggcgatgggttgatgatacaagagggcagttttgtaaaagcaacaggaagaattgctcagatacccgtgagcgaggcttacttgggtccttatcctgcaatttggagagtagttgatatggtctttcttggctttggctttcaaagtgcagttcgaaaagagtgagttgctgtcaatggcgggaatgaaatatataaggatagggtggaaaagagtgaaatgagactactatacgcgttttccgaggagcaacatgatactttctttgccgttggttcccaactctccttccttttaatttccttcctcccttaaagctgaatctcaccattcgagaagctatggaatcgtcgacccccttaccaagtagactatgaagtcactttcgtttttttggttgtgtatgctatgtgtttgtgccccgtcatctacgaagtaaattcgacaagaaagctatccgatgtatattcgttggatatgataatgagcgaaaagggtggaagtgttgtgacccgaatacgaacccttgctatacatcctgagtgtggtcttcgcaattcttgggttggatgaattatcggaggaggatcgcggcaataatgagccaaactagtatttgcggtgaatcccccggttaagtagtcatgcattacaataggaacccctaattccctcgcaaatacagctctcttaatcatttcttcgcatgtacctgcagtcgcattcaagtaatgccccttaatttcaccggtttcggcctgtgctttataaatagcttcggcacaaaacacaaaacggtccctccaacgcataaatggttgtgagtttacgttttcatcatctttggtaaaatcaagtccaccacgtagacactcataacatgctctccaagcagaaatatcacaagtaccgccgcgaccagggccgtcgcaaggaaaactatatccaaaatcttttttatccgtggcgaaccatgctgcttgcgtagtgggagatgcccgcccgtcgggcccggcctgcttcctgcccgaaagaaggctagcaggactagtgcgaagaactgcttcaaatacagtatcgggaagcactgcttggggaacttcaatatccacaggcttattcgctaaatggcaattggcacatacaattcgtggtctgcagctcctgcctttctttacccttccgcttttcgggaaacagattacgctttcacgtagaaaatggaaggtcttcgctatatataaaagagctctttacccttggcaatagagcagcgcctacgtacagtaccttttatcctttttttattcctttactattatgtatatgtatgtgggtttacataactttttatgagcacagggttttttataatgtaaaatttggatatgaccttttcaaaggtttactacgaccaagaaagatgtcccatcagttaattcagatagtaagcaagaactaggtggattcaaacaacattgttcagttctttgaataaataataagacctttttttgtgcagaagcaattgtcgtacgacctgtaagcgtaacttttgacttccttgccgtttgtgaattgagtcaatcgagttacgtttgcaaaatgaatggaattctggagtggaccgaatatccatggcagaaccccacactggtcaaaaataaaagtcaatctctctaaaaaataagcacgcagtatttacagaaaaagttttcatttattgggaaagaatcaatgacatacaatgcattacagacgtatgatcattacccttagggaagcaagagtctcatagggaaggagatcctgcacagaccaatcaggaagagagtcttgttgtcaatgaaagcaatgagactatgtcacatatctgcctatctcgtgttgtgagctaaaaagtacccaccagggggtggaccaagaaagaggcaggcgattgggtccttcccatcctctgtgatgtcagtctctttgtcattctttcacccttgctgagtagcgaagtgagcatactcaagatccaattcatcaatcatttgagttggtacgaacataggaatccagactccgcttgattcgatcttcagttcgaaacccgtgcttaaatcctactcaaggcccactacgggtagcgagcaattaacaaatagagacaaggatgaggagaaatgacgcatatcagctgaaacaaagaagagtttggtccgctcttcattcaggcccggcccgcccatctgctgctaggtccgagaatggcgccaggcgagggtgccgctatgccccgcagctctgctgtggccggcccccagactatgcaaaagaatcgaggccgggggatgtcgtccatcagggcccccgccttacaaatgggtcgtcccccttaatgaatcgaatggtccttcgaccctcgtttgattccgacggccggcatagatgaaatcccatgagacccgcccactattactacaaaaaagccctgcccctggcaccttcgctacttcatattcatcattttctaaaaaaagggtaaggggtctcttttctgcaacggaaaaaaaatcagcggagctgatttgactcagcacaacctaacgatatatccaataccaatgatctatgcctaccgatacgatactcaaaaaataaattactatataaagagctaatgtcaataaaaaggctaatgacagagaagagtcaatctcctttactcctcccgacacctcaagatgagaaaatcccttcatctaggcgggcgctcatgcctactcagggagctacttctaccatggctgacacattatctccacaaaaaccaacgacccatcccgaagagaagttgactgacggggatgtctcgagaagaaattccagaattggtagctggaatttcacacctattttctcacttctggaccaagtcctcaatttacacataatcatgttttcttggtatctataattatagagcatctaaaaattgtgatagattgcagtcttgataatgctaacatagtattggtaatctaacaagcctttcgtttcttgtgccactcagccctgaggagggcgcctgctcgacccagtcaggtactactccgccgccggccccgagtaactctgcgggggtcggtgcagccctttcttctattccggagtgtataaacaaggatcctcaaaaagtgaaatcatttcgttaatggcatttcagaaatgagtcataggcgcctgtacaatgacagaatagagagtcctttttttccagaatgaatcattctattcaaatgtcaataggaaacctgggttccgttagcctcaattgaaacatagagttcaatcccagtgagctgtggtttcctactgtccattcggcaagaagaagaaagtacatagcgatttccgccctttttaaagtctatttcctcccctacacaggatcaccaaaacgttgtttttgtgcctatgttcacacttcgttcctgctcaactgtgctttttagttaaaacaagctaattcgtttgttctagtccggtaaaacctactatttgtgagatttcttactcctcaatccacttattcgttcccttctttcatatacctccccaccaatagatagagacaaatggagggatcttggagtcatttgtagactggacgtgttgttcagttgagtagactgtgcatatgggagtggatcctagatgataggaagcgctcaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggcgggatatcttactcaactgctagcaggatagccaagcattcctttttatctgggatccgctttcactacgctgggtatggtccatcccacaaccaagtatcatagcatcctggtccggatcgatgccgtgaagcatcttattcctgtggttctacagccgtaggagaagattggtttggatttctcacatctttttgataacttgttttgcgagtctccgaccaggaaaaaaggtattactttactgaactgaccccgggcgtgttaatatcagttgaaacacgctttggtccctcatccgtgaatcaatccctagcgggtcttgtctcgtaatcaccagatcctttttatcaagcgtgcaggaccagtgaagaaaaaagatttgcaaaaacacacatgaaacatattgaactcctaagaaacacctgaccttaggtgcttttttctcttgccttctggatggttctgaagtagtgaacagcttccgaccattatgaccttttattgaattttggattttctataggagctctctactgctgcatttcaaatgtgcccgcctattgccttaatttacagacctctgcgattcacatatagccccactaatgtaagacagctcaagcgagtctagcctgagatataaaatcacactagccaataaaaaaagtagccaaacaaagccaggtagttttcatccaggtgaacaagtagaaagagc

SEQ ID NO: 61830 - DNA, 588 bp, Oryza sativa
ctgcagcccgcgagaaacgagggggcaaggtagtgggcgcgggaagcgaggagccgggcatagcgttggcaagggaataaagacgccgaggaagggattcgtttccttcctctcgccattcttccccttgccttcgccacttgcgctctaactcttcgtttcctgtgccctacccttgccatactcgctcgctctcaagctcctcctccaccggcgtcatggcacggggctccgcaccgctcgacggtagcgtgctgccgccttcccgcatcgtgagcgagaggcaggccgggctgccgcgccgattcatgccggaatctgccaccggccgggaggtggtcacgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgagcccatctctccggttgttccggtggttcttcaccgtac

SEQ ID NO: 61831 - DNA, 5951 bp, Oryza sativa
attcccatagttaaagttcaggggagcaaagtttacctttttcctgtaaacaggttctttcattcgattatgtttaatttgatcgacctagattactagtatttgctttcctacaatcatgtactatgggaaggatccaactaatgaactaaaattttattagagttgctcatatattaacaaacaaaaaaaatacaatcatcatctggcctgtaactccttaacagccgtccctgtaaccagatctaacgggaactacaatgacaatatatgctctcaaatgcatcccgcaaataaagaaaagaccaaataataagctgaaatttagtttatatatagcagaacaagattcgggctaagccaacaataaacacatcaattcaagtaacaggaagtaaactgatacaggctagtactcagacttacgctttaaagtctgctgctgcataatccaggtaattggtttcacccagagaaggcaggtggtagggttttgtataagagaagaaagtccggctggcaaaaggaaccacaccaattgttgggtggtttgctttggtagctgcgttagggctttgaatagaattcaggcactttgcttgctgcattggaaggcagtacaaggaaattaatattttttttttcaacaaaggcatacaagttcactcttatattgtggaaaaatcaaagttatcgaaaattgcatagatgtgagaaaggaaacaaaagaaaaggcaccgccttgttctttttttaaaaaagaaaaggaattataaattggccggtttgaaagtgtaaaactagtgctagcaaagaaattgagtactattagctacttacagaaacaggaaggccatggttattgggaatcaccgtgctaaaacgacggagagctccattaaaaacattgttgatagcagaaacgcctcctccttcctgagaggaggaaaagagcaattatgctcttccctgctgtgaaagaaaaaccagaaatttgaaagatttggaggagtgtgtatacatacagcggaggtaggacgattaggcatcgatctggacagcacggacgagaattcctgaaacaagaaacgcctacacatgtcggcgatctataattctatatactgcttggaatttccggcgagcgctatctgcatataaaaaaaataaggggctaaaaccaaaaacaaaacgtaatcaggtgaggtagttttcggcaggcccccatgagcagcaaggaatctcaacagggaacttagaatctaatctaataacaatgacacggaaagaaagaaagaaagaagataaaactgatcctagcggctgcacggagggaagatgggattgaacaccgggcctccaaaccctagcacatcgcggttggggatcgaacacaaccttttttgccaaatggatttaagccatccgatgggggaggcaacgagcacggatgtaaaatatctcgcgaattatctcttatttatgtaactagcatggtggcccacacagattgcgcggctagcatcattatattttctctcatataatagcatatatgttttctcaatgtattattcaaatatattaaattgacaacataattttaaattttgtactaactttacgaaactactaatatgtaatattcatattgtattttatatacgtgttagttattaattatttttaatatcaaattttagttatttgtaaattatattcctatatagactctagactcgtctttcaatatttttttaattccgaatttttgttatctgtaaattgtatttccatgtagactctaggctcttctttcaatattatttatttttaattttgaatttttattatttataattgtatttctatgtggattttaaactcatctttcaatattctttaattttttttaatttcgaatttcaggtacttctaaattgtattcctatattgactttagactcttcttcccatgtgttttttttaaaattttgaattttagttatttataaattatatttttatacagactctaaaccatacttttaattttattatacttattttgaattttagttagctttaaattcctatatggactctatactctacttctaatattccttatttttaattccgaatttccattatttcctaattgtatttctatatggactctatactctacttctaatattccttatttttttaattccgaatttcagttatttataaattatatttctatatggactctagtcttttttattctgaattttaactatttctaaattatatttctatatggactctgtttttctttttcttcgattaatatgagaatttctaggccgtgagagcgaacgtggatgcttcattttctattcctttaataagttaataaattagttttgttaatggaatatgtttaatactccaaatattcgatgtgacatagattaaagtttagtctctgatccaaaattccaaacaccctctaagtacctcttgatgtcttgatggccatcaatgaatgaatagatgaatgatgtagttgtagtaataaactccatgaagtacgtgctccgtgacaagtagtgacaaacaaatgcagaatggggacgtggttgaaggtagaaaacagggtctagttgttgtagtaaaatctgaagccccgtgaaacgtttgttagtacggtggtgacgtggcgtgggtccaacgaggagggagcacgcacggtgagggagaaagtgatgaagttgcggttggtcagcgtcgtcacgagctggcttaagagaaagtgacgcaactgagtacagagtattacctccatctcaaaaaaaagtgcagtcatagggaaccccgtgtccgacgtttgaccgttcgttttatttaaaaaatttatgaaaaatttgaaaaaaaaatagtcacacataaagtactattcatgttttatcatttaataacaataaaaatactaatcataaaaaaatttcaaataagatgaatggtcaaaagttaaacataaacagtgcaaaactgcatttattttgagacagagggactaaaactttatagacggagatgacggtccatgcaagttatgaatgctgaaaagcaagagagaaggaggaggaagaccctctgtgagagcagaattcattaatttttcattaataatataaggaggtggaaagttgataagagaagtcttgtgtcggttgttggtcgggacgggaggaaggttcgtggcggcggcggcgtcgaatgagcgcaggacacggccgccccagaaatcgcccgtcaacctcccctctcgtgtcgcaagccgcagcacacaacggcgaccgtgcgcgcgcgcgtccccacgcggaggggaatggtggcgtccgacgcggagacacgcgggggaggggaagggaaccacgcgcaaacccaacgccctacgagactgtagtcgacgatgatttgataatacagcacggcagagcagagcaatgccaaagtcatggtctcctcctcctcctccccccaatccaaacccccaaaaccaaagccaaaacccctctcgccaccgatgggcgcccgcgcctctcgccaccgccaatcccccgaccaatcccaatcccaatccccatccccacaccacaagcaccaccaccaccaccaaaccacccgggcccccaagcccaagcccaagccccagccaccgccgccgcagcagccgcgatctcagcctccgccgccgccgcggcaccagccccagcaggcgccccagcaggcggcggcggaggatggggtggggcgggtgctggggcggcccatggaggacgtccgtgcgacctacaccttcgggcgggagctggggcgggggcagttcggggtgacctacctcgccacccacaagcccaccggccgacgctacgcctgcaagtccatcgccgcccgcaagctcgcccgccccgacgacctcgacgacgtccgccgcgaggtccacatcatgcaccacctcaccggccaccgcaacatcgtcgagctgcgcggcgcctacgaggaccgccactccgtcaacctcgtcatggagctctgcgagggcggcgagctcttcgaccgcatcatcgccaggggccactactccgagcgcgccgccgccgccctctgcagggagatcgtctccgtcgtccacagctgccactccatgggggtcatgcacagggacctcaagcccgagaacttcctcttcctcaacaagcgcgaggactccccgctcaaagccaccgattttggcctctccgtcttcttcaagcccggtatcctcccatctttcttttctactgcccattccttgctgcttcctccaaattaatataaataatttacacaaaccaaatccaccaccaatctattagccatcatctgctctctgtgtggacacctccaactgcgatgactatggtatcctgtcggattacacttcatttacgctctcatggtcaactcaaagcgggatcagggacaaatatagcggcaaaggcctgtgcatcatgttaggcaaggcatgggcttttgtttcaggaccacaagagaggaaatgtcatgaatcgtagcactgatggggtgctcaaggtgtgttcaaactgatggggtggtgtgggaatgcaggtgagcagttcagagatcttgttggaagtgcatattatgtggctcctgaggtcctaaaacgactatatggagctgaggcagacatatggagtgctggagttatcctttacatccttctatcaggggttcctccattctgggcaggtacattacatatcgctgctctttgcatcaaaaagtttttttatagagcagatcactatgtcatcaggcttttagtaagaaagcccagaaccaggttcaatacaagaaagcatccaatagattttgataccattatcctaacatggaccctttgttggttttaccagaaaacgaggacggtatatttgatgctgttctgcaaggtcatatcgacttctcatctgaaccatggccttctatatctagtggtgcaaaagacttggtcaagcggatgcttcggcaggacccaaaggagcggttaactgctgctgaaattttgagtaagttgatattttcaaactctgctatttgttgccaatcttggttctacgaattgatttgcccatatgtgtggttggaacttttaaagcgcactgcttgctattattagtaaaagcatttgtggtgattttacaaactaaatcttcatctgtgtatagtatcttaatctgatattttaaatacacagaccacccatggattagagaggatggagaggccccagataaaccacttgatattacagtgatcagtagaatgaagcagttcagagcaatgaacaaacttaagaaggttgccttgaaggtaataagatgttttgaacatcaagcatttcttctctatggctttgcactttattctgcaatacatgataaatcttgtcttttattatgttatggctaggtcgttgcagagaacttgtcagaggaagagattgtgggtttaaaggaaatgttcaaatctttagatactgataacagtgggacgataactcttgaagaactaagagctggtctaccaaagcttggcactaaaatttcggaatcagaattaaggcagttgatggaagcggtatgctcatattctctttctgtctctgcacgctcatatcttgattctgtaccaatgccagtagttcactataatggccttgtttggatcctccgagctattaaatagccctccggaatcttgctatttaggagtattaaacgtagattaccgataaaaccgattccataacccctaggctattttgtgagacgaatctaatgatgtatattaatccatgattagcggctaattactgtagcatcactgta

SEQ ID NO: 61832 - DNA, 781 bp, Oryza sativa
  unsure (1)..(781): unsure at all n locations
gctgctcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttcagatggtgacaaccaggagaagtgctgctaccggtgaaggcagtcaccccgaaggcagcaaccacaacaagcatggcagcccacctncaccttcttccccgccaccaccaccaccaccagacaccaactccatcctcacccaaatcctcgcccagcaggccaacatgatggctgctttcctccatcacatccaaaatccgccacagcataatgctccacctccaccaccacccccgcaacattctaaactcgctgagttcctccgcatccgtccgcctaccttctctagttccaataaccccgtggatgccttggattggttgcatgccgtggggaaaaagttggataccgtgcagtgcaacgatgaggagaaagtcatctttgctgctcaccaactgcagggacccgcatctctatggtgggaccacttccaggctcgcagccaaaaggacagcctattacttgggcccgcttcaccgccgctttccggaggaccca

SEQ ID NO: 61833 - DNA, 1167 bp, Oryza sativa
gtctgaatatacaacagatggatataaagttgaaaccactttctatgcatgaaacacttatttttcttctttttaggcaagtttatggaggaagctacactttgtcgtgaagatcagagtttagtttatttgcttatttccactgcgtttgtaagaattatttattatttttgaatgatgtggatctctgtatcaatttgtccgttgtgtactctggctggccctggacagagattttaatacacattctgcttgaaattcgggttagcgaatttctaggcgtgacacttgaccggcccaccagggttcggccgaactaggacaagcgccaatcgcccccaaaatttgaacactcgatctgcctactctgtcaacagtagaactgaatcattcgtgcggtagctcgttggatcgacccagttcattaaaatctctctcttgttcatctccctgtccactccaccttatccattcaagccactactctctttagctcgaatccataagtccagtccatacccaagatcttcaatggctgggaaatccttgttccgtatggtgctacatgctgaaacgcatttgatctcaatggagagccctctccggcgaatcaattggtttcgggagaaaactgggcgatggaagaagcaaatgcgatcttcatagaccccctggacaccatcgcggtggactccatgagtatgcggccgatcttttctgctcctagtttagccgaacctaggtcgggcgaaccctggtcggcctcgatcaaccccctgtttggccggtcgccagtctcgccacgctacaaaactccgactaaagtacggggtgtttcccaagcgcagaggccgacgacaggagaattgggtctactaaagcgagcacgatgactttttgaagacaaggagaaggccacatcttccgccagcgagcattatgtgggatctcttgatgtgactgtcacaccccgaagttcttctcccaagccaaaaatttaatttataagcgaccctaaaaaaaaaaccggtgcaaagcaagagtaaacccttttaaatcaatgcaaataataatcgaatctgacatgtggaattttttcttgagttctacatgtcgaaatttactaacaggatttttagtggaattttcagagccctagaaataatt

SEQ ID NO: 61834 - DNA, 560 bp, Oryza sativa
  unsure (1)..(560): unsure at all n locations
tcggggtcgtccccttcctccggccgcccgctccacgtngccaccaccgccgaaactgccgccacgcccaccttcgtcttctccgggccacgacgtccatgtggccctcgcgcccgcgcctnccgcgcccactcccctctctctctcccgcccgcgcccacgcccgagatgaccgggatccgattttcgaatcccgcctctctctccttccctactccccgcgttggccggcggaatcccgcccctcccggccacgtccgggattcccctcccctatttaagcttccccgtcactccctcttgctttttccccatttcgccgaactctcccgagctccccatcgctcccgcgccgtgcaaccacccgccgccgccgttttcgccactccggccgccgctagccgccgctagactcgccgccgcaccgcgccgtcgccgccgtcgggttcgcgaggctaagctccaccccgtccgccccttccccgtcgagattcgtcaccggaattcgcatcccctcacgctccggtgagttcaaccgctaccgccgctttcggccatgg

SEQ ID NO: 61835 - DNA, 649 bp, Oryza sativa
aatcatgctaagggctaaagtttcttaatctttctattgtcatcgtggtctatttaggagttaaccaacatggcatttatggtatacatatatatttggctaatcggtggtttagtctatcaaatggctatggaaggattatgactatatatgcatctatctaaatagcacggttacataccagaggttctgttgttagatggatttattattatttaattgatggaggctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctaatatacatgtttgtcatatactccctctaatttaatatatgcaacacgcaaattaatactataccgtacaactataatgggatgtatagtatatgtgtaagcaacaatatcttattattggatcatatatttgagtagttgctttttactgtaagctatacaatacatgttgattttaagatggctctgtttgggtaactaatggatat

SEQ ID NO: 61836 - DNA, 3585 bp, Oryza sativa
gatgctgccgaggccgtgctgctgctgcatcgcctgcgagaagaagtcatgcgcggcggcggcggcgccgaggttgaggtggtggagatcctgcaggctgtgcgccgccgcgatcacggcgtggtcctgctcctgcttgcaccacccacgcagcggctgcgcgtacgggtggtaaagcccggcggcgtgcggcggcggcgccgccgccgcctggaacgcgatggtcggccaggcggcggcggccgagtggtggtggtggccgtaatgcgcggcgtaggcgccgtcgccgccgaggtgcgaggcgatgcggccgacgtcgtaggcggcggcggcctcggcgtccttgaggcgcttggcggcggtgccgacggggagggcagcgctgtcgaggatgctcttgacgtcgtagcggctcatgtcgaagttggtgacggcgttgagcccccggaacttgatcgccgcgatgtcgtacgcctccgccgcctcctcctgcgtgcctgcatgcgtgacaccaccatcatcacacacaccattagcgcatgcaagcaagattatcattttggctagctagctagcttaattggtgattagtttgtgttgcaaagaatgtgattaacactagttaaattatttactgcaaataatgcattattgtttcttaattagtgaggatcttgaccaggtgcagtggtgaatggagacaggagtagcaccagacatggaaggtttgaaaaggtagctagccacatgaggagagcatgcaagcatgcacagagtatatatattagtggtgtaatgcaacttgacatgacttgcagatcacatttttagtttaattaattagttacaggcttaagtaagctctgtgttctttgaagagtcacccctctttcttactactactattttgccctgaatgaataaattgtacttgccaagaaaatatgatattttgtatactcaatgagaaaggacatacttattaatatggatttatatggttttgcagtataaatatgaatatttgtacttactgaaggtgcccaagtagaggtccttgttccctgcaactcttcctatccttgcttgccatctcccatgctggtgatgcctatatttacaagtacacaagatcaaattaatggatctatatcacagtcttcattttttaccctaaaaaaattaaaaaaattaattgtacaatgatgcatatatatatgtacctagttactccacggtaaatggatgcacctctggagaaaccactgctcttcctgcacatataaggaacagtatttgttagtatcagtaagcatcagataattaattaacttcaatgcgatagataaattactataaatctaaaaggaaattaattagtatagtatggatatcttgattgtagagaccaaccttctcaaagaggctacgaactcctgccttgtcatgtgcttcatctcctccagctccttttcatagttatttacctgaaaaatacagaaaccattgcctttaagtacagttttagtaatcatcattacactagatcagtatcaaataaaagagtgagaaaataacaatgtgacacaatctgtatattaattataaacacaccggaaaatttgtcgtcgtcgtcgggccccagtatttgagagcagccaaatcataagctctagcagctttttcctctttgtcataaccacctatcagcattacaatttataagatcattaaacttcaagaaagcaaagatcagcaaataattcaatctaccgaatatatacatgcatcgcaaacagaacatctaggttcaaggaatctcactcacctagatagactgtagattcaaaagccaagttcgatcaaacagaggaagatcattcgatcccgaaatgatcattagaaaaagaaacaagatcagtatcaatcgccattggagcataaaaaaacaattaatcgatttaaatggcactagttagcctaccttgacgacccttgcgagtttggccctctcttctgcagctgttgtcccaaagatgagcctcatacctccctgtccatctatgcctataaccaaaccaaaagatattacaactttgttaatcacaacaatcatgtcccacataataatgacataatgataaatcctacaaatctaatgatcaatctatcacctatatagctatcctagaaaatgggatccaaatcacaaacatcaaataggaatgaattcatgcaacacagttaaatcatcaaagaatatatatgattacactgatgatgatttgtgctaagctagctagtagatgaacttttttgagcaaaatatagatagatgattaattaattgcaccctaaataccttgtcacgccgcggtagatcgatgttctctggccgaacgtgtcgacggacttcctcgccgccgccgctgacgccgtcgtgggcgacgacgggcgaggaggtggccaccatgacggagtcggcgaactggagcgaggatgagcttggaggagggtacaggtagccgacgctgctgccggagctcgcgtagcaagcggcggcgctgctcgggatcacgccgcccttgccgccgtgatgatgctgctgctccgagaaggagatgccgccgaggaagtcctccagcttcggctcggcgacgagcgccgagagctccgatcccctcatgctccaatctgcacatcaaatcaatcaatcaaacatgcatgtctcttcaaatcccaaccaacactagctatatctagctcatgaatgcatgcatcgattggtgagcttaattaccttgggggatgttgaagcagacgtcgccggtggaggagtcgccggcggtggtggtggtggcggcggcggagatgagagtggagttggtctgagacggcgggagctgatcctgcggggagagggagaaggccagccagttgttcatggtggccatggttgatgattcacactgaacaagacaagattcaatgcgaattaagctatggttatatgtatgatttgctacttggttaagctctgttagatcaagtcgccattgttgtggtgagctcaaggttaggggaagcttaagctaagctaactgagaagaagaagaagaggtcaagagaggtttggagcactaagcaacagtatcactggtagatatttatataagatagatatgcatgatgctaattgctaagttagtagtactactactaatggaagtactcccttatgtaggagaaggcagcaaggaggtctagcttttgtgcacttttgtttttttttaaaaaaaatatgaatttgtaacctgtgtgtgcatgcaatacaaaaacattgggcatggtttaactgaacagaaaccactttctgcttctgctttctggggggtgagtccaccatattttgtctcattttcctgtgaatatttaagcctgtctatatgcatgaaacctacatgatctcaatactactagtagtatactactacaatacagtgtatgcagtagctttgtatataaagcaatggccttgggctcgataatagtataaaatatcatcttcttttttcactgcccttt

SEQ ID NO: 61837 - DNA, 9974 bp, Oryza sativa
gccaatcaccaccccctcagtaattaattgcgtcgttctgaagctaaaaggccacatcgagctagcagcatcagcagcagcatatgagcacaggagaccgaccgaaaaccgtgaaatttcgaggtttcgacattggccgggagcagatttccgagtgatataaaatttgaaatagtaaatttttagaacatgaatttaaaatagtaaatccgatcgaaatttcacgaaaactgtcataccaccaggggttgagatccagcgctcaatcggaaaggtgaaccctgattatttcacaccgcggaccaaatcgattagattcagaaaacaagaaattataaacgtgttagagaaaccacacactttttactgctgcacaatcaagcgcatctcagatcgatcagattcagagctgaggtgatctgatcaaaaggacgacgtcgcacggcgacggggcccaacctagctacgcttagcgtcgacgtgcatgtcgcaacgccgacgatgacgacgacgacggcgacgacattattacggatctctctacctttttcttgctgcatatgcatatcatcagctctcatcaatctctccctccaatccgtccacacctacaccctgacaacgacccggccggagaggcaaagtcgaacgccgacctgacccacatgcatgcaggaaaccaacacgcacagattaatatcatactcacacagtcacactctctccagtggtgaaaaacgatgcccatttttaccgaccaaaccatctgaaaatgcatggttactgattgaaataaaagtatatagaaaaagtacggaaatgaaaaccgaaatggtttcgatgttctaccgaccgttctctcgatttaccatattttcctaggaattacctttttatagtattgtagtaaccactatttttaaatattgtagtacatgtggcccatttaccacgacaatcactaatatttatattttcgtaggtatatatctgcaaatagctatttattacgatatccgtttctttcttgcttgacatttagaatgctgtcgtaaatcatgatcatgtgtctttatttaaaagacacgtgatcatctatttaagaacagaggcggatagaaagacagtaataaaactaccgctgattggtagctcgatcgattcctgtgccgacctagctgacaggtccacacaaaattctccaaataagtgaattgcgacacataatttatgcacattaaaagttttgaggactatctccaaaattggggaggtcctctttctcttggcttttggagggacaattgaattgaattgaagctaacaatggctgtggacacttgcacatcaccaacctaaccctaataaaagctcaaaagtgagccaaggaagaggccacgtaatcacaatggggttgagactgtgagagggagcagctagcgtcattaagcttggggataatattgttgttgttgattgggagcatgggtcatgtacaaggagatggtggtatggcctttgtttgtgcacgtagctagctaagggaggaaccggcatttcgtcccattttgttgttgttgttcatgtcatgtcttgactttgcttgttccattgattgctgctgattaagctttgctgttgctgctggcttttctcccatcaatgcctacactgcctcggtgtagtcatcatatttttttcccttatgacaagcaagtactttacatccgctcccttaaacagataacgtgaatcatataatacgtgcagttaaattttaaaattttaatatactgatgtatatgtaaaatattaggatttactatttggggactaggttaatagatttatcatgacaaacgattttagaaagttatttttaaaaatatttttccaagtacatagtaagaaaaagtaatgattgaatatgctctttctagtaagatgtgtccaaaatgtaggtttagctagtgatttttattttattatttttgtagatatttttcaatgaaactctctactcgtatgatattcaagcatgcggtctaaataatttgatagatattgatatatgctcaaagtttgaaattttggtttgagatgtgaaaaaatggacatgtattagagcatgtgggctctatggtggaggattttttttttcaggacttggtgggctctatgcctctatacagatctatgggccttggggcctcaagtaaaggcccatgagtgaaaagcgggaagggacgaagggtcatgcacgggaaaggcccaaaatcggaaagagagttccagaaaatctccatttttaaataactgagactggacacttcattttcaaaatttgatcattctttgtttttgcaaaaaaatacaaatactaaaatatgaattattattaaagtgtattaataataaatgtaaatttactatccaaattctacgcactgtagtctaattatttattagttattgatggtcaaagttaaaatagttttgatttccaaatattgttactattattcatatttaaaatttaaaaacttgtattttctacaaaaaaaatataaatattcaaaagattttgtattatcaatgtatcattcatcctaaacataagcactaaaactacattcattgaagtttagtgctccattggaacttagaattcttaaaacacggtaacaggaaaaatgcatgattaaagtgttctaccacctttcataaggattgaaaaaaaaagggggcagaaattctgcaggaacgaccgtttgtatgaagagtggaaaaaacagtacaagaattagaataaacatggtcaaaaggggtgctcttttttttcccccaagaggttgaacctcacgttgaaattcctatgttataagtcaatatgaaggaatatcataagatttttggataactatttctttgatctagagaaagaagatttttctataggattaaatgcctaaaaaaagccattgttccaaagtaactcgtgaatatctttttatgtaaatggaataaatatccctatatttgcaacaccatttgaatgtgaggataacttcttgtccacacagctactactacctccgtcccaaaataagtgcagccatgggaatccgtgtccaacgtttgaccattcgtcttatttgaaaaatttataaaaaaattaaaatatatttagtcacacataaaatactattcatgttttatcatctaataacaataaaaatattaatcgtaaaaaaatttcaaataaaacaaacggtcaaacgtgagacataaacagtataaaactgcacttattttaagacggaggtagtaatagacaaagttgtttaattgcgggcatcagaatttaaacccttattcacatatcgatattattttacaccgtacccgcagttccaccatcgtactaatggtgcctgccttttgtgactaaagcaaatgcaaaggaggtagacaagtagtagctatagcactgcacttcactagtttgttgggaattttgccggatcaaggaggaaacgaaacgggagcatggtaaagataaaaatctcccatacattaatttgctgaaagatattatacatgtgtagtactctctcaagagtgatcaaggttacttacgttagagcatctccaaccacctctccaaatcgaactctccaaatacccatataaccaattctccatctgatttggttagtcaaactagtagttcactctaacagtctcttcatctaccatctctacattgaatgtatgacacaggaacccacatgtcagcttcttcttagttttttatccctttccttcccattttcctattttctagcatatgcttccttccccaatggcagaaaacaaacgtcggcggcaatcggtggagtgatatggcgaatggagtcgacgggagtgacgaccgtcgctggcgggcgggggacatagacgtatccgatcgttttctgtcgggctgcactgcgtgggggcccggcaaccgcgacgagcggaggcgaaggacggcaaccgcacgggggccggcggccacggcgagcggaggcggaggacagcagccgcacgggggctggcggggtgcgccgcacagaggccggcggcgagcggcgctgcgcgggggccggcggtggcggcgagtggaggatggcggtcgcggcgagcgaagggcggcggctgacgtgctcgagttcctccccatgtgtcgtcgtgctctttctgtgcttggttgccgtgtggggatggaggagatgggctccgtggggcccaccattggccaaccaaatagagtggccaaatttggctagtggagggagggttttggccagccggatgacttagccatccggttggagggactgttggagcacgttttttttgctagaatggctaaaatttggcttggaaagtgggatggagaggctgttggagatgctcttacttcacattacgaatgacacaacacacaaaggtgatcgatcgaggagtacatgacgtctaccacaatgacgcgaagaatgtggagagagatggtacatgaccttttttttaaaaaaaacatggtacatgacctccatcttgtttatatataacgccattaaatttttttagaaacgttcaactactcgttttgttcaattttttttaacaaatgtaaaaaaaatttaagtcaaactttaaagaacatttgataataaatccaatcataataaaaaaaattacaaacatttgactacttattttattcaaattgtttttaacaaatgtaaaaagaatttaagtcaaactttaaggaatatttgataataaatccaattataataaaatatttttataataaaatgaatagttatatatatatttaaaaaattaacaacgtcatatattagaaaatgaatggagtatatatatttgtgaggaaaaagaagagggtgtgacagccgtgttaggtagatcgatgcctacaattcttgtacgaaagagggcaaatggcttgtgttttctgcgtgctatgacgaggggacgacacctcgcaggtgtacgttcgatcgtgcagctacctatctcttcccaatactccggctgagtttagttccaaattttttgtttaaacttttaacttttttatcacattaaaatttttctacacatataaacttttaatttttctatcacatcgttctaatttcaactaaacttttaattttagcgtgaaccgaacacaccctccgtctcagtcacaaaatatcttgtcgttgtatgatgcgtacgtgcagtcgtcactagttgaagtgtcgtttgctttggtttaatttgtttgtcattttaccaaatctcatgttaaactagagaatgtatcgaaccatattgctacccttaccaattactccctccgtttcataatgtaagactttttagcattatccatattcatatggatgttacatatatgtttgtctagattaattaacatccatataaatgtagataatgctagaaaatcttacattgtgaaacggagaaagtatatcctaaccatcttctttctgaaaaaaaaaacaaaacaaatactgaaattccttgtcagtactagtttcttttttaagaaaatactaccaggccttaccttgtagtgtgtgattttataaccaaagaaaacataatagttttatacaaatatatacttaaaaaaggaaaaacagaaggagtactacaagcgttgtaaccaatcagcacctatcttaagggatcattcatcctatacatatgcaaaagaacctcattttgaatagcagaccaccaactatcaaagaaaggaccaatattctgaaatatctttccattttgctgtttccaaatgtgctagcaagctgtgaagaaaacttctaagaaacctttctatctgaaccaaagtcttgctaagatcacaatttgaaagaaatcaagaagagaggtattccaaaagataccaagtttctaccagcacttttcactgaaacgactgagggataagaggtgtaaaatagtttctctgtgctgagaagggcagagaaaaaaacatgttaggtcagcatctggtggagcacatttcttcctatcaagcatgtctcttgtgtttagcagatcatcaaagaggagccaaataaaaactttgattttcatcgtacacttggtcttccaacttccataaccactaaggccatgtttgtttcagtttaagattattgtaatctagattattgagccagattgctgtaagcttgattataataagccgacatagaataagttgtaacatatttagagtggattaccatattatagtaatttggcttataatttgtaataatctaccataataagttatctgtttgtttcagtttacttttaataatccatattataataattttaagctgaagcaaataggccctaagtatggccgagaagcttgtaaaactgcaaagttcagtttataaaaacacttggaggtgtaattactttgattctaaatgaaactcgaaaagtccaccttctaatctgacaaaggttaaattaaggagcttagatcctcatgaattcaatgaaggcctcctcaggcctctcgtgagtactagtattcctggtgttatctctatatttacgttagtatttcaattaatttttcatttatccatcgagttgttatttgtaatttgtagttattgaatctgcaaactctataatagttgactaagacttcttgaaagcaaatgctggaatggagtttcattgttaaaaaaaaaattacatttgaaaattgctatagaaccaacatttcggcgaaagctctactaaatcaatgaaatcatattgatataataacttataaacactaaatatcagtccactaacaagaatagatatttatcttaaaaatcaaaactatatgagtcaggttctatcttcactttctctctcccaaacttttggacacgtggcttcaccacaagatgccaagtctacgcatatatcacgcctaatccacaagcttgagcagcgtaagtatatataactattaagagggatgcaacctcgacgttgcatgcaccatcccatggcgttcactccaaccacgctcgagctgccatccaccatgccaccggccgccgccgccgccgccgccacccgccaccgccacgcgaggccggccggccacttgcgctgcgccgccgacgcggtgtccacggcgccggcggagcggacggcggcgagggtgatcgccacgagctcgcgcacggcgtcggcgtcggcggcgtcgggctctgtcgctcgcgtgtggaggaaggtccagggctccggcgactgggacggcatgctctcgccgctgcacccggtgctccgcggcgaggtggcgcggtacggcgagctcgtcggcgcgtgctacgcggcgttggaggaggacccctcgtcgccgaggtacatgaactgcaagtacggcaagctccggatgctggaggacgccggcgtcgccggggcagggtacgaggtgacgcagtacatctactcgtcgccggacgccgccgtgccgggcatggaggcgtcgacagcggccgcgccagctgggtcgggtacgtcgcggtgtccaccgacgagacgacgcggcggctcgggcggcgcgacgtgctcgtctcgttccgcggcacggtcacccccgccgagtggatggccaacctcaggagctccctcgtgccggcgagcctcgccgcgcgcggcggcggcggcggcgacgtgaaggtcgagtcggggttcctcaacgtctacacctccgccgacgagacgcggcgcttcggctgcgccgacagctgccgcgaccagctcctccgcgaggtgtcccgcctgttcgccgcctcccgctccggcggcgaggacgtgagcgtgacgctcgccgggcacagcatgggcggcgcgctcgcgctgctcctggcgtacgacctcgcggagctcggcgtcgccggcggcgccccggtcaccgtcttctcctacggcgggccgagggtggggaacgcggcgttcaaggcgcgctgcgacgagctcggcgtgaaggtcctccgcgtggcgaacgcgcgcgacccggtgacgaagctcccgggcgtcttcctcaacgaggcgacgacgaggtcggggccgctcgccgccatgcgcggcgcgtgctacgtgcacgtcggcgaggagctcgccctcgacttcgtcaacctcggcgacctcgccagcgtccacgacctcggatcctacgtcgcgtcgctcagggaaggggtggtcaccgacgccgaggcggccaccggcggcgttctcgccatggcgatggagctcgtcgggaggcaatggcagtcgaaggacgcagccagggggatgatgcagtcaactggcttgatatgagagaactctccctgttgcaaaaactcttttcctcaatccttttgggcgttcaaaaaaaaagatatctatgttgcagggaaattgttttaacagctcgagtggatgtcgacccgttgattgtatgtcatctaaattattatgaaaaaaattaaaaaaatataaacaagatggatcaatatataatacatcaattcacaaacatgcatgttaaaattcaactcctacaaattgtaacaaaaataacaaacaaaactcaaattactatatgtacatttacaattaaatttgttatttttgttataacttgtagaagttgaatttgaacttgcatgtttgtggagtgatatattaaatattgatctatcttcttaatttttttgaaaatttttcataatcatctagttaacatgtaataaacggatggacgtccactctagctattagaatccatctccctctgttgcatccattttttgcagagatttttcccattggccactgagtgttaattaattcttagaatatgtgtccaacataatagttttattgactattttagtctgtaaattaacaagcagaggttttttggttttttttttgttttgggagaaaagagggatcaatcccttctcttccattgtactctcattcttttgctgttaagaaaacagtctctctcatttgcctcaaattaatttgtattgtgctctctctgcctctctggtctatagataagttgcaactccctccagtcaaatatttgaagtttatgacaaaatccacttatacttttaaaattcatatcaccaatattttttttataaatgcttagtttataaacaaaatgaatgacatcagtaggtttgccttaaaaaagtactactccctctgtccagaaatataaggtattatgtctaaaataatataaattaaggaagagaagtagtacatatgtgtagtttgaaaaagcatctttggcataataaacaaagtagtagtactggtaagtagtacattaagtacattctttgtattttttttagtttttgacatggatagtgtggagtagtagtagtaatattagaagctctgctcgcccaaggaggtagtttgctttactcaactcccctttttgataacaaggcaaaaacctccgacccgacattcatgagttttgaatgaagaatgaagagtgccctgcctctctttttttttccctaaatcttagaattggaagttggtaaagacccaccccttgtttaagttagaatgagtccccgagacattggcttccgccaacagtgaactattaaggatcgcatcccatgcatattccacattatagccagcaactgattcagcttccgcttctgggagatcagacggagctcgattagtttctactagacaaggaataaagaacataaccaatacggggagcgagggaataccggaccatatctgcttttgtgcctgacaatctcacggagggagtacttctcacagaaatcaattgatgggtggctgacaat

SEQ ID NO: 61838 - DNA, 4472 bp, Oryza sativa
tattttgacaaggaccacagcgggtaagtttacttctgtcatttttttgaaaatcattttgataggttcgatcttttggattaactagtttgttgtttgcttgtttctgtacaggttcataacagtcgatgaattggaagaagctctgacaaagtacgacatgggtgatgaagcgacaattaaagaaataattgctgaagtggatacagaccatgtgagtcactccactaaatacctagaaaactccagtgattactttttgatatgtcatcaacgtttagaatatgaaaataatcattcctgcggcctttaaatcaggataatcgaattgattacattgaatatcttgaaaacattggaggagatttggttttcaagtatgctgaatgttgctcagccatctctaagatcatggatgctggctaattataattttcatagggtaaatctaactatattaataaactatgtaagctagtgaactttgatccatcctgctctctagtaatcgagttcctgttagataaataaaaaggttagctatcgagaaatcattccttctctaagcaatatacttccaccaacatgaatacatgatgtgggtgaataactgaaaattgctgatgctattattcaaaagtgaacattaaaacgggaactgcatggatttcctactaaatactgtgtcctgacttactgcttaggatggaagaattaactaccaggagtttgttgccatgatgaagaacaacagccctgagattgttccaaatcgacggcggatgttttaagcctttcctacagttattgtgaagtttttttcctttcacaaattctatatggttccatcttagggaagtgagcattatctttgtaaatgttacaagagcagttcgtatcggcggaattcaatgaagtatatgcaaggcatattggactcgttatgtatcatggtggatagctctctgaagtgggtgtggtgcgtttgtgtatgtatgcttgtgctttctggccatatgttttctgtctcttgataaaaagagctctgtaaaacagtttctactgatcatatcaggcaaggcaagataacgcttttctggtgaagctgaatttaactgatgatgtatgcttcgaaatttgattacttttctttgccagaagaagaatttggcaatgaactctttgacgatagataagttgataactcgagaaggttttaaggttaagaagaatttgaccattgaagcgaggattggggatccgttaatggtcagcccaatgcatcttgcttcaatgccagattccacagcccaattgacctttcagaatttggatcgcaacaaaatgttcgcgatgacaggaccatatgccagcaaatctggtacaaatctcccttgaaaaggatacgaagaacatcagaagtatctctacaagccagcagctccatttcgaatatgaattttattgtctgctgaaagccgaggcttcttagaagcagaatagcacagcaacaacatggaactgattgggcgctgatgcagaattactacattttgttcatcaacaggaatggcaccactgatgctgacctgaaaaattgacacttacacattcagctctaaaccgcacaagcgaaaatcagatttacaataagcctcttgcttgaactttacagtgatatcacttcacacacacaaacgggaactaatcatcgaactgaggcctttctcgtctttgctgacttgtgcttgataaagagggtagctagcatgcttttagtgctaactggaaccttttggatttcacgccctctaggtttgtccaatgcattaaatgtcgacatatgcatgaaaccaggctggtcctgaaaatgcagacatggtaatttgcttttgttgggtttcataaagaacaaaacaactatatggggataaacccattttactgaatatagacaagtatgatggtaaaatattaacttgtttttaattcatactcctactaagcttattttatattccaattatttacctttgaaccaacatttttcttagcatcaaaactggtgttcccattcggttgcagaggcttgtgcatgggagaagcaggtatgtccttgcctgaaagatcaattatttagatggaacactcaattggcatacgaatatttcaaaatccccctattttacagttaaacgatatgcgcacatccatcatcagatcatggtcatgagacacaacacaatttagcatagtgtttgattacctagaaggtacatggaaccatttgatgcaggtttagacgatatagtatcccctagtctgcacaaaagatgacaagaagatagatcagaagagaatagctccattgcaccttagtaaatgaagaaaggtgcaatttaaacagaactgaacaaaacaactaatgatagtatcttacgtaaatgtatatttctgtgctccagttgtcgaaatgctgttctctgaagacagatgccatgaaagggtcttggctgcagtccaaatatgaaatgttgtttgttggttcatatgaaaagtagcatccataaaatttgcaatctgaacaaaaaggaacaagaaggtccatacctgaaggataaggtttaggttttgaatcctgaccattgtctgtttgcaggcgtgcagcttgagttcttttatgaccggtagctagcttggcaagtaagtataggcaagatttagcatttaattggaaaaaacagtggagaagttcttaattgtatacatccttacatggtaggatatagtgcttatgatgtttaaaagttgttccaccaatcttctgctgcctgaggcctgctctgtcggtgaagatttggcaggtgaggatttgctataaattggaggataggataaactgatattgtcagttaaattgtcatggtttgatcagcacatactgcatgcaaagcagatatagctttacctggtttaagcgtgcaaccttcagctcaaccgtagagacctcagaagcttgctgttcaaacaggtccgttaatttgtatgcaacagtaccaaggtgatcaacagcattgacgacagctcgtacagcataatctttcaggttttccagcaccctatatcagcagaaaagcttcaaattatgaaaatacgatgcactaagaaacaatgctttagaattaccatatggtctttttctaaaataaacattttagaacccatgtttcagaatttcttctacattaacaaatatgagaaaagcccctaatagtaacatgtgggctgcaaaattccaaattgaatatactagtagtatacagagatggtggttagataaatccaaaattccagagaatacagacatcctatattcttctttaggcagtagagtttgttttgttgtcacatctcaacatcaagtccccttgccacacatgttgctgtcctccttcacttattaggtggttttagcctccaatacctatcatataattaactgctagcacacgatgtaccaacgattcgattcaattcaattcaacccctaaaacaaaagacgaaagtagagctagataccatgcaagatgcaaatttaccactgattttatgattgtaaattaaaatggtaagtggtaacaaaatgcaccaaagagctaaaacctcactcacatctgcttctgctcgctgtggaggtaggatttctcgcagtactcggaggcggagtagagctgaggccgcaggttcttgagctcctgcacacgcacagacgcaaggcatcaccaccaccacaaaccaagaaccggccggatccatggacaaaattaagcgaaggaaacgagacattcttgtgagcgcgagggatctgggatggaatgcgggcacgcacctgcagtgccttgacgaagctcttgctccgctccatggaggcctcgtcgacggtggtgggccccaccccggcgacccccgcccacccgcccgccgccgggctcggccgcaacggctgcattgtcgcaccaccgttcttgcctcctctccggttggcggcggccggcgagtgggatgggcaagaagaagaagcggggaggagaagctaagctaagctaagcttagctcagtggaggagagtgagagtgaggacgaagcgacactactcctactaataaattgctcgagcaagtgtgcaattgtatataccacgcagcaagaaagcacgggtctctcttggcgcgtcggaggaggaggtgatggcgacggtagctagcgccggtgaagaagcgatctcggtgggattggctttagcaaatggaggtagcaatctcacgggggaatcatcatcattcatcatcagagctagcttaattggtttgtttgttggtttggtttggttggtcgatcgctttgttttctacctgcaactgtactgagcagtagtggatctttgctgtcctaacctcattgtccttattacc

SEQ ID NO: 61839 - DNA, 26705 bp, Oryza sativa
  unsure (1)..(26705): unsure at all n locations
gcacaaaatctcagtgcaagtttctgaacatctggaaatttgatttagagaacaccatgcaaatgtgggaaagggtacaagccaacatgtgcaaaaaatgatttagctaatgtaaattatgtcatgcggtgaatgattatctcccatttgctacaccgatctgatgattacaaggctgaatgtttttcctaggtaccatttcttcatatcacgatgcaaatggtagagttaattaagcgaggggtttttaagaataaaacacaacaaggtgtcaattggttcgaggacatatgcgctattcagtgcaaatgtgaggattggttttcttcttttcttgcaaaatagccaccacgcgccattttctccaaagagcaaaaggaattccatatataaaaggagaaaattgcaacctagaaggtattagtgactgggatcccttgctgtcatacgcttcataagctattaattatatactttcgttgtgattaaatgattaaaatcccaacctaaacacctggaagtgctaaaggcaaactatgaatttatcttgataaaagagctcatatctgtatttctctttgttctttcatataaaatgtccattgttcttttttttcaattagtaaatcatttcgtgaaaatgtcgatgtatatttgatcgttgaatattatttgccttctttcaactgagatggagtttgccttgccttgcctgcagccaaaagagcaatgagaacaaggctaatcaactgtccatgtacttaaatattaaaagctatttctttactaccttattgagaattggtttgaatttaataaattttcaggccaaagtgtctgaaagttcagtttgcacaccgtatcagaggacttatttgttgtttgatgggttattagattaggcaccgtatggtgtatactcctacttaatttggtttttgtttggtattgaattatggatgctgtcatcctcatccatggttaacacaagatgagttggcaatctgatgggaaaagtagaaagaattcctaaatgattgcatgatggtgactggtaagtgcatcccaagagaaacaggtcatgttaaaaagaaatagtgttttgcatgttaacttgctgcacacttatgtaaaagagaccacctaagtttgcctgtccaatttcaaagtaggtagactcttggagttgacagcgaatggatcttttttaaactgtataatttcttctactgcaattctggatagtagtcactccattttaaaatgtagttatttctactagttcttttggaggggaacccctcccctccgcacgtaaaacggagcgatatattaatatataattaattacgtattaactaaaaaaacttgaaaaattgattaatataattttttaaagcaactttcctatagaacttttgcaaaacacgcaccgtttaatagtttgaaaagcgtacacgccgaaaacacgaaaaacgagggagatgagttggtaactctgggaaagaactcagccaggaacgagggtgaaaggatcataatgtccttcattaatgcatggaggacttgtggagagtagggtggctggttggggtaaaaaaaacaactagaaatagctacatttgggatatatttgaatcctgaaaataactatattttggaacggaggaagcagttgatgtacattagcatttaaaatctgctcttagaatatctctaatgctgagatatacttgcaggttcactgttcttatgcttatttggttatataatccttgttatttgattattggttatatgataagcttctctatacaagaatacttgcaactgtgggacttagttgatggactgatcttacaacaggatatccctgaccaacacactttaaagttttcgaagtcaggaacttacacaagcaagtccgcttaccacacctatttcattgggtcgataaaatttaccacatggaagagaatatggaggacttggacgcccaagtgtaagttctttttgtggttaacggtgaataaccaatattggacatcggattgccttgagaagtttggaatatcacactcaaaagtttgccctctctatgaacaacagtaggagataatacaacacatccttgtgttttgtgtctttccccgtcaagtatggtacctaattatagaaaagataggcatggagacctcagggcctcaaccttcctcaaggcaattctctagctggtggtctcaaatggtcagaggtgtatctaaggaagataaaaaagactgaactgttatcttagtggtctggcaaatttagaaatacaagaatgacagtgtattcaacaatgccacaccaagtactgttgtcgtattggttgttgtggcaagggagagtttattagggcagtcccaactctctatctaggatggtgtctatggtattaactatattgccatgtagaacttttagtttatgtggcactatattaattaagagagagagtgaagagaggaagaaactaggtctcatgcaagacacagcatcaacacgagaacctatgcactagacactatcaaattttgcattgggagagaataatgtcttcataatagatgaagaataaatatgattggtagagaagagagattatgtatttattaatggctcactttaagaaaccgtgggttgtagagtgtagtttctattgtgatgtcttattgacatggcaccatagtcgacactgcttatgaacactatgggttgagactgcccttatggtgtaccgctagagcaagagctcttaatgaactcttggcccggttgctccccacttatgagcttagctcctcacatcgcttcagcaacttttttttatgtgttttcctttttttagagtgttgtcaagcgctctgctatacatacattatcttctctttaatgaaataaaacgcatggctcttgtattttcgagaaaaaaagttgttacgatggacacaaccataacaagaaaatgagctgtcaaacaatgatggttactttccaagatgctctactacaaaatatcattcccacattatgttataaacacaaccataacaagaaaatgggctgtcaagtaatgagggttagtttccaagacgctctactacaaaatattatgcccacactatgttttcaatgtgttgggtagactaaatagagaaggtttgttgcttcattaatccttgcaacggtggaattaaatttgaaaatatagtgttcattagtttttttctcagaaatatttcgaaggtaactttttttcaaaaatatacatctgatctcgcacaaacgtaacgtaaaattgatgtggacgtgacaacgcgggcgaccacggctcgagactgctcggtctcgtacggcggggctacgagattgagcggtcttgcgttatcagcgagcgagaccgaacaggctggatcgattaattatgattagcgattaattaattaattgttaatcaagataattaatcactaattattattaattaattattaatcaggtaattagtcaatagttaagtggcagcactcgctaattagctgagaccgaagttcgctctcgctttgtacttgtgcgagaccggtcggtctcattattttcggtccgcgagaccactcgacccgtgtcgtcacgctcacgtcatcttcatgtaacggttatgcgagatcgacggtatatttaggtaaaaaatgttacatccataatatttttaagaaaaaacaaatgatcagtatatttttaaatttaattctacaatggtgtatgagtaatcagtatgaattactgcttttgaaagtacaatctcattcacatattacacagcctatatatacagttttttttaatacgcaaaatgcgtatcactgtaatacaaagatcagggaagttgagacaaccaggtaccacaaatatatacatggtttatttatatttgggcatacaaacgcgcgaccaagtggctagtactatctgatagcattaatacagtttctgttttaaagaaatataatgcagcttgattgcacataatctatacatgtccacgacgaaatgtttgtactttcagaatcatcagtgaattgtgtagctgtcagaagaaacagagggaaaacgatgtgtaactgaagaaagaagtgctagcgccgtttctgcaccgaacaaaatcctagctggagtatctagcaaagttgctgacaacatcttcttcttcttcttcttcttcttcttcttcttttttctctgaacaatgctgaaagcatcttcagttgaggttggctataccaatacttcactgccaaatagtagtagcaatggttaatgcagaattccagggtgttaaattaggttcaggcttctgcctcatcgaactcctgctttacgagctacagcgacgcctgcatttcttccagcgtgtagctggggaaagattccacatcagagagatgacgaatgccatcatccgatagatccatcgatagatcgatccatggctgcattggttgcgtcgcattgcattccatctcgtagtaatcagtgagtgctcgtcgcactcacacaatcagctcgcgttcgatcgatcgaagctagcagctacctttcgccgagctcagaacggcacgtagcaattcagatacttctcttcgggtttaattagattcggcgtagccaagggggagaattttggtaggttttgactgccaaatataatacacattcagctccagcgactgtccggagttcagaaatgttcagagatgtagaaatgttcagagatcgtacttatcaagtctcgatcgagatgtgaccgtgtgtctactgacaatgtatagtaatacacatcgctaattaagcctgataacgtgaggacagcatcaggcagccagatgaaaaggcatgtggttgggttaccaaattaccatgaagaaggctgatggcgaactgcgtcgagtcagacgaaggagacgggcacaaaatcaagcagttttcagggctctgacgagttcaattctcaaggtatatttcagactggaaagcaacaccttttcttttttgatagatagattttcttttttgacctcataaaaaagtttatagataagagtagattctgctgtgtgcttccatgatgcagaacccggaggtgtaatcctcttccaccatcagacaaagagagaaaaaggaaaaacaaaaaagataagatggatgtgtatgtgcatgggctatctgggctggattgtgcagaagggctttggtggcccataggttgtgtggcctgtgggcttaataatttgacacactgtcaatgcaaccaatcacacagatcctgtacgcaaagtatcccctctggttttaagagtatgacacggttaacttttatacatcctccctccgtttctaaatatttgacgccattgatttttttttaaatatgtttgaccgttcgtcttattcaaaaaatttaagtaattattaattctttttctagcatttgattcattgttaaatatacctatatgtatacatacagttttacatatttcacaaaagtttttaataagacgaacggacaaacatgtgctaaaaagtcaacggtgtcaaatatttagaaacggagtgagtacgttttactatttatgttattaaaaatacgtaattattttttcatatgtttcatattataaatcgttttggctttttttttcttagtcaaactttatagaaaaatatagatatatttctaacacaaacaaacatatttaatgttacatttaataaaataattttggtgttgtagatattgctactttatctataaacttgatcaaatctaaataagtctgacgaaaaaaattaaaagagacttatgatatgaaacggtatttattataatttgttttattattaaaagtattttaagcatgacttatttttttatatacactattaatttcaataaacaagtagttatacgtatgtccaaacaatccacaacgtcgtacgttagaaaccggagtactacctagctggatagattttttttttcttcttctgattagacttttgaattgctgaccaattaatttttcgaagaaaaatagagagctcgcgacgaccaaatcgctggcgatgggttgagctccgtggcgagtgcaccaccacaagccagcatcgctagaaaacgacgatctctatcttttcagcgcccagcaacaagctactgctaattaagcacttgctaccctcgtggcttaagtactgctcagtcagtattaatattttaatatatgacgccgttgattttttaatcaaacgtttaaccgtttattttatttaattttttttataaatataaaaatatttatgtcagatctaaagaacatttgataataaattaagtcaaaataaaataaatgataattacataaatttcttttaataagacgagcggtcaaatgttgataaaaagtcaacagtatcacattaaaatacggaggaagtaattaacttaatacttgtattaataatctaatctaatacagttgagattagtagttgcagctgccacttgctagctaattacctctctctatctcccatgagaggaggatgcagatgcagatcatgctagctaattgcagcctgatcaggagagagagcctgcaacttggcgcccaaaaaatctcgtcatctcgttggattcagcgagagttgtacttgcccagtgtactttttgcagcagatctggcgatcaggcagctagcttagctagctaatagctaaagcttgatgttactttagggttcgtgtgtgatgggctttggtttcagcagcatccacatgcatgcatgcccaattgggaataattaattatatatatcaattgttgatgagtaatcaaacgcacacagcttaatataatataatctgttgctagtactgcaagcatcaccggatatcgaaaagcttttcgttagggttaggcattggttcggctgggtttaggggcaagaagaagaaggagaaattttaagtttttgtttacaccgtttgaccactcgtcttattaaaaaaatagaattattatttatttttttagacttactttattatccaaagtacattaagcacaactttttattttttatatttgcataaattttttgaataatacgagtggtcaaacaatgcaagcaaaaacttaaaatctcttatattatggaacggagggagtataaaattatcgaaagtcaaggccggttaacgcaaaaaccggttccaggttcaggcattcttgacatgcatgtactgtactatcaacacgcaacagctaatctgcatgccagtcacttaatccgtccgccaaactatcttgagaagacaagtaagagtagtaattaattaaggtttgacagtacgatctattgaaaataaatctctgtttttggcagtaggacgacgacccccctcggttctctgaagaaatcaagaaaaatattcagaagcagcacatgaagtcatcagtgatgtgagctgatgcaggcatagctgcagctaattaagctagcaatgcctattcgagagttgagaatcacacgtactccaaagtaggcccggtttattttccacgcaaaaatttttcatcatatcagatcgaatgtttggacacatgtatggagtattaaatatagataaaaaaaactaattacacagattgcgtgtaaattacgagatgaatcttttaagcctagctaattgcgtcatcatttgacaatgtggtgctacagtaaacatttgctaataacggattagttaggtttaataaattcatctcgcaatttacaggcagaatctgtataatttgttttgttattagattacgtttaatacttcaaaaaagtgtgtccatatacccgatgtgacacgctaaaacttttcaccctcgaaaattaaacagggccttaatctgacagtgatccatcagccacagcgagagaatcttagccatcgcatcgcacccgggggcgaaataggctgtctggctaggtgtccagatatccggccggtttatcgatgatcgatcgatgcagtttgctccccaatcagcttgcaattatgcatatgatcatgaatgcttacgtccggccaatgccaaccatagccaacagtgtactgctgtttgtgcagatcgatgccgtagctagccgccatggccgtcgtcgtgttgcagccatagctagccaagcagctggcagcagcgatccggtactagattgggcggggcgtgtttagtctagtctagtaattatgtagtgtgtgtgtgcctgtaaaatagtagccgctcacatggggaggacggagaagacgacggcaacctctcgtgcgtgcgcacgacgacggccatggcgtgcgtgtgtccttgggttgggtggcattgcagattggcagccaccacgaaccaaccaaccaaccaacccaacgcaaccatctgaattctgcaggctttttcgctttaatttggatcagaagattcagaactccagatgctgaattcagaggagacatactactgtattatttcctccgttccaaggttgctaaatgcgtagatagagtagatgtttacctaaagatttgcgtgacagcctcgttcagatgggatgagggtgaagaataaggtccggtcttatcggttgcgcatattctctaataaatcaaaacagcttattatgaaatataaattaatttataggtaaaacttttatatatgtattttttttacttaaaaaaccaatactaaaaagagattacgttgaaaatatcttaaaaccttcttcaaaattaagtttgaaattttaaattatggttttgattttgaattattaggccaaccaatgaggctctaaatatgggcacctaaaaaaaatcatttgctagtctatgcgatatcaaaagaaaaagagggaaacactacgggatggcatcgaaaatgagcttggattgacaatcttaacctaaacggcaacaaccacttcacggtgaatttaatcaaccaacttgtctccctgtggaacgcaacacagggcatcatccttgataaaaacgaacatgaccaaatcaccaggaagctgtcaaaccatggagaatactcgatcgcttcggcttataaagcgcaatgtatggaaccacgggcaccaacttcaacaccttaatatagaaatcttgggctccccaaaatgcaaattctacgcatggcttgtgatccagaatagagtttggacctcggatcggctggtggctagaggatggccaaacaacggggcatgccctctataccgcacaacaaacgagtcagcaagccacctccttgtccactgtagatacactagaaggatctggagtatgacggccacctgggtggcatatcacaactggatccaagccaatgggatctgtgtcagagcgtccaagactggtgggaaatgctatccaatatcaagggtgtccccaagaaaggcctgcgaacccttaccctactaattgtctgggaaatttggaagaaaagaaaccaacatgtctttgaacaaaaggagaccacagcccctagccttatggctaaaataaaagatgaggcaagaacctgaaccatggcaggtgcaaagatgctcagagaatttcttcctaaccggccgcctgtagatcttgaaaatgttgaacagtctttttttccttcacccctaggggttgtattttattccttctatattcaatgaaatagcacaatcttgtgctgattcttttcaaaaaaaatatttgagttttagttatttcaaattcgaaaaataggtttatttgatattttaaagcaatttctatatagaaagttttcgtacgaaatacactgtttagcaatttgaaaaacgtgctaacggaaaccaagctaaacatgtatcttaatcagatttgcatctcattcctgcagaatgcatatgtctaaccgaagaaacgaacattggatttagggtgtgtttagttcacgtcaaaattgaaagtttggttgaaattgaaacgatatgacggaaaagttgaaagtttgtgtgtaggaaaattttgatatgatggaaaagttagaagtttgaagaaaaaattttagaactaaactcgaccttagatgtatctaaattctgatgctttctccatccaaaaggagagtttacatagaaacaaaactatggttgactttagttttttttttttttgccatcaattagctgcaaaatatccttcctacaccctagtagtagtagccagatggtcggccgatcgatccatccacacgaggagtcaaaagaaggccggagattgccacgaaacggacgcgtgcgtgcgtacgttcgccaagaaagaaattcagttgatcacttcgttacaacttgaaactacaagacggattccgcacgcgcacaaattatatgtgtgggtcgcgtggacaattaactaccttttcaggtcggcgcgggaaaaaaagcccagcccaacttgcattttcacgtgacgtggattttttttattctcttccaacaaaattaattcgtgtgattcagagagtgccaacacaacgactgcgaaattagaatatgcatctattgttgcgtatatgtgtgtggagctttcagcctttcactgaataataataataataattggataggatttcattgccgtctgcaaaagggggggaaaaacaagataggattcggtgggcgcagctatctactccgtatatcgtgctaataattctgaaaagctacaaacaataacgtttaataatttcaagacatcgggatacgttaaaatagctctgtttagtcactttgcacctatttaaggggtttctagctgctgcaatttctttcagaatcaaagctccccctaaagctccccctaaacagttcattttttttaagattctatgatgatgtagttgtataatctagaaaatgaactaaaagtcatagactggaaaacccagctttttcattttttataacttggctactaaccagtagcttcttagaatattaaacttccaaaacaggtccaaagctatgttcttttggaggtgcagggaacctctcctcttcacgcggaaacgcatgaaaaatgcatcactatatattttttaaacaactttcttataaaaacttttgcaaataacacattatgtatgaaagcgtgcgcgttaaaaaagaaggaatatgagttttgagaacttagaagaacacaacctaagttaagagaagaaaagattgaaaagaaagttagtagtagtaagtcgtttcagttactctacactagttaagacatgatggcaggtcaaacaggccgacccaccacctgagccgacgtggctgaccaagtcacccccgggggtatccgtatcccgacgtgtgctaaccatccgagctgtcaagatccgacgtgggttgtgaaggcacatggccacacccacacatgtgcacacgcatcgtgggagtcgccccgtccacgtcacccttcccttcccaggccgacccgaacccgctaaaaagcagcggaggcaaagcagaagccgaagccgaagccgcaacctgcaaaaccaagtccacctccgcctccgcctccgcctccgcctccacccaccaccaccaccgccgccgccgcgccgccggagatgaacaggatgacggcgccgcacggggggatgccgccgccgccgatgccggcggcgggggggctggcgaggtacggctcggcgccggggtcgctgctggcgtcgatcgccgactcggtgatccggggccgcggggttggggttgtcgatcagctgcatcatcatcagcatcagcatcagcttccgccgccgccgccgccgcagcagcagcagatggtggggaggtacttctccgcggagtcgtcggggctcacctcctgcgagtccagctgccggacgacgacgacgacgtccacagcggcggcggccgatgtcgggcggcacccgctcgagcgcgcgtacggcggctccggcgagatccacgtcgacgcctcctccgccgccgtcccgctcttccgccacagcagctcccccgccggcctcctctcccgcctcatggctgacccgcacggtacgttcccctccctccccggcgacgaatccgtcgatctcgccgtcgccggcgacggcgacggcgacggcaacgggtttagctttgcctttgcgtgtgccaccatattcgctactagctttttgcgtgcacttgtcgccgtccgattggttccccgctccccgcggcgactcgcgctccgccgtccgatcgatcactcgcgtctctgatacgtgatagcttgcctttgggtggctggcaaatgtcatgaagggttgctaggactaaattattttaatcaaagaaggaaacagagagtgagagagagaaaataaattatgtatcctgattagttatccgagaacctcatctcatccatattagtatcatattctactatcataattgacccactattatattcatgcgagtcccccactggcacatactccaggggcatatgtgctgttattactgtacacaagtaagcttaattaacttcaataatggtgctcgtgacagtgcaataatgcatctctggcaagaagtagaacaaaagaaatggaaaagaatcccatcctcgcacactgtatctagtgtactactcctatataagtgcatcaggtttatagttattagttcgaccgttatatttccaattgtagagcttgagtactgcctagcaagtttagtatgacttcctccgtttttccaaatacatgtaactgttaattagtattattatagcttcaatcactaataatttttaaatattttgactataaaaagtcatattgtttatatttaggatgttgatccaaaacacaacaacgacacagatttatagtaaaaaatgtccgttactaatgtaacttagggctaaatataggtagtctccagtaattacagctgaaggaatagtactaagcagcgtgacactgtcctatacattatgtgctgcaacatacttagtacaatgtacagtattatcaagttgatatgattaggctggtgcattgtatgttgccgacatgactgcgaccgtttattggcgcacttgctggcggccatctgcttgcagcgaacctggacacatgtcagtgtccgcagaattcatttcctaacaatgaagcacgtaccactcggttcactgcacctgctactaaacctctctctatcgcaccagaaaaataattttgttgtcgatcaaaacgggccccatggatttaatttttgatttattttcgaaggtgcaagataagtcccccaaaaatgccgttttcttatatttattcggaaggttaagataagtgattcttgttggtgcaggtaggagtatgatttaagataagtgtatcggttagtttaacctgctggctctgtcagctatgctccaatcatgcataatgcaaatgtcaccaacaaaaatatattgtttgtttttctatggtcatggttaattcagaagggataaaacgttatagtaatatcaggttctcgttgagtttgaaaagtcaatccatttttgttgattaatgtcaccatgcataaggtgagtgacagcaacggcagacatatcttgtcgtatgagtcatgctggggccaatagtatattcgagcaatactgcatcactgccttttttcagcatgataaaatagtttgaatataaacaaaggagtataaaggagttttttttttctgtaaagcaaaggttaaaaaaaatattaccagggacggcattaataattgctactgcatcgatcatggtaaattcattactgttgcaacttgcaacttttcatcatgggctgatatatcggatcagatgcattcacggataagatgtaaaggcgatgacaaatatccagcttgagtaatggccaggtgctatgctagatctagcttagattaagccttggctttagcttagcttttgtttatgccttcatggggtaggcttttagataatggatgccccatactgattgtctttactctttagccgatttacacagacatttgctgtttgatggggccaaaaatagtttcttcaccatctgtgtcgtttcttgcagtactgtttggtgtccttgctttctgaaaagaaaattgttcatttctagttttgtatcaatggttagaaccaaaagttgcaacaaaaggttcttgccaaaatcagtcacaaaagttaacttaactaactctgtttagtttcagataatgatgataattaagataagatttttatttttttagaatttttactaacataatgaaagaaactttcaaataaaatttaaaattttctattaaaaattaataacatacctaaaatttaaaattttcaaataaaaatttgaaactctaaactcagatttgaaaactttcaactcaaatttgaaactttcaacttaaattggaaaactttcaacttaaattttaaaaccttcaagtcaaatatttgaaaacacgtgtgctgcagattgaaaaaaaaatcgaaaagaacacgacaaaaattaaaccgcgcggaggagagacaacgcgaaaataggagaaaaatcacaaaaaaaaaaatcagcaacgttatagttcggcacccttggtcccaaaacaaatttatttttcacctacttatacttattaataaaaaaaattagaataccttcacttatcaaatttaatgcaattatttgtctttttatctactccaaatgtatttatccactacttttataaattccgatgcaacaattattaaaaaataaagttaacttattttgggatgaaatagaggaaacaaatgaacttattctggaacggagggagtaactaatcttcgaggtactacctctatcccaaaatataagacataaccttatattttgggatggagggagtaccatactactgtagtactgtatcaccttgaaagatttttttttttggtaatataagagatttatcgtttatacagtagtttgttttaaagattggccaaaacttacaaaaactgacgtgattgttatgagttattagttatgaccactcactgacagaagaatctgttgcaaaaactgacgtgctgcctgtgatgaattgcaggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagcagcaagaaggcccgcgtcgccgccgccgccgccggcgaccacggcgacgacatggtctccagcttcagcaacatcgactcccaggtaatactccacactgccatgggtacaattcagatttgtgtttttgcccttgtgctgaaactgcatttcttgggattatccagtttggcttgtcgaagcagtcgtcgctggagatggccggcatggatgacttcttgcagctccagccagactccgtcgcctgcagggcccgggcaaagcgcggctgcgcgacgcacccgcggagcatcgctgagagggttagtcataatttggcaattttcccttcacccatctttgcatatgatatgattatgatacgatcgatgttggatgctggtatggagatctcatgttttctctgtgctgttttaggagaggagaacgaggattagcaagaggctgaagaagctgcaggatctcgtgccgaacatggacaaggtaactcaatgaactgtttgggtcatttctaccaattgaacctgacaattctgaacctgattggagctgtgcttgtccctcggttataaatcgaaattagttcaaaatgtttgatgtgatatttactggattcttctcaaatatacagcaaacgaatacatcagacatgttggatattgctgtaacctacatcaaggagcttcagggccaagttgaggtatgctagctccacttcagaaatctcttcagagaaaaaaaaaaactcccaacaggtttcatttgcatgtataggtagagttattagtaactaagttacagatatattcagggaattaaaatggaactgttacagaattacatctgaaataagtctctcatatattgaaattgatttatgcagaagctaaaacatgaccaagcaaactgcacttgctcaggcaagcacgattgctgaggctggagaaccagatctccgagctaatgttgtaatgatgtgattggtgaacccaaagttttgcttcagaagattagggtgtaaaagcacttcacatgtcaagtggcctccatgcctcgccctcccctttatcggttgtgttatggacagcgtcaatgacttgaagagtaggcggtgacaaagtagattaattgttgtattttaattgatgtaaggcagtggcttgtatgtaaaatcatccatttcaacgccaatgggattgcttcttattatcattgctcttattaaaagtatcctcctctttggcaccatttttgtgaattaccgactcattactgttgtttttgctgtaaatcaccttgtatgtctccttttcgtttttccaacaaacttattagttgttgtgtcatttccatgatctaaaaatacaaatgtttttgcagaaccaggattctaagtatgcatatttttttctatacataatgtcaggtatgtattcaatttctggttggaagaagagttgcacatctgaagtttatttatcatcagccttgaaatatgaaatatggaacagtaaagccaggctagcatttcatatgtgtcacaataccactatacagtttgtgaaatcatgtagcagaggatcttgatactgtccttgagaacaatcttaggtagcgtaatcttcggttatctgtattcctctcctgcaaattttacagggggatggttcctcaaaaagaagactgaagcaaaagaacttaatagcatgagtaggccattgtcagattttgtacagtgctatactcacagccttgattgtgttcttacaagagatggctgcagcgcatcgtagtgtccgtaaccatcgtagagcacgcagattggattgtccttgccatactcctgaccgtattcggcgatgatcctggggctatcagagcccttggtatacatgtaaacagtgataggcatcctgcaatatggcatcactcaataacaattgcaattatgcagaggaagatatggataacacaagaaaggtacctacctaagaacatgggagcacatgagcagttcaggttctcctccccaaacatgaggctttcttatctgtctcacatagctctcgaaatctccttcaagaaacctatccatcataatgaagattaaccagaaaaaaaaatacattatctgactgaggcttttttaaaatttatggttgaaacatcattagactatgagttaacaatgaaatccagaaggcaaacatgtaggagtaatagctaaagccagtcgttgcatgagaatttcacatatggataaaccagcaaaagtgattagtttgtcattttaagcatatttttagttatactccttctgcttctgcaaaagtatcatcaaaggtaaaagatgcatcaaatagacaacaggaaggaaaagaaaccattcagtgtcccctcttctcctgacaaactcatctgctacctggaacagacaaaaaaaagttcttcagtggatcacacaagttcactgaattgcatagccatcaagtgatgaacattgaacaatcactttcgatcgaagctcatcggcaagctccttctggatgctatcgcttggcgactgctttcctctccttaagcaggcaccgtacgcaacagacctaaagaggcatctcccatcgcctgtaattcctgaaatgtgaagacgacatcattctagctacatcctatgttcagcaatctagagcatcaactgaagcaaaaataagaacacaatcagaactgataagttagactgttagagagtgcagtgaaaaaattattccgatgcacaacaggacatatgtaaagaagaaagtcactattttcttttcttctttcaaaagggaagagactgatctctcatctaattttgtcaaagcggacaccaaattattttaagctgcgaccttgaccttaaactagcatatagtatacacacgcaacagggaaagaatcgcacaagaaaagcacatctaggagcgacaggaaaggcatcttgctacccgattagtttatcgcttcagattacagcctttagactgcaaatcaacactgatctctcctttctcccatatctactttttttatccccgaatactaaaatcagtgatctctcttaccactaatcacaaccaaaaagaaagcccaccttttcacaaatgggtaacaactccctaatagcaaccttgcactaatagcaactaactcatttgcttcctctgcagcatccaatcactaaccaagaaaataaagaacccaacaggagaagaacaagaaagaggtaagaggaaagatcaaggcaatcaaggatccaaggggatcaatcaaaacaggagccgggcatcgcatcatttcgcgatcggcgtcacgtacggatcgatcgcagcgggcggagctcccgatccgacatccgccgcgccgcgatcctcctctttcctcctcctcctcctgtcgtcgccggagacgaagggggattggaatgaggcagagaggggaccaggctcgtgggcgcacgagaggaggagatgggggggagggaagaacaaattgggcgtggagggggggtggggagagagaggattgggatggaattggattccccacgcactccgcttctgtccctgttcggattgccgcctctttttttttttcttcctcttttcttttctttttcttttctagttctctcttgcctgccacagtggcgctgccgctgagtgggtggaggcgttgccgtctcggatgctcgatttcccgccacaaataaatggcgggagtgagggagggagagccgtgggccgtgggccgtgggacgtccacttttgaatcttgctcctgggccctccgtgtcagcggcgcatggctgatttttttttgttaaaaaggaaaagaaaaaagaaagccctccagaaagcgttccgattttttttaatctaagcacatgcgacctcataattccaaatgtgagcatatattgtcctgaattctgtttctaatcaaactagctagcaggcacaaagcaaatgatccattaacatgtttcgctagtattacaattaactttgttgatgcagcttctatgtgaaacaaatcaagatttattagcacacataatattatgattttgatgatccaagcagatggattatatttcaaccgaccgctacagttccaattttcaaaacgaaaacaacatccaagtcaaatatggattaagaaaaaaaatgacgaagaaagctcgagactaacggcatgacggtacggtgccctatctcgtaatggttgatccaaccaattgcaaatggtaataagattttcttttctgacgacaaacaatcaattagacctaaacaagttgctacgagctagtgatttgtccaatgatcagcagccattagtttgttatatttcgtttgacattaagtccgatggaagaccactgcacacacacatgtgggcttcttgattaaaaatagaactacatccattacctactcatatttggaattagaaggttgcatgtgcttagatgtaaaaatttcgggaaagcgttagaggtgtagtagagatctataatactttgaaaaaaatattttttatattttaataaaaataagagggctgctacaaaacggaatcccgttgcaacaggatagacatattaactattctcttgcacgagtataacaggtatcaggtactacgtattacaggtactgggtaacaggtatcaggtatcatgcagctggtaccacaacaggtatcaggtactgtcttgtaccgttatctaggttttctgaaaataaaataaaattatagtttgccatgtgggttgttgttcagcgaaattgtgttcccatgcacacaccttttttttaaaaaaaaaacgttcatcaaaaaaaaatcctgaaatagtgtgcgctgataacacaattgtgctaaataacatttccagtttgccgtgatgccatgtccttggaatgaaacggctatttacctgcacatgagtatgtgacatgtgtttccctagttaaagtataaacaaatgcaattgacatacctatggttcagatttgcaacatggaattttttcgtagttcatatcaaaattgtattctggatacggaattcgtgcatttcaaaaaaaggttatgtatatgtaaccgttaattttctcttgacacgtataaataatggtttatatagtcgtcatcatataatttctcttgttttttcgtcgtatgtacatgatattaaagtatgttacttatttattttcttacgtagacacgtggactaaatttatccttatagtccccactaattcttccgttccatgagtctagacaaggaggggaccatgccattccatggtcttctatggattgcttgatactcgagtggtctatttgcttttcaatactccatcctttttaatcttgtcgtctattttttgtgtataaggttatcagaattatcgttgttttttttaatcttttgacaacatccttcttagattgccaagacgtttttacctgtcaagttctccacgagccattttttttctttttggagaactcgttctaatccatccattccattgtcaaatagtgtccaattatcgaagaccttgtcatttttcgatcgtcaaaagtgatgggtggggctatcctccaacaatcacatatccatggttcatctctatcatcattgccatcaacctctcaatagcgcacacctatatcatgtgttgttaaagcttggatccaatggccaagaaaattcaccctcatatgtctgtgttaataacaagagatttgctagatttaagggcatatgaaaatttgtaatttttcagtcacctaaaattacacattgctgagcttaaaattgtagtgttatgcaatgtgcaactttatttcattttatagttttaatttattttcatctgagtttgaattctttttacatggaattttataaatgtgcgtaattgtaaatttatttcattttaggttagtgtaatttattgtttaaccttttatatatggaagaatgtatgttgttttgaataattaaaagtggaggtgatgagaaccatccaattgccattcatgggaagagaaaaagcctaagaaaaataatttcagacctgttcatatagatgtatatgcatcgcactactggaaaaatacttggtccagaattcgtgttgatgtcaaagccgacacatacttcctccgtcctaaaatacagtaatatagtatgaaatatagtaatatagtacgagtttagatatattctaatactacaagctctttatagaggcctatctagattcaaagtgctagcttatattacctccgtctcaaaatataacaatttttggctatgaatctggacacacagttgtctagatttatagctaaaaatgtttatattttgggatctcattattttttgagataaaggtggcatcatcatcatcatcatgatcatgtcttgaccctaagagacaaacacaacagaggtctctcttgcacaacactagtagcctgggcccaaggctgaaatgtcaccaacaaactttgaaggccagtccacgagttttcttcattcatgtcggccctcgaatcactgtcttgcctcctgtggcattttcttcctttttgatctcatgtcatcgtcttcactggcttggcttccatgtcctgtcaagccatagcctaaccctgcatcttatcactgttgcatcttgggacaaaactataccatgaggtactagcattcaacaatatttaatttaattaactactgtaccaagattggtagtactaccttcttgagctgtctgatgttgaatttcttgagcagttgggcctcctgaagacaagtatctgcatgagtgaacctgtatagagtatagacacgttaacatgttagttgtgattcataaaatctgatgatctgatctgaacttgtgaaatgaagtgaagagagctatgaacatatggattcaggggagacaatctgatgatctgatctgaacttgttaagtagagtgaaagatgagctatgcacatatcttggcaaagaaaaacaaagaggaaatggcctacatcaccccaccgagaagggggggaagatagttttactttacacaaggaaacaacaaagaaggcaaaaaaaaaagaaagatcaagagaaacatggaacaagaaaagatgtacatatccactgatcaaactcagctcaaaaatctgctagcattggtacagggagaagctcctgttcttccacagtgagctcagagtccttcctagcttcctcgatttagacttgcacagctgttttgagtcgcggcggcacaccatggtgccgttaccggtctctcccgcctgctgctgctgctgctgctgctgctgctgctgctgagcttgctgcggcacaggctgtgccccatctcgctgcctttgctcccggaacagcttgagcagcttctgggacttctccttccccttgcctgtgccggttgccgagatggaaaccaaggaaggcaccactccttcctgcagcaccggtgcgatgcacttgtcatcggctgagcacatcaccaaaaggcaggacaccgactgctcctgctctgttggctcgccggtgtccagcagcatcgccaaggtgctgatcagacctggggtggacatgatatcttttctgccagcttgggttgccgcaaggctgatgagcactgcaagggccttctctgtccaacccaggccctcagacgccagggactccgaaaggagagagtgaagagcttccacaatgcccgcagacaaaagcgacggtacgctggcctggtggttggagagattgtatagtgtgtatagggcatcatgcttgcaagagctgccttttgtgtcgcgggcctcatgactgaacagacggtctactaggaatgacacagcctggctcgaaccaatgatgttctttgcctcaggtaggcaggaaaggttaaggtatagtgccgtggctggagcagataggcgtggatttgatatcatctgctcaagttgatcgattactccagcagacaataaaagtcccttgttcctgaaataaacaagcaaaggttaagcaaaactacagattaagtagaaatactgaagatgaactcagctagttgtaattgataagcagcacataaatggaaattaaattcaatacctgttattgttgacagcaaggttaaaaagagccatggcaccaatttcctgtgccttctcatttccatcttgcacagcgttcctcaagaactgaactagtgcctcagcaaacccatttgagcccatctggattctagcttcctcatcatctttcagaagatatcttatctgctcaaccaacctgcactggatgtgtaagttggttttttcatgaagcattagcagtaagtttcggtacccctcattcatatcgaaatcataacaagagctgtcgtccaatgttcccgattcgttgtttgctggctcttcttttctcacgttgtccaatggaactaccttgacactcttcacgttgatagagtcaaaactttcaagagacacgcagccagtcgcttcggagtcagataaagcaagtctccaatttacatcgaaggatcctggtggaccatcaggaacaggaaaatcattctgctcacaccagctggcaattagggccttaacacagtaatttggagtcaaagacaggtgagataattgctgctgagtctttggacaggtgctgtgaccatcattaaaccatttctcaatgcaaacacgctcataagtttgccctgatgaaatgataactgggtcgtacatcagttgtagggaaatagggcaccggagctcctcaggagggatcgacatgttttcggaccttggaccactacgcctacaattgaatgacccaagcctagagttgaaagatccaaaccttgaattgaatgattgaatactcgaaagttgtctgctgaatgctcggccattaccatagggtccatacatgtcctccatgcctaatattgtcggcgagcatggagacgatccttgagaatcagtatcatcaccagcctcacttctgaaaaattttgagtatttcctcattagattgtacaggtatgacacaacatactctttccgcttatcttcatcagaacgagccttctcaattagcttcttcagggcccttctctcagtgagtgctgccctggaagacgtaattcccagctttagtgcagccatatgaaaaacctcaagctccccactatcactggaactattcattttcctgtttctctggagcaaattgatcacctcgtcaccagcttccttctctgattgatccaatgtaaataccacttcttccaactcagcaataatctctacaatctgttgtgcaccaacaggtccagatgtcaggaaataccatatggtgtactaaattgtaaaaccataacataacttgggcagagttggttttgtggttcaaagaaatcaagtactaggaggataggattttcacatgacataccttacaaccaatttcttctgttactatgccctccacgcgtctaagactctcctgaagttgggttcttgctttctcaaatttcaaaagcacagtttctgcagttatggcctgaaaatgaacaatatatttaagcatataacatttttaatgatcccaatggcacggatcttctgaagaactttatggggatgctggtaacataagcttaccaagtagagcctgctgcaatctgcacaatgttgaagaagacctttggctttatctagagctacatgtagagagcatagcgcctgtatgccagatttgcttctgggtcttgatgcttcaatgaaagggaaaatcgctacaagttttgagaccgcaggatgaaatgctctgtacattccggcatgcaactgcataaaccacgatttccttagatcatgtatcaacaaatacatccagaaaaggttgataagattccagtaaggtggctaatgacagtaggtcaagaacaaatatatactctcattgccatcaagataaaagcactgccaagatgataccttagcatcattagccagaaaaggaccttcctcggcctccattgcatccatggttaattaccaccagagctccaacatctgattacaaagattcaagagagcaaaaaaaccatcttagatgaacagatcgctcccagctattctcacactacagataattaaacagatagtagaatacaagttcccttagcactaatgcattgaacagatttggacattagagaacgggacaaagcagccttccagcctatgagcacgaaatagaagagataagaatgccaaaagaagaaaccagccgctgcaagcctacacaaatagtgctccctaacagatcgatacctatctttcggctaaaattcaagatttcgagctcctggagcccatgaatttggaccaatctcacatcttttgaactaatccaaggcactcgactgttcccagaatgctgcatttgaccccatatcatgcctcatttttttaaaaaaaaaattcagataagcagacgtcggcagcttgctttaagtcttccccaaactaagtaagaattcaacgcagcatcctccgtgattggaagggaaatacgataaggtgtgggctgcgacatcgttttcaccactcgaaatctcccccatctgaacttcttttttttttttacttttaaccgcgagacaccaaaaaaaaatcagaggaagaaaagaactcggcgacactggaaccgcggtttaacccgagatccccaagaccacccccaatgcacgaactcagagaagatcagaagagaagaggatgagagaaaacacgagacgaccctcgcggcgcggacgaacagctcttgtccgcgacctccaaaaaaatcctaatcatttgcagcgaccagaacacgagcggaagcgcgaggaggatgaggagcagcagcctacggggaaggtgggaaggcctcaccatttcnagcggcgagagaaggggaggaggaggcagctcggcggcaggggcgacgtcggccagcggg

SEQ ID NO: 61840 - DNA, 2330 bp, Oryza sativa
gcatatatcattttatagacatactctttctagttgtataatgtgagacggttgacattagtagttgttggttagggtccatgtgtgtgcttttatatgtgttgtgcactcatttatttatttatttttgcatggaatgtgcaattcaaattatgcactggaattttggaagctcgggatttaaaatctggtgtttttttaagtatttttgtgttcttcatttgggtcttgatttagtcaatcatgtactccagcattcaactataataaactgtttctaatatcattatactcaatagctggtttatatattcacttggtccttttttgaaaagcgatcgtatattataattaccaataactaccacctaagctattttttgttgcatccgaaggacgtacatgccgcacacatgtagtaggttaaaaaagagatcctgctcaaattaaagcacggttttttttataaaaaagaattcgatcaaattaaatcaagatgatttcatggcatgtcgcgcgtgatgtttcttttctcccatcacttcgtcacgaaactgatgtttaaacaaacttagttgcgtacaactgcatgttcaaatgttttaatcagtctcttttactttagttatcttatcagcatatttgaattcacagttatgaatagttactctgatcactaggacaggagattaaaccaaggtgatctccacaaaatttcatagttaattattagaattagtacttgatgatctcaaaaaaacaaacgctgtgacctactgatgcatgcatcagaacaatttggacaaccaacacatgtttctgccaaaaacaccccaaaatatgccaacttgatttcgccaaacttctcccataaacccaagctttctctgaatattagaataatataatgtgcaggaaatggcgccaaatcgatctgatcccagatttgattaacaactcaagccagtgtaattaacagagatctagcttagctagtgccagcagagtggtggtgtgcatctcaagttggaacattttgttatgttttactccctccgtttcgaaatatttgacaccgttgactttttagcacatgtttaatcgttcgtcttattcaaaaacttttgtgagatatataaaattatatgtctatataaaaatatatttaacaatgaatcaaatgataggaaaagaaataataattacttaaattttttgaataagacgaacggtcaaacatgtgataaaaagtcaacggcgtcaaacattttgagacggatggagtactttgttagctagggatcccagctgattccatcagatgccaaaaccaaacatggccatgagacaggaagaatataaaaccaaatcttaacatgccaatcaatgcattatgtactaatcaagcaattaactaaggaggattgtgtgtgtgaaaggccacccccttccactggcttggctcctagcctctcaatgattccaagcatttccccctcagaattttaaatttgtcagagttagatcaagctctgctttccagtggatcctcacacacacatcaaatcacccaaccagatttgattttggtttgtctcaggagaaattaagaaaggtcatcacttgctaattaactccaccaggaaaaaaaaaagctctttttcctgagaagataatataccatgaggcctttaagagacaagcacttggagccataggtgatagagatattgcttagtagacttgtacttatgtgtcaaggaactattagcaactttgctatagcactaagcagagaataagggaaaagatgttactgtttgatgggcaagtttggttgatgggttagacaaattattaaaagggggagggattagaggattgaccactaatttaattccatgatgtaatgcattgcccacccatttgattaattacatatgtttgctactttgatagcaacttactgatcatctagtcttagatttctttttctttgcttatcttttatggctcttttttttttttttgcttttgaaagcgctggatgtttctgcaccaacaaacttggcgcaagaatattgcccactaactttgattcagaattcatggagaaagctgtagtagcttgcaaggagaaattaattatttaaaactgagacatgagtaacaaagaagcagagtgccgacctaatttcagaaaaatggcaaaagtagctcgctttctggggggaaatttttttaaaatattattgttttgaatatcaattcagaaccgggtaacacatgtatacagagaaaatgcagagatactggagggtacacaactg

SEQ ID NO: 61841 - DNA, 16731 bp, Oryza sativa
  unsure (1)..(16731): unsure at all n locations
cgatttatacatacttgtaagcagtcagccgcaagaaggatgctcccgatggtaataccggcgttgatggcagtttgcacggtgaccaccaagtagaacacccatccagatcctgccaagagaagagacaaaattgaattaatgacactcttaatgatgaggtaattaatctctacatttagaagaagatgaggtgcatgcggaccgaggacgtcggcggcgagctcgcggaagcggatgtggcggcggccgtgggcctcgcagtggtcgaggaccctggacatgaggtagtaggcgtagaaggtgacggcggcgacggcggtgagcgccaccaggccgagcgcccaccccatcccccgcagcgcgtacgggagcgtcagcaccgtcggccccacgatcgccgtcgtcaggtggaacccggcgtgccaccacttccctggaatcataattcaccaacaattaatccaagatatatactcctccggccatatgtgatgtgatcaggtagtagctaggttaattaggtgacctttggactcgagcacgaaggcggcgccggcgtcggcggcgggcttgatgccaaggcggcgagcgccggacgcggcctcgacgtcgaacaccgcggcggagggcggcgtcggcatggtgttcatcaccggagagggagagcggagcagagggctgcctccggtgccggccatggatctacgtcgaggtcaagaagaagctcgcatctcgctgaacacacttacaccttacagccttacaggggtatggtatgagatgagacgagaattgaattgtgtgtgcgttttgatttgagtttcttgtggattacaactacaactacaaccaggacagcgcgcgtgaggaagagaagtaggcctgaaaccgttgacctttttctttttgacaagaagattattgaaggagtcttgactgtatcccactcccaccccacggcgctggagacacgtaccactcaaaccgtgacgcttcagtttctcatcaagccaactaaccgctcatgcgttgcaggagacccaaggcagatacagatattatctactaacagcaggcagcagcacacatgtagattataccaacaacatggaacctatactgacaataaggatttctaaactaaacaccactagcctgttttgtactccctccgtttcaaaatgtttgacaccgttgactttttagcacatgtttaaccgttcgtcttattaaaaaaaattgtgaaatatgtaaaactatatgtgtacatgaaagtatatttaacaatgaatcaaatgatatgaaaataataaataattacttaaattttttgaataagacaaatggtcaaatacgtaataaaaagttaacggtgtcaaacattttgaaacggagggagtagtacattagataaatgaagttgaatatcactgtatttatctactgtgggtaaagtacaggccaatggggaaactataataaacttttgaggggatgtcccctagttatatttgcatgccacttaaacaattatgaaaaaaattaaaaaaattgagaagatgtattaatatgtgatatatcacttcataaacatgcaactttaaattcaactcctacatatcgtaacaaaaaaaacaaattaaattataactagttaacgtatatttatagtcaaatttattcttttttcgttttgacatgtagaaattaaattttaaattgcatgtttgtagagtgatatatcatatgttaatacattttctgaatgtttttaaattttttaataactatttaagtgttaaataatatggaagtagagattttaaaatccactctccaggcaaacgctacaatgcagcccaacccaagatattcagagagattatctataatcatcttgcttagcgtgcaggttgtactaacagcggcacacatgtagagatgtatagtacgtagtataaacgcaacataacacaacctgtactgacaagaacagtactaaaataacactagctctgggatcaccacttgcttgttttgtacagtacacaaatgcagcgataataaactgttcgttagttcgtacagactagagggatcagtggggcgtgctgaaaaaactgtaggaaatatacaggtcaacgctgcaatgcccaacgagcaacgatacacatgcaagatgcatggtactgtacgaaaaatgcctccagactccagccaactgaagatggaattgttctggcagataagcagctgtgcaatgtgcatatataatgcgaatttccatattactcctcccatcccaaaatataaatatccaagtacttttggctttccatatgacatagtagaagtttgttcttaaaaaaaaaatctactaacagatcctttacaatgtataacatgttgatttcagccccccaaggtgttcatgtgccaaaacactgttgacaaggaaaatacatttatcgattaaaaaaagcatattaataaaaactggaatcacaacagagtagtacgttattaaatatttcgaaccatgcactggtaagctcatgcatgttttccatgattgagtaatataatggcgcatttggtcagccaaactagagttgagtttcagtataaaaaacaaatgtaatacctttgtaaatgaaacctcaagcccaaatcatcaaacattcacatctgccacctagcaaaaggtggttaagattaaatatttacaactttacatacatgtgtaatataatgtaaaaaggcactggtatagcagacatattacaagcccacaacgatacacacccagaatattgtctatactctattgctctgtatcaacaacatatgcaggggacaggaaacaacatacccagacacatgaggaacttagagctgttcgcatgcttaggtcatatatacctaaagaatgcttcaaatgaagtaatggaatttgtacgacaatttgtcaactttgaatgagtaagtggtaaatatatataaaaaacaggtcgtcttaggtactcgtgtattactgttgctgcacactcaagcttcaagaagtacaatctaaaggcttcttccatgccacaatccaatttaactcccttgacagcttttacgtggaaatgagtttttgcaaagcaagggaacatcatcagagccagagagctaacttttctcttcagggacgtgcatgccaaatccacgttttaacttctcaactctgatcattaaaatttgaaattgttagtgcctggttttaagaaatctgatcaaaacgtagttgctgataaaatttatgttactgagtctaagcgttgacacgggagtaatcattatgaatagaagaaactagtaacacaaaactctcgtaatttcatccaaaggaacgatatgatgagcttgcacaatatcatctgatgatttacttctacgtatacaatagactacaaacaatgaaaatactgaaacaaccacagcaagatgaaaatagctaaaagacaaggttatgcatagagcgctctattctttggagggcaaaagatccgatgcccgtaaattgtggacaatgaagcttggataggacataacgaccaatctagttagtacaaacaaaaccggaaatctaattaaagaaataagaccagacaggttggaagagttgtaactactatgcacgcaagctgaaagtattgatcatgtcatgctctagtgttctatagctaaggtggtgtttggatccaaagactaaactttagtccctgtcaaatcggatgtttggacattaatttggagtattaaacatagactatttacaaaactaattacataaatgagaactaattcgtgtgataaattttttaagtctaattaatccataattagcacatgtttactgtagcatcacataggctataatcatggattaattaggttcaatagagtcgtctcgcgaattagtccagggttatggaatggtttttgtcaatagtctacgtttaatacttctaattagtgtcaaatatccaatgtgacagggactaatccaaacaacccctaaatttcctctggcctgttatgtgagatgcattagcttggcctacatgtgcagagaggcagagactacagaggacttttcgtattctgtgattacagttgacgtgaaaagggaaaaaaaatcatgtacagtcgttggctgcttgttattgggtttttatatntagggtgtgtttagttcacgccaaaattggaagtttgattgaaattggaacaatgtgacggaaaagttggaagtttatgtgtgtagggaagttttgatgtgatggaaaagttggaagtttgaagaaaaagttgagaactaaaccaggccttactttgaaatgatatactcctattcaacaacaaattaactaattctttggcatagatgatacggtgcattggaggccatgatttcaaaacgtgggacacaagaacaacaggtgcaacatgaaaacacactgcaattgactgaattgcctggtattcatgtttgttgatgcctgatttttttttttgttaatctggcaacataaagatctggttgtctttagctttgtcagaagatgctgtgaacctgtgactacactagagctatttgactagggttgtttaacttgaaagatattgctgctagatcctgtccagcctagatcttctgtcccctggcacaacatctttatttatttaaaattttgcatttttctcatgcttttttcagttagtaagctcgggcttttcttctcttattggttatgttgtacagagttgtttcaccagtttggcatgtgttcaatgccttaccaatttaatacatcttaagccatgatctgaaccttctcctggctcttctattcttgttggatcacacactcaactcccaacttcaataattagtcagactctgttcattaggttgttctttaaaatgactagtgtaaggaggccaaaaggtgaaaatattgtgcaagaaatgaatggacactacgtgaccacaaaatactggaaatgctatttcacatggtgttgttcgaactgagctgaagaagaaacttacgtaggagcaagctttccaagctttcgtaattttttgccagttgtttcatcaatcacatttccattgatctcaacagaatatgattttccagatatccgtgggagacctcttcctgcaagcaattcaaagtctttctgatgaagttctctaccattgacaataactcctgtgttcccaccggcacaatttttcggcattggataattaaattcctttataaatggctgcaaaaacaaagctctgtcatgacgtgctaccacaaagttctagagaaagaactacgagaaaaataatcatcttacagggatgatgccactacactcatgtcccatgacaccccaaaatccagcgcggtagtcatacctgaatcacaattagagaatacggaatgttaccttacacggaaattcccaatgccttgtgaatttaagttggtgaagatccaacaaagttgctttggaaagtacattaggtagatgatattcccagagtaatttttactgtactaactttgcattttcctcgtctttgtatactaatcagattaattttaaaactgtagctggtaaaaggcagaccattgaattatggagcttgcatgtcgcaagcatgcagatgtgtgaaaataaattatagttcacactgtaccattacgattaacaataacagaacaaaactaatgttgcacatagttactgaatgccgagacaaagtaagaccgtgataataaattaacagatgttaatacatgaactaggccatgcaagaaattttttgagctactagcatttaatgggagcaatcaacagccaaaaaaaaaaaaaaaactctgcaggacaagaatcttccaggtatctcatcactgtacaaaatgttctagtaatcaactcagggaagtggttgatttggctgagaaaagttatcaaggaaatcaggtacataggttggttaatatgcaattgagaattacacagtcatttaatcaccgctgtgcagtataagtcatcttaattcctactgttaagatagattcttctgaagaataacaccaatctcttttgcctgtagttgtgcgtctcttgatttcaaaggcaaatgataaaaagatgctaaagaaaacaatgacaagtgccaacacggtagatatcaaacgctaagaacatcagtccataacaatttccaaatttatgaagggagaaggtgacttaccaatatgaaccagggccaactggaccagacttcttctcggccttccgtaggacacgttcggagattgaatggccattgattgaaaccttagcactgtccactgattgattgaacaaagaaatgtccttcaaacctttcttcaaaaaaccagcaaaaaactttgaatccccgttcttagtagctgcagactgaacttcgtctagttcagcctcagaagaaacacgagaactagaatttgtgcgctcattaactgatgactcaagcttcgatggcattatggcatgttcagaatttggggagagcaattcactataacaatcatctaagtcatcttgtttgcatatcgtagctatagtttcaacttgaatgacactgttattatcttctttgctgcatttgctatatcgctcagtaatgaattctgattgaaagttgttgtcatcttgtttgattttttcttcatactttttgctcacgtctccatcttcaaggctgctggtatcatcattatcagccgtcagcttgtctatgttacccatgcttccatcatcacaaaagccacttgtactttctttgagcttttgctcatgtctactgctgacagtttcttctccaaatccttctttatgatctttgctgttctgctcatatgtcacgtccgatctttcatccctaacattagcatcaacagaatctgccatgatatttaggctacattccttgcttgtgcgatctccaccactacaatcttttagacgactggaaaatggatcgacacatttgtcctctataactggggcctgtagattgcctgtattaaatgctgaagtttctacttgactgtatgcatctccttgacatagtatatcctttgggatatttgcaagtctggaccttctaacagatactgatagtaactgactgctcctgtttgatccacactctttgtctattctgtcataactagaagtagaagacacagaaatattgtctgcaagatccttgttctgctgccatctctcttgtgcttgcagcttatggaaactagaatttccttcatcctgatgttggtaccacccaaaacttttgttaacctgacgactggaactccccactgtttttgatgcagggaaagatgtcggcgcaaccaaaggatgaattttcacttccttaagcttgaaactaacgatctccgagcacgaaccacaccgaacttgaatctgcttccgagctgtgcatttcccaggaggcagctgcagcagctggttacaagaactgcatacaacgaaaggagcggcgcctctcacaggacgacagaaactctctgccttcttcctgaaaaactctgtcctcctcttcgacaccgagaaatgagagtacaatgacgaagcgacagacctccggtcaagctccgatgagactgatggggacctatcgaacaggtgagacccctgctggcctgcaaagtacctcgtcatgggaatgtgctcctcctgcatcacagctctctggccatgaaggcactgtgcacactggcaggtgctctgatggtgattccccccaagatacccagaattctcccactgcctctccggccattgccggaaccgcccactcggctgcctctcatacctatctctatgcatagaccgatgcagctggtcattcggactgtgcggaaagccagacccgtaccttcccgtgtagcgtgagcggtagtgctccggcccacggcctagcggcggcggctcggcgtgcgaggggcgcagcgaggccgtgcggcggctcatgcggtggcgctcccgcggctggtcggtgatctcgcaggacctggtgatgtggtcccgcagctcgtcgagcttccggagcagctccacggggttctccttgagcgcgccccaatccagcacgccactccggtcgccgccgcattgcccgtaatcgaagggctctggaaccctagcccttctcctgtacttcatctccttcgcctcgctccccatggcgcctcccacgggacgagctttccccccccccccccccccttcgccgaatcgaaaaccctgcggggaaaacttccaatgagtcgctcgaaattcgtagccaccaaacacgaaatgggaagacgccaatgtagatcagagcagcgaagcttctgaatgctacggagaagcggaggaggcggcggtggcggttacctcgaccccaatgttgcggagcacacggcggcggcggagactctacggcgcggggatgcggagaagccaccggcagcggctcgccgatagggctacgcggcgaggaggaggcggtgggacgtggggttcgccattgtggtggatggagtggcggccgcgcgctgcggcggcgagaggaagaagacgagtgggggtgaagtggaaaagagaagcctaaatcggcgggaatccagggactggtttgtaattatcaactttctagggggtttcggcgcgatgtagctttgggtttcagttggggatgacctggctgagacgctgacgaggtgggcccacgtgacagctggtctgatctggctttgactagaaaagagcccccctttcttaacgcgccattgcttgctttatgtcaaacacagtaacagcgtgattagtggctgtgctcaacaacattaatactccaactaaaagtaaccaaaaataataataataatcggcctgtctatctatatatctatctaggtgagtgaggctgcttgtgtatagtttgtttgtaattttaaaatcttttcttttcattagcattcgaaggttcatctcataatttggaacgcataacaaccacatgcttttcgcaaactatgcaggagttagcttgctaaatatcatcctaaggggagttgacagagatcaaataattcgattttaaatctacatgtgttgtacggcgcatttttgcgatataaatttgtgtatcagggggcagccccttgtaagagccgcaataaacagtggttagtgcacgttaacaaatgagctctcgtggacctcatttttttagtgaggtatatatctcatttcttcaacaatactacttgttcttctagctatagtaatatatgagagcatacagtgtgttataatccaagcaatcagtttgtcaacgacaaaccagacgaatatatggacctaaacatgtggcatgttcctgtttctttattagaattttgtcaggttatattccatcagcatttgatcaatatctgacacaagaggctgaacattcattacaggacgttttagccttcaaacacaggcggcattgacaagagcctgaaaaacatgcagtgctacgaaaatgagaaagttcagagagatccaaaactgtactacttgagtatttttttttcttctggcattgatctgtatatctattgagttttggagtacatacataatagttaaacctgaacttacatttttcagatgttgaaacctgaaccaaaattgtataattgggtatatcttcagacagggaactgtaatggctgttgggttctggagtacacaggatagttaagcctgaacttacatttattcagataatgaaacctgaacctgcatgattgtaaatgtttccaaactctaaatgcttgcatgctaattaaatgcaatctagctgtagctgcctaatgcaggatacaattaggcaagctatgtggacaatgaaggttgagattaattagcaaagtaatgaagggagtggggactgaagaaaggctgaaaagtggcgagtcatgtcatgggtgatgagaaaacagcgaagcaatgcacctaactctcgaggtcggaagtggccaaagaagatcgatcaccaaacaaactagttagggggcgccaaccaaccaccgtcaaccacagacactcggacagacagctccaaaagatgcagatgccagtgctgcacatttggccacatgaaagtcgcattcaatttgcttaattaaactagtaatttgcctgtcgaatagcccatgctacaccgacgaccgtcggtcctcttctagttttcagatgagtgtgtcctcttaacaggagaagatttgcagctttttcgtgctgaaaaaacggtacggacagtccggtttgtgcgctgtttgtatccaagaacatgacgaaattagttgaaaaaaaaagtggtatctgaatgaagaataaggatgtgtttgtttctgtccataacattaacattttcttgatctgaaaaaaaaacattagtattttctttcagacatatatgtattgtaagatattcatacgggaccaaatcaagtgtacatgcgattcagatttgtagcatctgtgaaacgactgctctgcaatcatattcgtttcagtgtctccttttctaactgtatccatatatgttcatgcgtgaccaaaattaaaaataaaaaccagacatgcattatatctgtttcactgtttgcctaacagcaaaacagttaggcaaacatcacatgggtagcccactgttagccttccgctgatgggctggaaagtcgaactgaattcacggcccaccccctgaggttggacggggccggaagcccgcgtgtggagatgggccaggccggttacttcctctgttccgagatcaccgcctccaagctcctcacagtcacagccacaagggaattgaagccgccgccgcctcctcgtccttccggccgtgtgctctcacgcagggcgcggcggcggcgatcttctgtgctagcgtggcggcatcgccgttgctttggaggtatgagctcctgtcctcctgtgcctcactttccccttcatatctcttggcttcttcaattttttcccgtgcaaccattcagaatttgtttttgcctaaacattcccatctgtcatagaactgctcctttttctttctttttctttttttggctcaattgctatgcagcgataggccgggcattttcaggactcaacctgggccgaacacgaaacctacaactgggctctgtctgcaggcctaatattacaaacttggaagaaaaaccacacaatttcggcggtgacacggcggcatacatacatcatcatcgatatgtctttaacgcagtggagaattatcacgggcgagcggcacatcaaccgatcaaattatcgatcttgacccatgccatgcaatggcgagcttcacatgtccaacaagcaaaagcagcgaagaaaaggcatccgacgatgcgaccacggagcagaatgctaacaacaacatagcagtatatgcatacggaaggagaaagaaagaaaagaagaaaagcagaggcgaggagcgcctcgcatgtgaaaaaaataactcaccggccgggagatggaatggatccctagctagcttggcggtcgaattcatcgtcctccatcgccgccgccggcagctggctcctctctccgctcccgtgcatgcatcccccatccctttttaattaaagccatctgtctagctagctcattcagaataatcctctttctttctcccatctttttagtttttagctagctttgcaacagctagagagcacagttcagttcagttcagaaattcatattcactgagattagcaaccatgcacacgtacgatgtgtgagcctcccctgcatgtgcccgtcgtgagttcatcaaagcttgatcgatccatcagctgtttcctctgatcgctgatggacaaagaggtagcatacacatgctgcttgttgagtttgaagcaaattaatcttcttctttgacatgcatgcatgttgagttttttttgttattttgtgtgtgttgtgctaattgtgttcaatgatcatgtatgtattcatgtaggtgcagcagagaagccacctggagagatttgcggcgctggacgaggcgccaccgccggcaccggaggagaccgtggtcaccggcggggagatggtggactacatgctgggacagccgccgccaacgacgcccgggccgcagagccaggtgtccttcgacaagctcaccttctccgacgtgctgcagttcgccgacttcggccccaagctcgcgctcaaccagccggcggcgtcggacaacggcggcggtggtggcgacgacggcgacgacgacgacgacagctacttcctcaggttccagtcgctgccgtccctccccgccgttccccctcctcgtggcggcgccgccgccgcgcatcaggtcgttgacgagcaggagggcagcaagcagacggtcgacgccggcggcgtgtccgagagcacgacgctggtgcagcaggctgacggcggcggcggccgtgcggagaaggccggtgagcaggggaagagcgggcggcggaagcgtccccggacggtcaagacgagcgaggaggtggagagccagcggatgacgcacatcgccgtcgagcgcaaccgccgccgccagatgaacgagtaccttcgagtcctccgctcactcatgcccggctcctacgtccaaagggtaacctatatcgctcggcgtcgccatggcatttgatttgatttgcacaagtaagaacacacatgatgatctgaatctgatcgatctttctcgcatgcatttaatttagggagaccaagcatccatcataggtggtgcaatagagttcatacgagagctggagcagctgatccagtgcctggagtcgcagaagcggcggcgcctgtacggcggcgacgcgccagcgccacctgcacggccggtcgccgacggagcagttctgccggcgcccatgcagcagccgccgccggcgacgccgccgttcttccccccgagcatcccgttccccgcgtcgtccggcgccggtgacggtacaggcgccggcgtggccaaggtcgcactggacctcgacgcgagcggcggcggcgaggtgggcggcggggtccgggaggagatggcggagaacaagtcgtgcgtcgcggacatagaggtgagggtggtgggcgtggacgccatgatcaagatcctgtcgcggcggcggccggggcagctgatcaagacggtggcggcactggaggagatgcacatgtccatcctgcacaccaacatcaccaccatcgatcagaccgtcctctactccttcaacgtcaaggtatatataaaaatcaattactattacactctacaatactatcgaattatcatctgaacaaacgaagaactgttacattaatttgctacgcgcgcgcgacagatcgccggcgacgcaagattctcggcggaggacatcgccggtgccgtccaccagatccttagcttcatcgacgtcaactacacgttatgaaatctctctcttcttcaagattgtgaaaaagggggtatatatatatatatgtatatgtatatgtatatatatatatatatatatatatatgtatatgtatatatatatatgtatatgtatatatatatatgtatatatgtatatatgtatatatatatatatgtatatatgtatatatatatgtatatatgtatatatatatatatatatatatatatatatatatatatatatatatatatagatatagacacacacacacactatatttgtgcccagcgagtgggtgtgcttagcttatgtgtgtagactgataactaagtatatgcaatcaacttatttactatatatctgcactgcattatatatatgctggtgttcagtgttcaatgatagtatgtagatcgagatgtacccttaattaattaactataggagttacctaattgaacaagattatttgtaagcttggatgctgcttctgtgtttgtatggggctacagaaataaaatttccattgctctctttagtagtgaatacaatgtcatatatctgattaatgacgccatatatctgattaatgacaatacattagctaagtgtaatattatggagcactagcactgttcggtgatgtagaaaggctagctgtgttaactgttaactcctaaattaactggttgatggattttcatcattcgaggatatatatatatatctgtttgttttgtgcatgtcacttaaaaaattatcaaaaaattgaaaaaatattttgacaagataaatcaatatatatgagatatatcaatccacaaatatgtaagtttaaattcaacctatataattagaaaaaaaaatgattacaaatagtgtgtaatattcgcaatcaggtcttagcatacaatgttggtacatatggaaacagttataaaccatacaatgttagatatactagaaaaaaatacctgtgcgtgcaacgggtgaaggctattttaatcttattattgttatatagtatagttaagataaaattcactgcattaaattcgcttagatatatattttgttagaaaatcatgagctgcaattagaagtccgatcgtcttaaattagcatgcgagttttttaaagagatttcttatacgattctttctgtatttctaaaagcgaacgaacttaaaaaccgactcaaatatggatttgtatttgcaaaagcgaacaaatttaaaaactgactcatacacggatgacgtaccaagtatcggaaaaaacaacttcaattcttataatagtagagatttaccttcacttaaagatatagttcagggaaccagagaatgcaaccagcaacacagaatcaacaacacaccagcagtagaattaacgaactaactcccaactaggtcgtcccattagcgtgggaaggaggagggaggttacgaccgagagagctgagccggggaggaaggaggtggatttttgactagctagaacatgattaacacagttctgttcgcgatggatttttgaaactaccatctccctgttaccagacatgaggtgcttgatcgatttgggagagaaattcgaacacgaaaattggaaactccgatcgacattattctgaaactggatccatctataagtgtaagagcaattttatagttcttgaaaagatatcatgaggtatcattttttttattgtaaatttgatatacctcttggtacctattaggagtactaaattttttatgaggatttttattgtgcatggaaggtaacgtaacttttcccatgatggatatctactgttgatttatagaagggtaaatgaggaaaaacagaaaaagaataacacagacatgtacaatttagtaattcttagccaataatcttttctaacttctctcattaccattatttgttgctcacccatttgattacttcatgtcgatctgccgcttataatcgctatgtctcattgatagatgttccggcgtaaaaaaatcctaaaactaaatcttttcttccctccctgacactaatcgctatgtcttcatgatagttttttattagagcatactctgttattatcttcattcaatccacaaagacaaggacatgtagaattcaatcatatacccttacaagatatttcaccaatacgaactatgaggagttgcataatatttttttaattttgtatttggtgtacataattacttggataaaagttttagtttattttacgaagtccatgtaagattaataatatataagtataatattcactaagtaatctcgattacctatttgaactaattgcctattttcatgcgtagttagttaccgagcttatcttcctagcttgtttgaaataatcagggccttttaatttggagatttgctctggtctaaaaaaataccttgggataccgatacatcacggtatcaaattgttttcgatcgttggattttaaaatctttaatctgggtctggatctcagatcaagttgttaatctgttgcagtaagcaagatgttggtgagaccctgcgtcagaagcatctcaaaggtgcagacatatctttttccttgtgttatttatggtcaagccagaaacaaaagacttcatgcagaggccaaggatggcctcggttgaattatatcatcttgatgtaattgattgagtcttaataaagcttccattattttaaaaaaagaaacaaaagactgcaattatatgatcttaagagcgatccatcaatgtttctgatgattcacttttcctatgtccgtatgtcatctttcacacacttgttagctgaatgattagagattgatatcactgaattcttccgtatctaacatacaaaagaactgaaccatatgatgtttagatgagagtctgaataatactttgcagcacttgttacgggaaacaccacattttctttcctgataacatcaccatactttcactagagctgggccatttacatagattctagatagtcacaaacaggataagaaaatagattattcaagagactaaaccaaacgttttcttccggtggagactacagtaaagctgaaaa

SEQ ID NO: 61842 - DNA, 690 bp, Oryza sativa
ttctctccttccaggaactttgatgcctcctcaacagccaactggaggtctttctcggtgttcttgtcgatgttgatgctcagcactaggcttctgcgacagatgaattgagctcaggtgtggagttgtggaagcgtgctatcttcacgacatctcctagcctgtaccgatatagacctagaacaaaatagaaaaaagaaaaagattttagtgtttcttaaacatcaccgtaataagtaaactttctgtgtcctaaaacaaaataattgtatgttagccagagatattaaagaataaaaatgttattggtgagtctggcatggttggcatacacaaaaagaaacatatatcatctgatagagttttaagataatcataatgagtaagcagcaaagagttcaaggagtggaccacaaacattcacaataattactcccccatgtgcttaataatattgatgtatacattgcaaccgtgtgatttttatgttttttacataataaggagctcttgtcaaaaagaggtttaagattgaaggggcaagactaataaatatttcttttttgaaataatatgtcacacaaacttatctagttatttctgataaatcccgttggtatcatgtctgaccagataacagcaccagaagcagaactagggatggctgccccttgctttttgtagaatttt

SEQ ID NO: 61843 - DNA, 9960 bp, Oryza sativa
aaagaaatttgtataatttaacaacatgtaaattatatattatgaaaaaaaatatggtgagtctgaaatcatatataattgtacggatttacatgatggttaaagatataaatttgtgacttgaaaaaagaaagataagtaatttaaacagaatgagacagtactactcatccgtcgtgagtaggaaaagtatattactgtcggcaagaactcgaatttctagttacccatccgtcgttggtaggaaaagtcaaaccgacatcactgatgcccatcatgcagatatggtggcctaagctatttactattaatttcaccttttacgtacaaacagtacactaagggtgtgtttaaagagaaggggattaggtagatcgaaaagatacacaaaacgagccattagcacataattaattaagtattaactattttaaactttaaaaatggattaatatgattttttaaagcaacttttctatagaatttttttataaaaaacacaccgtagtttggaaagcgtccgcgcggaaaataaaatatttttctctctcaatcccctggatcgcccaggaacgaacgaagcctaaacaaactagtagcagtaattaacaatgccatcaacagctgacttaacctctcttatcaacactgaacagttgttttctgctggtctttcgatcacttgcagtatactacaacatcggccatttatttgcatctctcatttttaggataagagagagatttagcaattttctgttggtcttttaatcacttacagtacaaacatcggccatttatttgcatctctcattttctgagataagagagagattagcaagctggtttggttgggttggttggttggatcagattgatcatgtgttgatgagaagaacatgcagtacacctacgtggcaatcagacggagccacgagctgaggcggcggcggtccgaccggccggccggccgccggcggcgtgcatgcacgcacgcgcacgagtaattgggcggcgccgctccgcgtcggcggctggcccggcttgtcgtccccggccacgcggctgtcggtggcctgcactgcacccagcaaaaccagtgtttgagcatgttcggcacattttttatactccctccatattcatattcaaatgtatgacgccattgatcttttttatcaatgtttaaccattcgtcttattgaattttttttacaaatataaaaatatttatgtcatgcttaaaaaacgaatactgattaaaaagttgatcagtatccgttgatcaaaaagttaacggtgtcatacatttaaatacggagagagtattattttaaggaaaatactatacgacgatatttgtttggacgggatgatacctcaaaaatattacatgctaattggtacgtatcggttgatacctcattcggacgggatgatccctctgagtatatacctcttaggtatcattgcgtccgaatgggaataccgtcatgtagcatcctccttattttaaaacacggtacaaacgcttacgacgcacgtgcactcatccctatatttggtacagtttgaattcgaggttttaaacctacaggtatctcttctaaatccataaatcaatgaatgcatatttgtgagaccataattacatcgataacatttgataaataattttgtttctattttaaaaatatataaaaactttagaaccctagataacttacaaacactaaaattttctccaaaattcagcatgtatgagtgatctggagcattgccaacaggtacttggaacatgttaaactctaagctcctgtgtttcgatttcatactacttgatttgccactactatccgtataaaaactggccagactttcacaaactcagcattccaattgcattgacagcccttgattcaagaggagaaaaaaacaaaggtcattttccaaaaccagtacaccaacgagggcaatatcggaacaaaactgttagtactgtacttatggagccacatcatatttactaacgaaaattaatttgtaaataaaaattttatatatgttcttagcaatataaaagcaaagactaaaaaataaatttcgatgaaaaaacattaaaatcagctttaaattgaaaattcacattattggcctgtgctcccgtggacggggagacacgccacccacgggatcggacacagcagcgttcgcgtccatacgtagaagcaactgacgggtggggcccagcacgcgcgctgaccagagaggcaagcggggcccaccacgctggagccaccctgtccgcgccagctggcatggccatcaatgcgacaggtcagcacggggggctgtacacgcggcaggtcctcgtgctttggagcctgaccagtgaccaccactctgctacagctcagctgcactactggtccccatgcacgcgttgaacttgccggccaatcgggattcagaagatcggttcgagtccttggagaaaaaaaaagagataatatttttagataaaatttgagcaaaaatttcatactcctacttatttatctgtgtggtacaatctatttgaaaattgtgtacgttgatataccgatgaatgattgtttagtgtgggagtgtttgtttgagatgaacagagatacgctttctgagctttctgtgtttgtttggatgtgttatgatttgagcttttaaaaattgttttatatatgaatttcctaaaatattgttcaaagtctatttttaaagtttacaatgtataattatttcgtttgtaccttcaaataaccatcacaaattatccagttattcagagacgaaacataacacacaccctttaatttggtaagagattttttttccttacacatagtatatacacgcacgcatgcatatcactatatacacaacaccacacttacacaccgcgaatgcgctttctaatacatatactcaaagagacaaaaaccaataactcatctttgatcttattaaaatcatgttgaaagcttgaatgcatacacataaatatttatgaagatcattatttaaaactgtataaagagaattattagtagtatatatatcaattataactacctgaagcatctcgagcaaatctagccgatctcatgtaccactaattaattagcacggttctgttatgagccccttttgtctcaccaaacttaaacaccttgctaaccatctctgtgatacccacatgcccctgcgagattcttgcgatatcagaggcagaatggaattatatctggagattaatcagactgatctcaagcttaattagtaccgaccatatgcatcgatcatgggatttcaggatttcaggtttaggttagccaagcatccacatgcatcgccaccgacagcaattagtagggctcggagaaaggggaacaggcggtcgaaataaatcaataaataattaaacaaaaaactaccaattaatcctgcatgctttcacgacaatctggtgtaaccgaaatggagattaggctagatcgatcgatcatctcactgcatgtgcacgcacttagaatatcgttgcgagccaaaagaagtcacagataatcagggttaaagatcagttgattaaattcagtttcattttgggcgactttgtccgtcgatccatctcattatttttttgccaaggcgaattcattgatctcaacatataccactcatctctcatatgtgcgcgtatatataattgtagacttgtgtgttttcttaaaggtaactatttatgtttgtgtatataattacctgcataaaagttcatttgtagagaagtttgagagatcagaaagttaattgaattacgaatttaaacacatcataatgttgtgtagaggtctcataaaaccctgaaacacgccttaattaatgatgataaggagtgtgcacgcaatgcatccctaattaagtccacgtgcattcggaccaggagcagcctgcaatcctgcatgcctatgagacatagtatgatgcagctgcttaattcctagcttaattagcttcgtcgattacgcgttagagtagccagctttgccattttgatctatcgatacatgcatatcaccatatctcttggattaatacacacagctgaacactaatcactcacaacgcgttcacaaaattaagctcctcaccagctcgaaatggagattggacctaaccaattcatgaaccccatcgatccatcgatagatcactgtctttaatcaatcacttatccgtgatcattaatccaatcgaactgaaaacctaagctagctacgagagctgcaaaggatagagcgaggtagctaatgatcatcaccagctagctgggcctaaatttccggccagccaagcttgaatcctcttaacctttttaggtttggtcaatctaattaattcgttgtacctctaatatcattttgtgaggtggaatagatatgatcagttgggaaacgattaaatgaaaatgactaattataaatactacgacctgcctgcagctagcaatctaactaagtattggttgtactcgtacgtgtacagctcgatccttaattactcgctgacgtggcacaactagaacacatacatcgtactaattactaatccacaaacaaacagtgtcttaataattaatttgtttgtttatgcgtgttcttgacgggatgaaagcgattactgatgatgatgatgataaagctctagcttctcggtcaaaccgaactttatgcgtgtcaacttcaaccgtgcgagattagattaattgattaattatcatttttttggggctgattaagctgtccacgtcacacatgaaaaccggagatgctacgaaacgggtgaaaaaaattggcagctagctcacacatcacactcctagctagatagctatactgatcaaagaatggactagctagctcatgcaaccagtgtcggcttcggaattattctaagatgcattatattttttaatatgtttcccagctttatgtttcttttttcacgaacacgcaaaaggattgcacgttaatatattagaagaaaaagagttttagttacacaccgcaatcagccagactagcttatactaggggaaggaagaaaaagcaaaagaagaaaaaactgaagcttagagaaactacggcggctaaaaacagacttcaagcagcgggaaggggctaagccacgctagacttccaacaaatccccaaaagcggcgacgccagctaaagactatagatagccctccacatggatggactccagaaccactgggaccgaagagagagcgtagtcgaaaacctagagttccgctccttccacagacaccaagagaccaggagctccagggagtcgaagctgtcgcagaggtgctcaggtaagcaggccctggaggacggccaccagtcctggaaccaactgccacggggtgaagagagggcagaccagccagaaggcggcaacactcggagccagacctgccgagcaacgaggaggatgtggttcgccgtctcaagatcctgagcgcaaaaagggcaagccgagtaactatcgatgccacacttctagaggagatcagccatcccgcagcgctgcccagctttgtgtttcgtggaaaatgaataattctatataaaattttcttaaaatacttttctaaaacaaactttcaactttttaatagttgatactctcaaatagctatggttagcgatggtcaagatgaattaatcattttctcccagattttgggcaatgtgcagtagtgcgtgttcatctgatcatctcctctgaatagtcactagctagtagctaatcagtgctctgttcgtactgcttgctttgcatggcgcacactaataaacagatagagcaattcaatattttttcaatccactttcatctgaattccccggcatttctggtccttttcttcatccctggtgcctgacagtttttctctgagacgatgttgcagttaattttgaagcagccgagctttaattactggcagagaaaattgtcgatggtgattaagttcgagcagatgattgtctcgcagagagaggggccggcagggaggagtaaattgttcggcgccatgtcgtctgatgaatgaagtggtggagtactgtcaaattgtcaatgcacacctgcataatatcgcccggtatcccagctgacaggtacatctgattttaatttcatgcagatgcaatgttgcaacttactacaactctctgaattcagttcatctgatttaatttcttctccattcttgatggtactagcttagtttaattctgatccattcttgtagtctctgtcagggaactgtagaattagtggttaatttagcatgcatgttgggactaaataaatggtaaaaatcagatttttgataggaactcatacttactataaaatggagtcttctgcttgagcttaagatgaaactagcatagacctgccaaaatgtagaagaactcctatagtatacttatatattagtccaaactttagtttcatgtcatgtatcaccagaagaaaatggagcaagctgggattgtgcatgcaaaaaacacaagtttcggcagcaacctataaacaaagacagacacacacacagtgatatatttcagtcctctctctctcactcactgcacaacacactggccaaacaaagtgacctagcagtactaattaattaaaacaacaacaactactgctcctacttagtactgctaaccataactatatctacactaatgacagtgtttgtgtgcttgcttggggggcataaaactaaggggagataccaaaccatcatgtggttcttccccctttggtcaagatcaagaggccattgagaattcgcaatggttgcctcgcatgtgaggtgcatatggcgatgttccctcctccctgcatcggtctcggtctccacacagaaattttaatggcgaggtgaggtgagagggtgaggttgatgcctccaggctccaaggtgcagagcatgtgggacaaggacaagagccacacggacactgtgccatgctgaatttcctgaatgtatctgaatttttctgaatctctctgaatttcttgaatgtctgaatttctgaatgttgcatttgccctggtttggctgcaagaacaagcagaggccggggcctgggcatgtgtggttgtgcgtattaacgcctggatatgctgctgtgttgttggtttcatgcattgagatttggagagggctgcagccaggacaggcctgattactcatgctgctgcttcagatcagtcttctggttgtggttggtttgctactggcagtaacattttgttgatgacctatttttgtgggtctttgagaaaacattttgttaatagcattttttaagaaaacttttaaaatttgttgtcgatttcgagaatgtagccattgttaattttgctatcatgactactagaattcatccaggaagaactgagatatttagttgacgaacaggtgggagtagcaaggtagtatctttattttgtccaatgtcattagataatgcacatggcactcgaccggaggcaatgctattttgttactattgtttctatcttgtcaataaacaatactcacatgacattcattattgttgttgacttctttagaataaatgtgtcaaccaatggccgaaagacgagagagattatcacttggatggatcatggatggactaggtgagtcgtactacccccttaccttctcttctggtctcaaagattaagaaaaggaggccatcaagcttaccaactaacgaacgaaaagtagcattaatactgccacgtggaagaatgccattccttgaaacaaggccatttttgtttgagtaaattttataaaactacatgtattttgatcaaactatcgtaaagctacatatttaaggcgttgtatcactaaactacagatttagcaccatatttatcataaaactatacattcaaggttaagtatcacaaaactacatatttaatattgaagttatcacaaaaatatagcttctagagtttaaatctctagcaccattattatactggagctataaatattattgttttatgactaaattgtttctaaacccatagttttgtgacaatttagttactaaacatgtagttttataacacttcatcttaaatgtgtaattttgtgataaatttggagtaaaaaatgtagttttgtaatgtaccgagttaaatctgtagttttgtaatagtttgaccatagtacctacagttttgtgaaatttactctttattttccagtaagaaaataaacatagagcgttggacagtaccggctaagaaatgggccgtacaaacaagggcaatgcatcattctgacttccaaagcaggcctaaccttgtatcatgggcatattgcagctttgtgttcaccaaaagcattcagtcccaaaacaatcgcacaggaatggaaccggaataatcaaatatcagaagcatttagtaagtgtatctcaagccagaaccgacgaggaatcccagatatgcgacatatatacatggttacattctactaataaccctttcaatgtctaaatagccaccatacaagtccatacgtaagccccccggtccttccccggctctacctcacttcgctccaggcatttgacaactgaaggatgttcaaatacgaattccacacattctatatgcccggtgcagccaaaatgacatctccaagaaccaaaatatgtatggttcagtggaataactgctcagcgcatattccttcttgttgatctatcatcactgattaagcatcactgattaagcttctattacagctgccagttcctcctcggaggatgtttcagtggcgagactctcttcaggcagatcactcaggaaatcaccttcatcctcctgctttttaggtgcttgagtttccatcaatttccttaaattcgtctccagttcttttgcgatactttcattttcgttgaggtaagatttaagggcatctttaccacgatatgactcttcgttgaaagaataaaatgcaccacccaactttttgacaagcttgtgctttaatccaagttcaataagctctgaactgcggcatatccctttaccaaattccagctcaaactgtgctgtcttgaacggtggggcatgcttgtttttcacaatcttcacaagcacttgactacctatagtctgcaaacagaagtaaaaattgtcagtaacatttcaagaagcactacaatatgttgaagctaaatctgtaaggttactaggtctgtaattttgattgatgaggttataaaatcatatggctaaatacaaagcatgcatgtgccacgtgtctaacagtgttttggagatgctatccaaatagatatgacgcaggagtgaaaaactaggttccaaagaaaccttgatatgggcatagcagtgcatatatgtcaagtattgactaactgtctaaataaggtaaatgtcaaggatatgacttggttaattacctcttcgcctttctttaccaaaccaatacgcttgatgttcattctaacggaagcatagaatttaagggcatttccaccagaagtaacctccattggacctccaaatcctccaaatgtggtcactttagacctgatctataacacatacaaaggatgcaaataatataaaactgagagaaatgaagcgaatagactgcattgattagtggggtacaaagtatttaatttttttctgggacaggttgaatataagtctatagtaatgatgggacagaatgtattgaacgagtgttcaaatgatcactctgtgagaactcatgatcgacgaacaagattcaagtagaatcagttgcatcactgtaaacaa

SEQ ID NO: 61844 - DNA, 640 bp, Oryza sativa
  unsure (1)..(640): unsure at all n locations
ctacctttgttttcggtttatgcctcctggttggctgggtacgtttgggtaggagattttgcttgccagactcggttaattactgagacacctcctgcccgctgcacatgatttttttggttggatgcggcagatttggcggcactgaggagctccgcggtgtgcaggcacgcgtcgccgcgggcgtcgtggtgcgcagagaaggagaacagtgggcagcgtgacgcggcggcgaggacgacggcgcccaagcccgctcgtcccgcgggcgccgcgaagaacttcatggcgccgacgatcttcgccgccgccgacacgtngtcggccgccggaccttctcttcggcctcaccccgtcggtctcctccgggatggccggggacgagaggcggagcacagcgcaaagtgagaggccgagggaggtgcgcgttcatgacagcgcggcgaggtcgaagttggtctcgtagacggaggtcgccaggcttggccccgccaggcccgacggcgcgtaacggaagcacgcccgcattgccgtttcgcccgcggcagncttcttacttgaaaagagaaagagggagagagggaaaaagagaggagaagaaaaccaacgtgccgctgatcacatgtggggcccacgtgtt

SEQ ID NO: 61845 - DNA, 661 bp, Oryza sativa
tgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttgcctcccagagatggcacgttagtcatctggtcagatatatgccaggcttcatcctaaccattacaggcaagatgttgtgtgaagaagggcgagcatgtagaatgctaagctgacacgtggtggacaagaatgaccgacgtgactggtctgataccggtcatgtcgtcagcagacagccacgattccacgtcgcaccagctcccggcgaaagtggaggtagttgtgagccgtctcatcagatggtgactcggacgacaactatacaaatctccgtccatttatgaaaaggtggggtaagtccccacaaaaaagagagaaatggtgcatgtggtatccccttaagatataaaaggaggaccttgcccacttagatgggggactggacttttccagattagaaacccaaaacaagggagaggctggctgatactttgtagctccttcatacacagatctcccaaaacacaggagtagggtattacgcttctcagcggcccgaacctgtatacat

SEQ ID NO: 61846 - DNA, 978 bp, Oryza sativa
tattaatagaaaaagatataaaaaatttactcatgtaaatttgatgtcactagttttatcatttacccaacctctcataataggcatttctttttattaaaaaatctttttttaaataaatattgtgggtcaaagtatcatctcaagactgtgtcagagtctaaaaatacttatatttgggactgatggagtaattttttcagtgaaaaactaaggcaaatcacgcgttgctacgggagcaatgcaagtgggcgtttggtttttgtgaaattagggtggccgagtcagtaagtccccacctgctccaagcaaactaattaagctgattttagctaaactactaggaggccatccaggtcttcctagtctacaattcatgtcgctctctcaaaggccgtagagatatacatcgatacattatacatgcgtgttttcagtagtgaagcagtgctgtgcatgcatgactccgccgctaaagtcaatgggggcgattaaggtaattaactaaccgggttaattttattcgttagattattggatagtttactagtaattgtgtgtataaaaaggaggttctctccctctctctgcagaatgctgtgttaggcaaggtagagtacactagtcccaaggctcgctctcttgcttaagcttgtgagcttggaaaagagtagtatattgagctgttgcttcgcttgctttagtttgcttgcttaccaggagaaagatatgagggtatgtatgtgtaattgtatatggtcttgctgctcatctgtcaatttttctctgtttcatcatcagtgaaaaatctgttattttgtgcaaagatgtaagatttatgtttgttcccgctgctaatcgttacaccgtttgaaaccttttgcagaaggaaattgtcatcaggctgcagagctctgagaagggccacaagaaagctatcaaggttgctgaaaaagtctccggtaaaaattccttgca

SEQ ID NO: 61847 - DNA, 7524 bp, Oryza sativa
ttactggatgagatggagtcttgaacttggcactcaagtataactcccggttgatgacaggtgacttctcgtccagttctctcactgacaatggagagcggaaccttctctgctttccagatgatgagcttctgatctgcaaatggaacaaggtagacatatgttcaaattagtaatcttttgtatactgtaatgtaacttgcaagaaactgcttctagtatgtggtacctcgcttgtacaagtgtctacactggaatcctgaccagcttcaggtttcgaggacaaggtggtggttagaggtgacctcgttcttgcatttctcttttcagaggccacacggttcgcgatatctcttagctttgatgcttcacgttccttgtcgtctaatgccaatttcaatttagaaatctgatagacaattacacaccatgagttacagaaacaaagttccgatgatgatcgtgtaacatttaaaacaacacaatatcatacctcttccttcagatctttgacctgcccaacttccttattagcatgagctgcaccaagttctacggtggctacacgctctgcaaacttgagggtactcattgtttcaccaaaagcatctgcttcaggattcatgtggacaaacatcaatgtcttcgcctgaccacctacatcacaagacaagaaaacataatcagctggcattcttgatgaaacacatccaggctcttaagagattctgtatacctaaggcatcttgtagcacttgtgttagcttgctatttcggtatgggacgtgggagctcttttgggcaagtgcagctataacatcaccaagtgcggacagtgatttgtttatatgttttgcttcgtttaatctttctccagcggcctcggacttatccacccgttcacttcccgcaagatccacaagatgaaggcatcctcttagagttgaccccgaagctatctccttgccttgaacatgaactgtcaacacactacagaagagcaacaaaattacagtatgtagtgagtatgcctgttgctcagacgatgaaagaaaaatattatgcaaagatattatactagggagaagggacattctgagaggaagtcgttttttgcattagttttgggatacctgtgtgagcgactacttcgttcattaagagcagtagacccaactgccctgttcctgtggccaactctcatcaaatccaaaacgtcctgtgcacacttcactggaactaaatttgcatctgggatgttcagtccatttacatgagaactgtttcgtatctctaatgtgttcatggttaagaacaaccccggaaggaaatattgttaaacaattttttgatgctgagagcaataaaagataatttatttcatgtgaaaacatatagaagatttttgcaagtaacttcatagaggaaacatcttatttgaaacaatgttttcaatcggcaacttgagaaaaaataacttttgcaaccaaaaggatatcttttgtttgcaccatcaaccatcaatagatctctcacttgctcattgtatatttcgatcatctgaactttcacatcatatgtggtagtatctgctctattttgcgaaatagcaaatagatcattaagtgaccggtagttcacgccccaggtttcctctgttgtaatatctggaccgctctgagtaatatatgcaacaaagatatgttacaacatcataaagaaagaaaaatacaaatagattgaagcttaatgcagacaagtagcatacaaaagagcatctgtttttattattgttcctagcagtaaatttctttattttttttatagtattggattcattgatttgagaatttttcacaaaagtaattattgaaactttagtacatttacttgcaaagaattaccatggtatatgtttttccagatcctgtttgaccgtatgcaaatatgcatacattgtacccatccatcacagatctgatcaatggctgtgtatcagcaaaaacctcagctgttacaaagaaaaaaaaaagtcaaactataactctcaaaataaatatcagccagccctccaaaatatgcaccattcttttcttatgaaaccgtatgcaatttttatcatgcattactcaactaaatagtcatattttcaatgaactgtttaacttttgggataaatgcataactatcttgtaagtcatcactcaattagaaactacaagatggaatgcaattaatttgcagtaaatgagaaatgaaaaaaaatgagaaatgtcgatgatgtacattgtgaagcattaggcccgaatattttgttgaatgagaacatcttccgcccttcctttccttgcttttgagggttcacaatcattatctcaccattctccccaatatgatcaacggtagatctttgatcagtttgcattttcaggaaaggtttcactctacaatatacacgaatgctacctaaaagatgtttcaatttatcagtacaaatatctcactgttagtgaaatgaagttaatttattcgcatattacctttaagatcttgaacttgattgtacagcttacgattttcctcgagtaacttgtggtaagcattgtgattatgagcctcaaaataactttctgcaatattaagcaaatgtttagcgatcaaaggacaaaatgttctaaaacatttctgaatccattactcacctagcctcctcaagtcttcctcccactgagatcgagttgattcaacttgaagcttcatctcgttgaaagacacttttagcttctgcacatttcaaatttgaacagaataatcatagtcagtacaagtacacagtaatacttgttaaaagtattaccaacgtcttcatgagaggagtgtcaaaagtgttattttggttcattgtttcgttaatacttgttagagaaaggttcctgacaagaaaagcatacaattgctagttgttacaaaacacaacatgcggactgacagtgatgtcatatagtctatgctataatgaaataataatattgttgggctttctgtagacattccaagaaataacctcaacagcataattcttgaacagaactttctacctccagctcttcttgttggtgttcaagtcctcctccatcatccaattgtttgcggcgaccacaaggtaatcgcagtgaggttaagaaacactcactagtctccttcatagacttcgaaataacttcaatcaattcctgtttggagtgagcaccattttcatctttcatcatcttccttagaagtgatctgacctgttacatatgatatgtttagaaataagttccataggaatacacagccagcacaaaactgaatcatagaacaaaattgatcaataatcatgacatagttattagtttttgcaattgcttgcggcggggctaccattgaaaattgaacaaaataccctattaggtaattcacaaacaatgaagtacctggtttcgatgggaagcaagcagaatggtgaattctttacaggcttgttcaagtattgtttcaaggacctgaaaaaaaaaatcaccagcgtgaggaatttaacacatttttttttcttttgtgtcaaggctcagcttgtttggtgagagcaccactaaagaaatcaggtggtcagcgaatattatacaataataagtagaacttacctaccatatcatctaagggcaagccctcagcttcaccccattcctgaaggaatgcccgcacaactcgaagcacaaattgctggaaaagtgaatgctgagattctccaactctagattcctcaagggagacttcagacagaaggtgcacaaattccagcatttgttggttcagatcagctgaacctcctcccctggatgaatatgaaggcaacctcttacttgaggatgcaattttcacaatgccaccatagcgccatatgccaatcccaccagagagcttccattcgtggtatgctttgaggcaaagtatgcaatcgacaactttcattgatgaacctccctgcaagtgttcatttatagttcagatttcagaagtttaagaaagtgaacagtaagatcggcataagcttaaaatatataatcaaccatctactttgttctagcaaatttctctgggtttaaagttgccatattttctttatccatgcaatctctcatgaaaataaacttgagtgcgttctgaaattctgtgttagtgaactaaacatcagttctcaatatcacagtttccaaatgaagaactttggcctgctttttggcaaaatgggtgatgaaatacagttctaaataagccatgcaatttagctaaccaggttagtcataatggcagtacagaattgtcatcatttagtaaggttgaccagtccagagttgaagaaatactcctacaagaccgtaccttctctatgtcggaagcttcaaacgtcaagagattcatctcgctaactgcaacaaggaagttcctcatgttctcgaaatactgaatcgcagactgggccgccacatcagacgactgcaccgcaacaatgggattctccacgacctgtccgcaaacgagcactcgttagattccaactctaccacggatacggtgcaaatttcaaaaaaaaaaatgacttccaatccgatcgattttttgtttgggtcttgaactcttaagcaacgcaccttggggacggcgcccgggttgacgtggttgaggacgttgcagaggacgagcccgttgcgcagcgccacgcagaactcctcctccgacggcctctccggcagggactccgccgccgccgcctccatctgccgcagccatcgcgccgcctcgcacctccgcgcggctgcggcaacagatcacaacagagtcagcggaaagccacatcggcaacaggggcagtttgcctcgcgattcgtgcagaagatgaacatggtctctccccccgtgatgcagatttactttttgaattctgagtcaatcggaaacagaagaggcggagattttggggatcctgaattcgagctgcatttctttttccaccatgctttgcgcgattaccaaatgaccaaatgcaactcctgattattgattaaaccgacgagaatgtcgcgtgtactactaaatgcatctcaaagttaacttcaaccaaacgcaaaccacccaggtcaatgctcaatgcttcaaccacactcatggcgcatgcaagagtcttaccatatgcaggagccttaattgcaacaagtagcgcactaaacaaatcacaccaatgatctcaacccaaatctcgcacgctgccaccgcgcatccgccgacgcggcacgcgcgccggagagcaggcagcacagtacaccaggtgaggtgaccgcccgcgccgccgcgtctcgcctcaaacgccatccaatgatccagacgccagcacacacacacacacacacgcacagcacgagcgcattgcaaggcgcagatcgcgcgagcgagaaaaatgccacacccgagagacggggagagggagaagagacgaacagctgctcaccggattcctcggccttgcgcagcgccatcccctgatcgtgcctcccgccctccgccgccgccgccatcgccgccgcgactcccgagcgagctcgccgacgtcaccgcctacccactcagatcgcacgcagctctgcttcccttctctctccgtgtggctgctgcgcaagcgcaacggctccctctatttgaaaaacttccggggcccgaggaagacggtgtggccgtgggccacgcggcatccacgaggcaaagcttttcaagtttcaccccccgaactcgtaggagtaatattttgaaacttcagggggcaagccgcgaagttgaccgagctgcatcgagcgcggaaagataggcagaggtgcacgcgtccatccgctgcgggaggccggcgcagcaacagcgtcggcggccgacgggatcgtcacacgtgtcaagatttggtcatcggagtggctcagagcaaatacaatagcagactattagctagctatataaacatattttattaagatagaatatgagagagaagattagtgggctacatatttgtagccagctgcagcacggacttcgagacgtaatgtatgtatgacaggtagaaccatatactaatagtataggaaacaactattttataaattggttattagattggctataaatgaattggacctagacacttagcagtgggctatactattaaacttgctctcatgatttagaaatgggttgtgctagtcttaaaatataatccgatggaacaatataatccgatggaacgttttctaatagaagtaatacatatggttgtgtttagttcctaaaattatggagaagtttgggaaaagttggtagtttagaaaaaaaaattagagtttatgtgagcaggaaagttttgaatgtgatgtgatatgctggaaaattgggagtttgggaaaagtttggtgtgaactaaacatggcctatatatataaacctctatatacattttatattttgtgcggaagagtagtatggatttgctatttgggccagcgcatgtggggggcacagtagggtggtggagtaattactgtactggaggttttttttttcccctgtgagcccaggagattcaaacgcttgttgagttgttgttcggcttgtctttaaccttttctttattgtctggtttttatggatggggttcaaacggttcgatacgtttagatccggcatgttgcaggaccgtggcagtggcagcctttaattatttagatgatagtagttttgtaatcgtacgttcgtgccgttggtacattggctcattggatgattttgaaatgagggtacgaatttggcgtagttctgttttggttcctgcacttcaggctgaacttgttgtccactgttccaattgttagcgtgcatgaaactcatcacggtgaacttccttggcaccccaaattcacccgtggaaacattttttttttaaaaaaagttagattactcactccatcccagaataagttcacctagcacacgatgtgacatatgatattactatgaatatgaacatgcagatatgtcacatccatatacttattttgaaacggagggagtaaggatttgccattgtcttcatctcctttggagaactcgagggtttgtatgcaatgtacttaagtatgtgcacatctagcttatgcaccttatgcactacacctactatttggttgatgcctaaccttattatactaaacttaggcaaattactaaattagggtatgatgacgtaagtgtggctacgaaatagttgatcacaaatgtggtatggttagctataatccatctgccatccaccgattggtcgagctcggaacgtaaaccacacacgcacggcgctggcgcggggcacatggaaccatagcacgattagcccggacagccgcccatactcatcgaagaaaacttcattaaattttaatatttttgatt

SEQ ID NO: 61848 - DNA, 9036 bp, Oryza sativa
agcacaccacatttgacagcagcgctgatttgtgaagaaaaaaaagagagcgaacaaataaaaatgataagaagagctacaagatcgagcagcagctgggccgtctcccggccctccggcgccgaccgccacgggcaacggcgccgtggtcgtgccgctccaccatcggcgagtagttcgccgggtggcttcgcgccacggcgaggccgtcgcgcacgcccaggccgccgtagtagtacgcgttcggggggttgcgggggtaatagagcgccgcctgcggcgaggacgacctgtactgctcgccgcccggccaccgcgcggcgccggggctcgccgcggtggccgtcgtcgtcgtcgtcaccgggtacatgatgcgccccacaccgggcacgctccggccgggagtggcggggtgcccgtgccagccgtggtacggcgacgactgcgcgaacacgacggcgccgccgcccttgccgttgcgggcgccggccgccgtcatcagctgcagcgacgccgcgcccccgccgccgcgggagccgccggcgtccagcgtgcgcagctccagtatctcggcctccccgacctccctccgcagcttcttggtcagcttgctctcgtccacgccgtcgccgatcaccagcagcaggtccctgtccctgccggccaccgtgaccgactcgacgcctggccattttttcacgagatcgccgtgttaattaacaaaacgttttgcatttctgaagattcagaaagctgcgtacgtaccactgactgcagctgcgaccttcagtgccttgtgatggcatttgtcagagtccggcctcatccggatgatgatctccttctgaaaattttttaccaaaaattcaggtgttagcacacacatcacagataactttcaaaacagacaaaaacagcagcagaaaattggagctagatgaggccttcttaccatggttgttggtctttgcatgttccaaactgtttcaactttttggaagaattttcagaagccaagccaataatagcttgtaactgtagtggaggaagaaacaaaacgtctttgctgttgctgtaccgtgtacacagaatacggacaggacgtgtactgctggcgaccagtcatatatatttcccgagcaaaggagaagtatttttattttctgttctttttattctggtcagaccagcaaactgacaaccgctcgaagactctcgtggcaagaattaatcgccggtttataaaatcttcagaaaaaaaagaagtgttgcttcagagttcaggtagtgagtgtacattcgtcgaaatcacatctcaatccatgcagattagtttatctagagtatccgaaaatgttacgctactgaagcaagtgacgtacgccattttcttcaaagcaagaagcaagaaatatatatatatatatatatatatatatatatatatatatatatatatatatatatatatttaaaaaaaaggtatggtgagttatagtgactagtgactagggcacaccaagcagagcaaagaagaaaatttctgcattgtgcacttaattgaactagtggactagtggtgcatagccagaaacgcaagaaacaatcacacggggttggaaatttatatgttgacctgaaagacaatgctgctgctactagggaaagaaaacagttcctaatctgggggtttcagtcgttactcacttgtcagagcagcacatctgggacaagatacctgctctcgttcacggctagtcaatccatttggctcattttccatcagaccatcgatcaatcgatgagacccaacaccaaaattcgttgtccaccatttgccatattttaaggctatctttggaagatggatttctgtagcattagaattgtgtgtaaaataataagctcagccatgtctaaagaaagtattctgtcatagtccttgctgcatcccaaagaatacgggacatctgtatgtacatggtatagtccgccgtgcgagcttggattagaaagactctcggagcagttgagacttgagaggtactgatcgtatatatgccacggtccactggtcaacaccaaaccggccggacgtctgcggctggcgtaagcgatgcactgtcacgagcgcgtcatcactttaaacgcgtttacaacgggaaaacaaaatggcggcactactgatgagtgatgaatactcgctccgttttatattgcggtatttgtaaatttgccactggttttttcagttttacgaggatgccacttaaatgacagtttcagtagtatttttataattttctagtggcagttttacaataacgattcaaagcaatggtaaatttacaattgccttttttatattacaagtcgttttaacctttttcttagttaaatatttttaagtttgattaagtttatggaaaaatatagcagtatttttaacacaatataaacatactatcaaatatattcaatgatacgtaatttggtgtgatagatattactagatttttattataaatttactaaatagaaagaaatttgattaaaaaaaattaaaacgattataatataaaatagaaggagtagtagcgtatagttgttgtctccgtatactatgtgttaactcgatacgacatttatcatacggagttataatatacggagtatggaataagtttaatctcctgcgggacgactctagaggatccccgttattgtatactcctaggtgaatagacaacgtcatcggtccagtagtaggacgacgacgtctatagtaggactggaggactcggtagcagaacaaccacagaaaccaaaactgccagcagaattgcagaaacaacgtttgtggccagacctcaacatatgaacagatatatatcacggagcagaaaccgacgtagaaacaaaaacatggaacatgtggagataaaatataaggaaagaagaaaaagaaggaacaacgggcgatgcacatatattccgtcttggatttcattagcacgttttataaactgctaaaaggtatgatacgtttcgtgtgaaaattttttatataaaagttgttctaaaatatgaattggatccactattttaagttgaaataattaaaacctttgattattttctaattaatttttcgttttacatgggctgcttgccaagtttagtttcaaatttttattttcatacttttaactttttcatcacatcaaaactttcctacacacacaaactttcaacttttccgtcacatcgttccaatttcaatcaaacttctaattttgacatgaactaaacacaccctatctcaaacacctatggttgcatggtgcttgttgcaaacctttgcgctttctatctaaaaccaataagccgagccatatatgggcaaaatatgtgatagaaatcacatatatagtgcaaacttggaaacttccgttggataaaaaaaagacattgaagattcgtccacgtcaacacgagtaagaattgtactcacggatttattcatgagtaaaaaattttatagcgagtaaaatttttactcgtgatgacatgaatgaattttaaacgttcattttatccaacgttagttttcaggttccctccacctcatattttcccagatggatgaatatgagaactgtcactgtcagacatcgatatccatatatgagatgagcatcgggtgatcactgctcagcacattctattccctccgtcccaaataaaattaaccttaacatgaataagacacttaatagtttaacgaatcttgatatatattatgaaatgtttcatccgtgctaaggttagactttttttttctgtgacggatagagtacgtgttacgtcacggcaagtcgatgcgcgtgatccgatcgacgactagaggagactaacgtacctcttgatgcgctcatgtgtttgcatttttcgtctttaactgttggccactgtcttttttctccatgcctaaaaggacagcaacaacgaacattaatggtagctacagtataccggacgctaacgaatacaaaggattactgtagcaggtacatttttctccagctataatactatctccgtttcaggttatagacatggtttatatgggactaaaacttttaagtccctatcacatcggatgtttggacactaattataaatattaaacgtagactatcaataaaatccatccataatcttgaactaatttgcgagacgaatctattgagcctaattaattcatgattagcctatgtgatgttacagtaaacattctcaaattatggattaattaggtttaaaaaatttgtctcttaaattagctttaatttatgtaattagttttgtaagtagtttatatttaatactctaaattagtgtctaaatatagaggctaaagtcaagatccaaacaccacctaagattttctagtattgtccatatatatatatatatatatatatatatatatggggcaacatatcctatgcacacaggccctcacgtgtatacaggtgcacgccaactaaaaaatgtcaccaaaaaatttagaaaaaatcatacacatactttcaattgtattacacctagggttaaaatcttaacgtcaaattcattatattttagccgtaacaaaaaaaaatctgacagttttaaggttgcaattttgtcagaattttattttttttattctctatgtagaatgaatttgaagatgcgactttgcacgtagatgtaatattattgaaagtacatgtatgaatttttctagaattttttgtgataatttttagttggtgtacatggtgtgtacacgcgagggcctgtgtatgaatttttctagaattttttgtgatatatatattaatgaatgaaacagaggaagaggaagtactagttacgtatatctttgttgtagttcggatgatctgtacatatgaactggcctataataatgattcagtccaacggttcggtgtcagcttggccttaaaacattcggtttggttagatgtgatagaacttgcttatttaggctctgtttagttcacagcaaactttttctaaacttctaactttctatcacatcacattacatccaaaacttttctacacacataaactcagaggaagctactcatcggacgtccgatgccccaaaaaaatcggatggtcaaatgtcgcagttgaccaacaagtgaatcattaagttatatagggtgaaacaaaaaaatcagcaactgaaacatttaaatattttatgaaacatggtgaagatacacgttgtaacatgtcgttgtcacgtatgaaacaacaagtattaacggattgaaacatgtgtttttcttttaacaaaatataatcatgcgatatcttgttgtaaagatttcattaaaacgaatacaatggtgtgatcggatcatggattggataaataatttaagagaaaaatcattttgaagcttgctaaaatacatgtatgcatgtgtgtatagatgaggtggagagagagtagtagcaggtagttttaggaattttatgaaacacactaaagacgcacattgaaacatatcactatcacgtatgaaacattttattttaacagtttgaaacacatgtttttcttttgacataatataatcatatgatatcttgttgtaaagatttaattgcaacgaatacaacggtgtgatcggttcgtagatcggataagtaatttagaagaaaaaatatttaaagagaggaggaaaacatgaaaagaaacagatatgtatgtatgatgcagcgatagggtaggcgtccgatatttctgttttcataaacttctaacttttttttccaaactaccaactttcctcaaacttcttcacaatttcagaaagtaaacacagccttaatttatatttttcgacttaatatgagtgttcgtatttatggttcttttattagtatcacgatttgaatctgataaatagaattatacacccacgattttaaagcaccacacacacggatagtgcttctccgtatatagttggggggcacaatattatacttggagatggtaagatttagggaatatattcccagcaacaaaaaagatttagggaaaatataaatttgctcttcctttttcatagcaacgggaaaaacttattttgagagaaaacacttttccagaacgatgctgccatacagaaaataatcttattagaccccggtcttacatataaaacctagggtctcatataattattttccggtgcgtaggatatattctataggagcctaaccgttcgatctgcaagtctgcaactatggacgaatcaccaagcgagcgtgcatatgctgccactattgtatcgtgcagcagcttggcacgctacggcgaagaagcttgcggcgggagcagcagctatgcgccgggtaatggccgccgcggccggcgtgccgctcgatcaacggggagtagttcgccgcgtggctgcgcgccacgtccaacgtgtagccgccggccaacggcgaggagcggtagcatgggctgggatgagcggagtacgaggccgcccagctgccgccgacctcgccggcgcccggccacagcgccgccgccggcgcggcgtggctggcgaccaccgagtgggcggtgacggggcatccgacgcgcgcgaaccatggcaagccgccgtcgcccccaacgaggccgtggtaccgcgcccgcacggcgtcctcggtgactgcggcggcggctacgtcgacgggcggcacggccgtcgacgacgacgtggtgagctccactatctcggcgtagccgacgtggttcctgagcctcctggtcagcctgctggcgtccaccacgccgtcgccgatcaccagcagcaggttcctctcctcgccggccaccgtgacagactgcactcctgctcggccaacgcatgcgtgccattcatttgcaaggaaacgatcggatcaaactcgggaacaagaagaagaagatcgaagacattaccgttgaccgtggatgccactttcaaggcttttgatcggcatctctccgagctcagctgaatccagataagaatctcggtctgaaacatcagtgttattaattccgtcgaattaaaccattgctagcacacgagacatactagcacgtagcattagcatgcatggaaattactagaaagtaacagagcttagtcgcccataccctcatggaagtgatgcaaatatacaactgctttattactaggagccaattgaagggattggttgctaatctgcaatgacagagtaaacaaatgtttccagccacctttcaatggtacagtagtactctactttacatggtaccgacaatgttttgtacttcttgcaaggaccagtgcacactgctcacttgctcagtgacatatataggccgagttggcgcttgccacgactatttgtcctttgtactgtactaacttagaccacggaaagcctagttttggtggtagcatggaatcaaaaagaaatactgtacattttcttcctgagttgaagagaagtccagacttattctaagggtcccagtctgttaacagtgaaatttggttcgattttctcgtcaacacagtcccagaaaacggccaaacatgacattgtgccatttttcaactaattagggctcattcggtttataggtcttccatatgattttttttaattaggattgacaattcctttgaatttttcacttttcatgcattcagttcgctggaatcccgtgtaggaatttcggaggaatactgtaacaaccatgtgaaaacataggaatttcttaggattcaaaacatctacgtactccaacctcattttttggttaatggctggcatagagtgaacgctaattcctgcgttttgtatattcatgtattccgaatgctcaatatcaccaaattccaatgcttttcaattatatgttttgcatatatgtatcatgtgtatttttttctatcgtgtgtcgttccgaatgatcccttaataggcaaccttgtttgattccatttcagttccttctcacagggacaaatcacaacttttaatttactgtaagtgttggcatgcatgatgccatcatttccatagtttgttcaaccgtggatttagataacttgcattactagcacacaaacccaatggggccggaataggcagcgttagtcaagactatcactgctggttgctcaatcgaccgtgatgtccctcatagagaacaaaaaccaaaaagtaaaaggaaaaaaaaaaaggcttggcgacgatcgttgagcctttgccactgtcattgttgttgcaaagccacaactgcggtcatggttgtcgaagcgcggtcattatcgtcattgtgctacccaccaccgagacaataaacccttacgatagggagtccgggcatgctatatctaatattggggtggcaatggcacgtgttccctagtctccggcactttggagcaccagagatcgcccggcaaagaggctaatgatgacaccaatcctagccaccttgtagccaaaattgtacatggaagacatcggtcagcgaaagaggggtaagggagcaaagagcaagagcagtggtgtcgggacggagagggacaagagaagaaagtaggagcagcgactcgctacaaatataatagccagatttcccggccgagtggttgtgctctctacatgcgtagccttgacctacttgctgtcaccggcaaatgtggaggctactagatagaatggtggtatcgggtacatgtgaatatattttgaaaatggaaatatattaccattctatacttcatttttaacaaatcgacttgtttcttatcgtttaagctatggttaataagccatggaagaatgagcgaagaaaaaaaaacttatataattgtatcggcagtttaaatggcaatataaaagcttagaatacaatgaaaaacttcaaatcaactccatgattaagttgtaaaaatt

SEQ ID NO: 61849 - DNA, 1806 bp, Oryza sativa
ccaaaaaccaaacccatcaaatctgaatatcttggaaagcgattagtttatacaacatgtagcacaaaagtacagtagtgtactgtgagctgttgaggatcttgctgacatccttttgcgtgcgttgggtgcttgattctgtccaaaggaacaaaatcttagcatgcccaacgatggagctaaacaattcggctcgatctcctgcctcttttatatataaaatatatatatggacttcagtaataattgacagagttggattaaggtacgtactaattaggcttttcttttctgcgaggagtactaataagcttttcttttatgatatcgtgacaatcaagtatagattcagcaattgtcacattttcgaatactagctggaataaacgtttcaaccattacatctaaaatagtacgactatacatgtgtactatagtactatggtcgaccgcaaaagcaaatagtaattgttgattcgataagattttatcatgatgaatcgatgtatatcatattcgtacaactgatcaaagggttgactaacgagtctaaaaaaatacgactatacatgtgtagtatggtactatagtcgaccgtaaagataaataataatcgttggtttgataagattttctcatgacgaattaatcaacttagaccatcctcgtacaaccgatcaagaagtcactaccgagtgactagaccgtactagagaatagaggtgccataaagcaaactatttttataattaattggatgacatgtataatagatcattcacgcggatctttccttttttaaaaaacacaaaaccaccaaatgcagatcgacatactaacaattatatactccatctccacttctgaaaccagaatttgggggagttgccatggactgacaaggcaaagcatgaactgttcattcctatgtatgttaggttgtttgaccacacatgaccccactcagtacaagtgtcatagtagtagcatataccaataataaggccaaggggaccccctcaatgtttatggccatattgtgagatatgtgcaacctaggagtagtcctccatgcccttgtgccccaaaggctatgtgtactactgcgtcgctcgtctcgtcatcttctctgaactttctgaacttgttcagaaaagttcagaaaggaagaaaaatgatggggtgcacgtcctcgccgatccttcagagcaagcagcagatagataggctatctagacagacgatgatgcatgcatccatgtgtacgtgcagcacaaatatatatatatatattttcttttgttcattagtgttccaattaatatctctgaacaaaatcaatacgagcagtgctacacacatacttaaaaaattcttgcataacccttacgaacaaagatctctaacagtttgatttaatcagtcgatgattatgaaaagttaagataatcacagtatgccacatcaattttcgtaagagtttgtaaacaaaatttgtacatgcatcgttttccagttaatacataaagtgtttatatgtatatcaaagtttacaaaaccaacgaaaaccaacgttttccaagccggcttaagaacataaaccgctcggtttttcaatcaagttaaaaaaaatcatactgaactttcaatttttaaaagtaccagaatttattaggagtcctttttttttgtgaaaccgacaaaactaccaattctgggttttggttcgagaatagtttggtactaaaatttaaatttttaacaaaatttgaccggaaatcgttaggaggcaatgtattttgcgaa

SEQ ID NO: 61850 - DNA, 4602 bp, Oryza sativa
accaatcactaagtgctgatgaaaaaaaaactaaaacgatattatacttatttaatttgttgtgcatactacagctagatgcactgatcggttcaattatgcttttggttggagtgtgtgtgtgtgtgtgtatatatatatatcaacttgacaagaatatataaacccagtggcagtcttgaaattagcttagcttgaccatatacgtgttatggcaaatataatagagtatgcatttttatttcgcttctgagatatacgtacgtgtacaactactggactccgtctgaaccaatttgtccatggtcttgggtcttgactgataaaagaaaaaactatatacatatataaatacacaattgaattactttttgaaaggatatatttaagttagaaatcttgtactccctccgtttcaggttataagacgttttgactttggtcaaagttacactgctttaagtttgatcaagtttgtcgaaaaaagtaataacatttttaacccaaaacaaatttattatgaaaatatatttaattattgatttgataaaactaatttagtattataaatattattatatctgtttataaacttagtcaaatttgaaatagtttgactttgaccaaaattaaaatgtcttataacttaaaacggagggagtaacagatactaggtatattcgtttgtctgtagggtttaaaaatatctgctccatcattgtataaatatagatacatacaagtatagctaggcacacactgtatacatttgacaaacaaacaagctaatactagattgatcacctctgcatgcatttgacagtgaactatggattaagcaatgtatagagcagtagagagttgtagataacacatgcaaaaatgatagagaaatcgagagggcatgcaggggttaatattttgtcaggcttctcacgtgcacacggcgatcatgcatatgcatcatcgaccggccaatataatcttctcttggaacgataaaaaagagcatgtgcaatggcaagcttagtccattgtcatgtgctcgcatgcttttcttctactcaatacccacaatggtaaagtaaggtgctatctataaaacatgtacatctcagcaatagactcgattaatagtaaaccaacttaatagtatgtctacattggtatctatagctctctcatgcattgcctcgtttttctctatagactatctctaagttagtagatagctttgctctctctcttcatttaatacattccaagtagaaaatatgctgacatagatctcttgtagagagcctatagataactattgtgggtgcccttagcatgggcacgtacccacacgtgtgcgtgcatacgcccaagagtcttcgattgatgcacttgcattaattcatgagcaataatctctctgctgttcttttccatttgccgtttagcacattgacatgattctaaacatgttttttttaacgaacaacaccatacggtacatatataaggtgagaagtttttattgatatagtatgaaaataattttacaaaactcaagccttgggaggctataagggcagtcccaacccttcacctagatggtgtctatggaattaactacattgtcatgtaggacttttaacttatgtggcactatattaattaagagagagagtgaagagaggaaaaaaattaagtctcatgcaagacacagcttcaacacgagaacctatgtactagacactatcaagttttgcattgggaaagactagtgtattcataatagatgaagaataaatatgattggtagagaagaaatatgatgcgtttattaatggcccactttaagaaatcatgtgttgcggagtgtagtttatattgtgatgtcttattgacatggcaccatagacactgcttatggatactatgggttgagactgccctaatcaggaaaatgaaagaagacaaaggaaaaactcaacgctgacaacatcaccgcacaaaacactgaggaaggaaactaacactgagccggccgctgtgtgagactgatagccggctcgccgctatgccaacgacagagctacaccgctcaacgatgataaagccaaaccacggaaagggcgctagggcttccatatgacatccctactttggattgcaaagggagaggcgagagaaaagaaagagatcatctttggtcaatcatctgcgttttccctttatgaatatgatttctcaaaaaaaatatacttaattagttagatcacacattatatatttggtaagtttattgttaaaaatatttaatttatcctaatatgtaaataatttatagtaatacctgatatactcgctgacaaatactgtatattttgcatgtctatacatcctatagatctataaagttcatccccactaattatagttaatgctaattatctcttctctcgtaaagccgcatcatctcaattgtttttagcttttgaatgattcatcaagggtgtaaattgcatctccccctcccccaaaaggcacactatataatacaatcatttataacctatggataattaataaaggtaaaaaaatatataaacacatgaaaaaaaattatatagtaggtaagaaagaaaattttagaactcatatctactatattatcatacaattctcctgtagcatttgtacataacatgtatgtatattttgcatgtttatacattctataaatttataacccactaaatctaaaacttaatatgcaaccatggccctgttggttccatgggctaattattagcactcaccttttagccatgaattagccctcaaggatccaaacaggtgggctaatttgaggctaaagtgaattagccctcctcaaaacattagcccctccatggggtgctaatggtgctaattttatgtagggaccatcaaaaagcagctctctctccccctctctctctctctctccctctttctactctctctctaccttttagtcttgaattagcctatggatccaaacataccaccctagactaatgtttagcctaccaattcatgactaaacattagctatcaaaattagccctaggctaatcttccaaacagggcccatatcacatcatcacccgctagcaataattgtatatcaaagctcatgtaaacatgcaacataatctacaatgtattgagttccagtacaaattaacatgcaagcatatcctatcatcactactcacctcatttttaccatattttaacatatttgtccatcatttttataatacttaaaatatacctatcaatatattccgcacgggcatttgtttgtttcatgattattactgataaactctgatgttttattgtttttttaatcttttgctttatgcaatgcaaattttggtccaatatttcatttacaatctcctacataatttactaaatttatttttcttcaaatatgacttggtaaaccagtttaatttattgttagtaaataatgtccttgatacttctagcttgattgttaaaggaaacatattgacgattgtttattgattcctgtagcaaagcataaaaaaacacttgtatataggagtacactatataagtagtactccagtacaaccaaaacaaattagcttgattgacgatgtgtggcagcaatatttgttgtcggcaaactgacaagccaccaagagatgcctccaactccgagctaggacaaggatcgaagacgtggcttcctccgaggatgcatgcatgctgttactgtttaatcatatatccagttttcaaaataaatatagttttaattagtctaatacatatactcttttttcgttttctaaatagataacactgataatttttaaaatgatatttaaccattcgcattattaaaaaaataatataaatatgttaatgtataagtcatacttaaagtatttttatatcacaagaaataaaatgatatatggatcatatggcaagagagaaaagtactatagacatctaaacacaaatctaaaatatcacatagaactaaatggtgaggtggaggaaagaagaatgaaaagagataaaacgacacctctcatatatataaaggacaactcgtacacaaacttttatttattagatatgagagtgtacgtaaggcttattgggcgagagtgaaatagctgtatattcacacaatttcctttcatcgaacggtgagcttaaaaatgaaaaaaaaataatgacaagttggcctaggtagtttgagatgcaaaccaaaggtagtctaaagaaatactcctactaattacatataaaaatatatatagcggtgcatgcgtacatcgcgcagatcgttcaaaccctagcagcagtgcagtaagagcagaatgcatgcagtcagtcagcctaggagaaatcaacggagcacccacccgtgcctcctcgtaaacactgtaaagataaccctatagctagcgtaaatagtagttaattaaagccataggtactagctagtaccacatatactaattaattaccgtgctttgcacttaatacagttgattaaacatggattgcatgcgt

SEQ ID NO: 61851 - DNA, 17275 bp, Oryza sativa
cagaattcggtagtagaagaaaaggtaattttggaggctctatgaatttaccaatcaacaatgttcatttgggaatcttgtgtccagataacttcagggcctcatcgtttggcatattcatatgcttatcagctaaaatttgaattttcaacattagatttggagctgattttagggttttttcatcgaagtttatttttcagcctttgcttttagatcgctaagaacacatatataaaagttttatttacaaattgattttcgtttgcaaatatgccatgccaaacgatgaggctgtcaatcttttaagacgaacatgattttctggcaggttcttatccaaaaaattcaggacgcaatctaaaagaaaataacattgtatacttaactggtttagagttgacacttacacactactgctaaaaatgcaaatactcccttctcagtatcatcattgcaagctagtttgaggagattaggccctgattgaagttactaacatgtctatcactctttcaagcacacaagttagctacatgcatttgtactttcaaggaaggagccaaccaatttaaattaccaatccaattgctctacagttggatttcaagcatggtttggattgtagtaacagatagagcatgcattaagtgggggtaccttgttgttctttagggcagcagatgcatcagagttgatgaggcgccggaggaggggtccgtgctgaaaccctaccggtgaagccgtcgcacccagacccggagacggcgaggccgccaccgccgccgagaacgcgcggcgcagcgctacccgtgccgccatcgccgtccaactccaacacccgctgcttctattcttcttcctcctttttttttcctttgggaattgggacgcttccttccttcgtaaggctctccgcgtacgggccgccataccaggttcgggccttcccctcgagttcaagcccagcccgaaagtcgaggaacaaaaaggatggcagaattcaatccaaactctgaaggaataagtctatttttcctccctccctctgttgccctcggtcaaactgtatccctccttcaacttcaatttgaaccctaataaattttagtaggataacaaacaacatgatcttaccaataacaacctatcaacatttgatagtttcagaactttcctcataaaaacactaccattttttttagattacacggcagacgcacacgcgcacacacaccactacacatgcaacaccactcaacacctccacgaatgcgtcacctaacacattctctaagagatggaaaccagcggcacatccctgatctcactaaatacatccaaagttattaaaatttggcaatggtaaaacctcccaaaatctagcattctgactttcatcttgaatgtaagttgtaatgctctgttcgggagtgagggttacgaaccctcactctccgcacgcaaaacgaaacagcacgtgattaattaagttttagctatttttttaaaaaaaatagattatatgatttttttaaaacaactttcgtatataaatttttttaaaaaaacgcaccgtttagcagtttgaaaagcgtgcgcgcggacgaggagttgggaactactctaacgaacggtataaagtaaagttaagtaaacgtggtggaattgctgctaattaatttggttttttgttcacctttaggcactccgagaacgaaaggaacgtgcctcagtttttgaggacccttcagattgatgccagagcaccgtcatgacaaactcaagtgtgtgaagatactcaatttctcgtctgcaaagagtttggttgagctaacatgtcacattgttgaatcggcgacatcgctcgagtgtcttacgctggacacaacgtcaggttttcctagtagatgttcagtggacaagctgggtaaatgcctcttgttgcgcagagaggtacccgtggaagctcatagagcactggaggctgtcaaaacgttcatcaggttgaaagttccttccaaagttgagttcaacgtcttggagccttgcagccggtgccatgctgctgttgagtggcctttagatgtcaaaaatgtgcctgtggttctaccaaatgattagttcattattgctagtgtcatgttacaagttttgtgttattttagccgtgcatttgtcccgaaactatatatcagccctgtctactgttgaggtttgtaatatgacatggatttagaacatgttacctagtgtaatttcatcttttgatattctctattttctgtgtttgaacgattgttgatttttcattcatcacaatacttatttcaagagagcgtaatctattttctggcactctttattttatgcactgaacaaaaaaaaagagagagtgaaatgtaatgcaaacacgcaggtgtgtaatgtgttacagtttgtgaaaaatgtgcgaaagataattcatctccatacatttcgttttgtttagttttgcggtgcaagaagtagctgaacattatttttagtgtttggtttgctgatttgaagcggtattcgtttatattgttaacgtttcttgatgttttttaagtttttgaagaatcgatgtttggttgctagtatgggatttctgaataatttatagccataggctgtgtttagttccattcacacttccaaaaattctgtcacatcaaatgcttggacaatatatggatcattaaatgtggataaaaaaatcaattgcacagtttacatgtaaattacgagacgaatcttttgagcataattacgccataatttaacaatgtggtgcttcagtaaaacatttgctaatgacagattaattaggcttaatatattcatatcgcagtttacaggcttaatctgtaatttattttgttattagtctacatttaatactttaaatatgtgtctgtatacttaaaaaaatgaaaatgaactaaacacggccatactttatcataactttaacaagtcgatttttttagaaactttaacgattagacttgagcaacctgaaaataactagattgagatggctaaaatgacacatgtttctttacgtacggcaagttgagacgacaagacgattattattcctgcaatttaaactaaataattttcgtgtggtgtagatgaatatagccatgcttagctaatccttaatttctccttagagagaaaagcacggcaaattaatatccatatccatagatagatagaagaagaatcgaggaggagaaggaggaggatggagcagctccggcaggtcggcgaggccatcggcggcgtcaacgccctcatggccttccacgacgacctccgctgcatcaaccctcgccaatgcgccctcctcgcccacgcctacgccctcgccttccgcgccgtcgccggcgagctccgcgcccgcctccgcttccacgaccgcctcaccaaatggaagcccctcgacgatcccctccgcgagctccaccgcgtcgtccgcgacggcgaggcctacatccgccactgcctcctcctcgacccggcccactggtgggcgcgcgccgccgccgccacgcacggcacggaatgcgtcgagcaccacctccacaacctcctttggtgcgtctccgtcgtcgtcgaggcggtcgagaacgtcggcgaggtcaccggctccgaccccgacgagctcgcccggcggcggctggcgctggccagggactacgacaaggacctgctcgatccaaagctcttccgggagaggctcggcgagacgttcctcgccacgcgtgagctcgccgcccggatggacatggcgtggaaggaggacaggtggctgctgtcccagcttctcgacgagaggaagggcccgacatcgtcgccggagccgccattgacgcggcaggagcaccggctcgccgacctcctcgccgcgccgcgcgggaagctgcacccggcgagcgtgctcctgatgagcgacttccacatgcggaggcgcctcggggggaacgggaacctcaaggaggtgcagtggttgggggaggcgttcgctgtgaagcacgtcgtcggcgtcgacgccgaggcggcggccgcggaggtggcggcgctggcgtcggtgtcgccgcacccgaacgtggcgcactgccgctactgcttccacgacgaggagaagagggagctgtacatggtgatggaccagctgatgagcaaggacctcggcagctacgtcaaggaggtgaactccgccaagcgccgggcgccgctcccgctcgtcgtcgtcgtcgacaccatgctgcagatcgcgtgcggcatggcgcacctgcactccaacaagatgtaccacggcaacctcaacccatccaacgtgatcgtcaagccgcgccatggcgacgcctacctgcatgtcaaggtcgccggcttcgtctccggctccggcacggcgaacgcggccaacccatgcatctggtgcgcgccggaggtggtggggaacgaggcggcggcgacggagaagggcgacgtgtacagcttcgggatgatctgcttcgagctgatcaccgggaagatcccgttcgaggacaaccacctgcagggggagaacatgagcaagaacatccgcgccggcgagcggccgctgttcccgttccagtcgcccaagtacctgaccagcctgacgcggcggtgctggcacggcgaggcggcgcagcggccgccgttccactccatctgccgcgtgctccgctacgtgaagcgcttcctggtgatgaataacccggagcaggcggcggcggacgcggctggagccgggccggcggtggactacctggacatggaggcgcagctgctgaggaggttcccggagtgggaggggaacggtgtcgccgacgtgccgttcgagatgtacgcgtacagggtgatggagagggacaagatgagcaacgcgtgcagggacaggagctccgactccggcagcgacggcaactcgctgtggggagatgacagcgccagcggcgggtccagcacgacggcgacggacgcgtcggcgtcgagccggccgctgcttgaccggagcggcagcacgaggtcgtcgccgccgcgcaaggtggccatcgccgccgccaaggcaggcaagtgtcgcagcggcattgttactcgtctaaagccttcctccaagattacagctagctccatgtccgtgacgtgtgcagggccgccgcagaagtcgaggtcgatgggcacggtgaggccgccgccggtcgtggcccgccgaacgccgaggattaagtccgacggccacctcaatagggcggcaattccgcctacccgacggcgtaaatccggcgggaacgcttcagactcggagttagcttagcaaaatgttgggtagccttctttctcatatgatgagaggttttcacttgtttcagaaatacagtatcaaaacgtcaacaatgaaaaaaatttcactcttgtaaataataagcaaacgaatggatggatgtaatgtaatactacagatacttcaggaatgggaaaaggaaatgctggtataaaacgcaccaacattactcggtttaagtagagtatttatcagcagaaacaatcttagacaaagagaagaaaatgatgaaaatcaactattagcagcacacagcatactgcatgagttttcaatctcaatacaccatcacgactgaatagactttatgagttaggcaaatgcttcatgctttacagccaacttattaatttttcccacgggtccagcaacaattaggatctggaaacagtagtaggatataccaacatgggctgagagggccttatgctgaatgggagcctcagtgctatgatccttctacctgcccttcctacaaaaacagaactcaccaccctacaaaaatagcagttgataatgaccagcactaactccaatttcttcagtctgatatcctcatctctactcctagaactttttgcacaaactcgtatgtcacgaatgcaatagcgatagaaggcaccacctgatgaagaggcaagcaaaggtcagcatgtcataaacaagcactacgatgatgatccattaaggttgcaaatatttgaatttttcgtaggaaacattaccttcactgaattgggcacaagacccttgtacaaagcaccaacaccttcatagcgaacagttttcctgaatgcatcgatcataccattgtactggagcgcctctttgccttctccagtaacaatagatgctgcattattccaaccaaccatctgcattctcctcctgatgacatcaagagggtaagcaacagtctggcctatggttccagccacagctccacatccaagccttgtaactacatgcaactcattgtccttgccaagatcatatggatttgtctgaagcagccagtccttcagagactcgtacacagcaaagttgaggccaacatacggaacctgcaagaagatgacaaagataatgtggaaagcacttgtcagcaaggcactaacgaggcaaagctgttaactaattaaagaagagacctaccactccgataacagatggaagccaccctctgtatagagcacggaagccttcttcacggtatactgaacccaatgcatgaaacataccacggtactgataaggagacttttccgtctgcatatatgacatttagaggtcaatagacagaatatgaaacagaagtagattgagttatgctgtgttgacgttgttgatacattacctgcacggtaatcctacccctaaccatatccatcgggtaagtagcagacatggctatgataccagcacaagcaccagctccaaggcgcaatagtggactaagctgagcatcctctgtacagcataggaacatgtcagtgctgaatccagaattttctgttatcaactttatataatacatcaacaagaatataaattctcttgttcaattgaagcagaacattcaagaaatctatttgtacagaaaaagacatgaacatcaggaacccttccagtcaaaaaaaaaacatcaggaactctgctccccagcatttaaattgttaatttacatttttagaacaatactatacataaggaacattggatattgtgtaagctctaagatccgtcacaggctcgcagcatgtccagcagtgttgcacacgttgtcatattactgacaactctacagcatacaaaatgatttggactcagtgtgcatatacagtgagcacggactgagataacgagaacagacactggagataacgtgcgctcagagtattgcactacttgctttgtactactctttggaggtgaggtattcaatctttcaaagttgctaatggattccagtttggtaggtgattcagttacataagcctgtcctctaatagggatttaaaaagtaaaaggcagactttgttttcaagttcaagcggatgaccaacaacttttcttgtgtgctttatcgtcctaaagcaggactacaaaggtcgctagcagaaacaacaaataattagctgtacaaggaagactttgtttccaagttcaagctggtgagcaacagcttttcttgcgctcatcacttcatatcaggactaataaggtttctagcagaaataacacatgatttagctgtactgggccatctagacgaatgaaggtttttgacttattatacaaggcctcacaatcttgaaaacgatcataatatatattgaaactaaaaactgaacaagagatgggcaagctgagtataaaaagtctacaattgtatttttcctatagataaacggaaaaaaccgtagagcagtcatgagactcattacgtagtcaacaaccaaaggtctgcaataacaacatggtgtgtaaacactttcaaaataactaagatgcatacacaggaaaactaatgtgtagtatggtaataacggagagaagcataccattccctgtttgttgccgataaagccataaaattccactgcataaaataacaaagaaggcaagaatacaattactagtgctttcatgaaacaaaaccatattaacagtagagtaaaaaggaaatgcttctgaccaagatcaggtcaaagaagactcatcatgcaacagagaaaaggtctgcaaagtgcaaaggacaaatagcaagtaggtggcaagagagcaagcagtaatgtaggatgacagtaattggaaacaataacaaaccttgatgcttgctcatagctaaaaaacttcacggcagaatttggaacaattctggcacaattggtaccattgcccttaaaaagtccacggagaccctctgttctccatatgtacttaagaccttgaattgtaccgttgtacttgatactgtgagggttttggacctgcattaggaaagataacacgaatcaggtgttagaaccaactcatacaattgcccacacatttccacgcaaagtacttgtacaaatttacaatattaacaagaactggactagggtttagcaccaagtgcagtgtctgtacttcaactattaatacaaatggctatatatatgtagtgaaagaggttatgtttcaagcaagctccgcaaagtagacaacaatagcatgccaccagataagaaatgcaacagcaatgaaaatatcacctgaagcagaatcttcattcgttcgagcggagcaacagcagtacgtgatctgttcaacaaaaaaagtaaataaatattataagcataattgtgtagttagttagaaacgattggtccaagtagattgtcatttgctggtcaagctcgacaaaatgcaccagaatggataacgagaaaagaaaacctgcaccaggtaaacattctagttgatccgtgtgttttgctcaaacataaaataaataatttctgcgtggacttcagctgactataacaacacctgatagcaacatttttagcccaagaataaaacaagttgcaatactcttaaaccgatcttatatcagatgacataattatgcatataattgattattgttcagctttagatgcaagtgcatgacattataaagaacaacatactccatgaaacctaaattattaaaccataaaggtgaaaactaattggagtgcgacacaaacatgtaaagggtctgatgcataaagtgagaaatgactcttatttagaggaattagacagctattagtgaaaccaaactgagatattgaaatgtccaggccagccgcccagatgatttgtcgtaaaactataagataataacagacaagataaaggctgaaaatttaatagagccataggatgaaaaagccaacaccaccttgtcagacacaatatattgctagggtgttggtgtacttatccagataatatattttgcattgaatacaataattcaagtggaacttggttagatcacaggcaaaccgaaccaacaagacggaaattttaatccaccagatggccaggctataccatgacaacgagttggaccgtaaatgcattcgtccacatggcccagtgaaccgaatcaactaacgagtcaacgaaacgagatctggttacctcgttagggtttaagcgtggcgaattcatcataagagtccatagatcacacatctccggaacagacgttcatgcaaaaacttataaccgcacacacacaacatagccgaaacaaatcgcgacgaggaattaaaaaaatggtaggacacgagaaccacaaatccatcaaggatcaaacgcgaatctaaaggaaaccactgaatctaatccgggagccgcgcagagagaattcaacacggagacgatgagacgcgggcatggagaagaacaggggggatagatagatagatagagagagaaagagtgagggaaactcacactccaccggcgacgccaccggcgaagagagacttgcagatggagagcacctggtaaccaggccccttgaccccctcccgcgcgagcttggcctcctccgccaggttgacgatggtggtgaccgcggtgtcccccctgctcttccccaccacgtcctccgatgccatgtccacccggcccgcaccgcaccggatcgcccgctcgcctcgccgacgagatcagcccccgcgcccgtctcctcctctcggcctcgggtttttgcggcggcggcggcggcggcggcgggaggaggagaggaggggagaggtgtgcgtgcgtgcggcggggagaggcgactggttgctaattaacctatttcgttttttgcttttgtcacaaaaataatatataatgataataatattgctgcgcgcacgcggggaacagctggtccatcactggctgcgggtgggcccgaggagggagtgggacccacatggcggtgactcagtacactgtggcgctgtaggtttaggggcgccgccggggggttgcgatctcgccgtccgtgcttatctccctccgccccccgctgcctcgggatggacgaacggggcccacctgtcattgacacagagagagagagagagagaggaggggagaggcttaacggaaacctagatccgtcgcgacggagtgcccgtgttccccctctctctccgggcctctccctgctttaatttatctttatcgtggagatatagattttgttgttagttaataaaatctgagaagaatgatttcttcggatttaaataacgttgaatttaaacaaatttcttctgctaattagtgttcatctcgttgataaggccatatagtcaccaaaaaaaaatctctactttgtgagacatgtgtaattgcgagcatgaaaatgactccagtgcacacctgtctcctgggctgggcatacatatttcatttcattattttgtttagtttttgttcctttttctcccagcatcgatggtataattctttgcaccatataatattccatcatttccttggtgccaagaagaagaaaaaaaagacattgcttggttcctaattaagggagttcggtgctcacaatcgatcgatcggttggtgaatgactgaatatcatttggtaatgtcggtacggtatgtaacactgactgcacttcatatatggtcttaatttcgaagtggatcctgcatcacacattttatgcggaaatatgtgtggatgccaaaatgaacggtctaatcatttacttatcggatcgtgtatttccatggccaagtttaattctttgctgactttgagaaaaagaaaagaaaaaagttgatagaatgtgacagacgtagactaatatttggcctttcctgctcaacttgggccaaaattctcgttttatggctgtagcaattcgaggaccacgcatcagtgcgcaaaggcatttggcgactgatccatggatgatacgcatactgcaagtatgtaacagcgatcacaaatggttttgcgttgcgtttttgtggatgggataaaataaaacgtcgtggacaacatacatagatggacgcgcggcaaaattcaggggaaggagatcaacgcctctgcaatttgcagtcacataattttcatttcagtcgccatatcaataaactagtggacaagaatatctgaatatgtactcgaatgtatacgttgtccattcatctatagtgcaagctgttttagatttgttctttggtcagattcatttgtttaattaagtttgtagaaaaaccatagcaaaatctgtaacatcaaattgatctcactaaacccactgctgaatatatatatatatatatatatatatatagcatgtttgttttgtgttcaaaatgcaaccatacttggttaaatgaacaagtttaattcagggtaaaatgaaacacttacaggatataaagttgagggaacaggataatgaagtatgtgatgcaagaatccaaaggtggtgtgatcggcaggtagccatcgcatggcaatgtggcggccggagatcgaaagggcgagacaccgtcgttgtctctccgtttttctccacaaactctgggataaggccggggaggagaccaaaatcacacacccccatgacaccatgtatacaatggtatcggggacggacgaaaagaaaaataggactgaacaaattagataaagttttaactttctttgtaaatatatgacaaaaaaattaagaggtttccctcaattccaacattggtattggaactagatgttggttctatggtttgggtccgctcagtagagcacccaccacccgtgtcgagcgaatttattttccatgtgattttactatccttaaaaatataccatactttataatgtaaaatttaatatctccggatactaattacctcgatgtattttttcaagactataaatttcttaaattatagtcatacatacggatgagacacaatggtcatgacaatgcgtgaagcctgttgatgacttcaatatatctcagcaccacgtgcaatctctgggtttgcgtagatataacttgcacttggtgtacatgggtggtgtgagtttgtgcgtaagttcagatactactaagttctcaaaaaaaaaaagttcagatactactacagcgtatatacgtgaagagttgagaaaagaaaaaacaggtgttcaagccccatcgatccatgacagatccgccactaggaataagttcactttaggtatcgtccagtctaatttttatctctgcagcacaaaaccaacttacaaaaccgtgcaaagaagctccctcagcggtatagtcgctggttttggctgacgtggcgcctacgtggcgctcctttgactaggttttcgtccaacgtgggcattgacgtggcgcttacgtggcaatttgatccaaaaaataataaaacccgtgggacccacatgtcaggtttacacaaataataaaaagtggtggggcccacacgtcatcctcactaccctcatctctctctcccacttctctctctccagccggcggagcggggtgggcggcggccggagcagcggcagagcagagggcggaggcgaggggcgaagcggggcgggcagcggcgggtcggtggccggagcggcggcgtgttgtggcccacaacttgtgggcggagcggctggtcggcagccggtagagaagaggaccggcggcgcgtcgtggccggagcagagggacggagcggccggccggcgggggagaagtcgcggaggtggacggaggggcgcggggcgctgaccggctggaggagaggagcttcccgcggcccgtagctgctccgccctcagctccggccgtggcccaccactcgttccacgcgttctcccggtggtcgttcacctgcccctgcacgccgcgcagcgggctccgccggtccagcactgcgtttttcgccagccggttgaacatcctcgccaccgccttgtcgctgcccagcccatttgacaccacgccgccgctgagcagccgcacgtcgtcgccgggccggaagctgatgtcgcggaggctccgcgttgggctgcggctgaagtggacgcccgcctgctccagctccgtcaccgacgggacgaactcgtcctcccgctgcctcttgcggccggtgctcggcggaggtggtggcggcgtcccatggaggaggcttcggtggcagacgtcgatcgggtgtagcgccagggcgtcgccggtgatcagcggtgggtctcgcgtcatcgacacgaatcggagaaccatgtcgttgatgacattatccgtctgtccatcacacggatcaaatcaaatcggttcttggatgattcttgatttcttgattgattgatcgattccgcgatgtacctaacgctttgtgcgggccgcgaacgacggcgacgaggcgccgtcctactcgtagcccgctccggccactgcccaacctgctccgccggccggccgctgcgccccgctcgtagcccgctccagccgctgctcaacctcctcctatcggcttcgcgcgtcgccgcccgctcggctccgccggccgccgccgctccgcactcctgccggcttcgcccgccgtcgtctcccctgtccgccttgctctggcgagttggcatgtgtttagagagaggatagagataagagatgaggccaattgtgacatgtgggcccatgtgggcaccaccaattttttattatctatgtgtaactaacatgtgggtctcacgggttttattatttttttcagatcggattgccatgtaatgccacgtcaatgccacattggatgaagacctagtcaaatgagcgccacgtcagctaaaactatggactatactgccgagggaccttgtttgtatggttttgtaagtttggggatacgttgtatccggttttgtatagcagagacgaaattggactgagcgacaaatagagggacctgaagtgaacttattccccgccactacggtacaagcccacaagtcagctagacagagtgatgggccgatatgcacgtgctttgcttacctttcggcccatatattatgttctctgggcctgtagagcaaacgatcaagcccacgattaaggaaagtagcacatggatgggcccggcctgctatatgcgaatgtggtcgtcgtgggccagcctatcctatgtgtccactactaactactagcaatggattccagatgggctttctctgatgaactaggcttttttagctcatacagatatcccgcgtaactattctctctctttttatattttttctttcccatgagaataacaataataataaaaaacgattgctttcattcaattgactattgactagaccactcactatatatgcaccacatgaacaagcataatagtcgtacaagaccactggctcactatgcaataagtttagggcttaattgttttgggggaaaaacaaagtatctgaatttataaggattacttctttcctgcaaggtgaggagtatagagaaaacataattttttttcatccattcatttttttttgaaaaaaaaatctaataaattaatgtgcgcaaacatttatattcctttagtttttctatttctatagattcaaattcgtccgaatcaaataagcccttactatttagtccaccgttccataaaaaacctacatagtactcgatgtgacgcatcttagaactgtgaatctggataaacatctgtccatattcgttgcactataatttatcacattcagtattagatttattttttctagacggagagggattacacaccaagtaattaaccaatggaaggaacgaacacgcatacttaatttgactttgaaaccagctactagtacgtgtactggcctatatatagggttggaaatgtacatatgttggccgtgcgagcgcgtggacaagtcgatggatcggtcggaaacctaaattaacacacgtgcaatgcgaaaatgacccatatccccagctgaccagcaagcaagctaggcagcaaacaaaactactactccatggagagggatgcaacaatgtcccggttcgtgcaggcacggatgcaactatgcgacaacgacttacttcccagtctccaagggccttttgttctccacgaaccgatccactgtaagctgcaccatgcattgcatgatgaaatcaaaacagtcaaaagcaatattttcttttcgcgaggagtcaaaagcaatattatttgcaagcatgtaacgttgatatatttttcataaacttcgtcaaacttaatgaagtttgacaaaaaaaaatgttaaagcatcttataaaaaagagtgacacgacaattttaatttgctactcaaattaaagagatacttattttacaaattatataaggctatgtttatttgtggagcaattttacagaccttaaggagctaccatgagataaaaaatttagtataaatatagccttatataattactaaaataagtatgtacatacgtaagtaagtacgtatatacacgtatccacccgcgacaaagacagatccatttgtgatttccgcagatagcctagcctatatcatcctccttccccctcgaggaccaagcataccatgggcgggccttttagtggtctgcctgtgagatgagaggttatatatatgtgaaaaccgtttatagtggtattcatcgaatcaaacagtactgtgctacaatattcaccgatgacgagttgacgaccgatccattcatccaatccggccaaatcgatcgacattactacgtacatacaacttatggtcaacaacatctgcatggactcttaatacacattacccggacagtccagatagctactgtacaggtactgtatgcattgcatcagcgccgtacgcacaagtaccatacgaacgtcgtgctcctatagtccctagccgtcgctcactatatatacaaattaaagtcgttcctcgtcttagctttgaataattcaaaaaccaaaagatcaaaaccaagggctacaaaaccacttttaattttaccaacaaattcatcccccgtgtgttatgcgtgtttcgcggcgcagactagtttttggattattgttaccaggtttttcgtatggtcaacctctgaaaacatcgtgttagttactatagcaagttctaaaaaaaaagttactatagcagttttcgttctagtccgtatgcctcgtatatgagcatgttcctagctaggtttgtcctgatcgatcgaattgaaatggattaattattggtcatattagatatcaatctgaggctagtgtcgttttctacctctagaaaagacatgatgagagggaaggggcagcttaagaaaaattccactaattaatggtggagtggcgtcttgctcagagatcgtgttgacgaaaaaatcgaacacactggcctgggagatctatttagctcctgtgcaggtccaaaggttgatgagatgcggacgtgccagtctgtttgatcttgcaactgacaagatatgtaaatagtagatcaaaacagtcgatcggctgacaagccgatggagcaatctcagccgatatcgataatagccgatgccaataccagccgatagcgatagggttttgataaatcggctatatgtccaatgtagatgatgatataaaaggcaatcggctgatgataatataatattgcaatataatccagtataaaccaatcggctagcaatgatatgataaataagcatcgattcgaggtttaaagcacacatcggctggaggtccgatgtcatgaaatccacgagattagattaa

SEQ ID NO: 61852 - DNA, 1498 bp, Oryza sativa
aaactttgctgccaaacgggctcagaagagcaaattggtgtttgttgtgcgatgatgctgaattgttcaatcaatgcggcaatctttaacattgcttcaagctgctgtgtgctgcgatgttaggccaagctgcctctgtaggttgcagccttgcagcatctggttagctcagtctttgaaggccgagtttagttctaaactttttcttcaaacttccaacttttccatcacatcaaaactttcctacacacacaaactttcaacttttccgtcacatcgttccaattttaaccaaatttctaattttggcgtgaactaaacacacccgaaatgtagtgtgacaacttgacaagtcaccatgagagtaggataccctgaattaattgacttgaatttgtttttcctaaatatcatgttaccaaaatctgaaatcgtttttaacttcaccgatattcagcaaaatggcatctattcttataggtgagagttttattagtgttattttttttactgttgctttgcagtgctgatcctgcatttttagatgcttactggtattaatgtctgaaccttgaggttactccctgttctgtttgttggcagctgcggtacaagagatggctttggtggacaaggtttggggtggtcattactgtgctgcagtttgttttagcactttgtttgttgtgtattatagtgaaggatttctctgctgggagatcttcaaaacagtgcttgtcaggtacttgcattgtgctatatacagattcagactgttttttttttcaaaaaaaaaatgggctgttaagatgttgttaggatcaaaatacatttattctcttaaacccttggaattctatgcaaagcagcatttttctgcactaaatttacttatttaaaatcaaatatatgtgggatttcgccaccctacatggattttagtatgtaacatactttatcctgtcttcatgcttaaattatctatagtatcatatggtaacacgaactgatatatagtacagcataacaaggaaggccttcatctccattcgtttgttagatgtatggattcctttgttgcaattagatcactgattcatgttacttggcttttatcaggacatgaccaagacaacagtaactggaagcacactctgttaataagttttatcgtcatcatgtgggtggcaactatagttcaatgttctactggttctgatgtattaaggtggaggtcattctatgcttcccatgatattgcgtggagggcacactatagagaggtgtttgatcatggtatccgagaagttttatgctgtctagggcgggttaagtattcgtatgtttctctctggaactatttggtatatcctacctctattgctatttgaaaagtttgagcaactttgttattcacattgctaggagtgtattagaagaagatgatatatgtgttgtggcaaaattattgggtgatcttatggcttatcgcgcatct

SEQ ID NO: 61853 - DNA, 682 bp, Oryza sativa
gtatgtgcggggtaaccaagaaacaatccgtcggtagaacgtgcctcaaacttatccaaatttccagatttcaagacaaagcatttgcaaccaaaaacacgcaaatgttaaactttgggttgatgaccaaatcgaagttcataagaagtttttccaagtttagatcgcaagaaaactcgatttgaaatataacatgcagtgttaatagcctcagcccaaaattttctaggagttttatatcatccaacatcgttctagctatctcaaccaaaacacggtttttcctttcaacaacaccgttttgttgaggaacacgaggagaagaaaattcatgttcaagacctctttcattgcaaaattgtttaaaagaagcatttttaaattcaccaccattatcacttcgaattcttttcaaagaaccaggaaattcaagatccgatcgaagaaacaaaccacgaaagcgttgaaaagtttcgtccttagttgccataaagaaaacccaagaattgcacatgttcagtaccacagatatctctggctgacaccaggcaagctctgacagagactaggaatgactggaatgactaggatagctgctgagtgagttaccgagacataaagaggatagctaatgactgttcttgattaatgcctggtaaagggtgtccaaggtactgcttct

SEQ ID NO: 61854 - DNA, 699 bp, Oryza sativa
tgatccccattgtttgcaggactgttgaattcaatgtccaagctgattgaaggtaaacttctctggctgttctcatttctgttggcattggcattgttgaagtagagccctagcattgatgtgaacacctctcctcccattagcatcagaaggatcagaacccagagttgcctgtcagataagtcttccatctctactgttgccatgctcgagacagtaagtgtagacacagaggtgaacaataggtccaaatcctttggacctggcttaccctggggcttgagattcttcagagcaaggaaaccagcaaatgagattatcacaaagtaaacgagctgaactaccaaagggttacttttgcaaaccagcgatgatcttcttgtacctcttgacgggctgacgcgagcgcgcccgcagcgaggggcagaagtagcagaggctgctgcaggcaggcagcacccgccgcgacatcacccccatcttcttcctcctcctcctcaaagcctcccaaaaaagagcctttttgggatcgaattcggctcaagcaacacaattctcagaactccaagaactaaaactctcttcgatccaaggctccaagcagcaagatgcttgagcaaacagcagagaattttcgcagcagagggggtagaggattagatagcaggtcgccttcttcctcctcccccttcccacgca

SEQ ID NO: 61855 - DNA, 655 bp, Oryza sativa
atattgatggggcgcctctgaacgaacgatcggcagcaagggtcgtgccgtacgacgagcgtggcggcaggtcggaaagatctgcgttgtcgagctgctcagggcacgccgcgtcagggaggaggaggggcgcgctcgccactgtcgcttcatccagggatgcggtacgtcaatttctttcaccgagcggatcgcagcagtcgtctctatctgcatggtacgcacgcatcatgattggggagaggttcgagagccgtgacgagttcttggaggagctagctctccgagaaggtgaagctcctcggtgtgttcagcctcgactgttagacttgaagtaatccagtgccggtgtctcaaagttatcctaggaagctatctgtagcgtttcatttcttttctcgcacaccgtttattctcttttgtcgagtctgtcgtgcacactcgcctgcgcgcgatgtgggcgtcgtgttccagtgatctagcgagtctgtagaagtagtgtactagtgtgcgtgcctaaacttcgacgtgggggatggcacacgtcacaaggagtggtggcacgcactgcagagtccctttcgtatatgttataaaagttagtcgatatagcgaaacgacgactaaccttctcgatcgcttcagtcattgatca

SEQ ID NO: 61856 - DNA, 694 bp, Oryza sativa
gctacgagccgatccgagccacgaatttcgagctttttgtccacccttaggcggctcctcacggggtcggcgcaggtgacggcggcaggaggcggcgacgccctaggcggtttctgaggcaggaggcggtgtttcttgcggggccggtggcgcagagcggcggcatgaggagcaggaggtggcggcgcatcgggagaaggggagcgagagagggccgaaggaaggagagaaatcgatctgattcctttgaccgctcggtttgactggttttttcaaccaaaaataaaaccgaaccggtttttttggagaaaaaaggggttggttttgtccggctggtgactgtgcaagtttagtcagtgggtcaattaaatcagggtagatcaatttaatcagggcgacagctgatcaagttgattatcgttgatggcggcgacggtggtttccaaatttgaggtggtgaagttcgatggcactaggaatttcgttctctcgcagatgaggctgaaggatctgttggctcagcaggggatatccaaggctcttgaggagcgatgccggaaaagatggatgatgacaagtgggatgagatgaaggcgcaggcagctgcaacaatacgtttgaggctctcggattttgtcatgtaccaggtcatggatgaaaaatcaccaaaggaaatttgggacaagttggcaag

SEQ ID NO: 61857 - DNA, 7099 bp, Oryza sativa
tgttggcatgcatgatgccatcatttccatagtttgttcaaccgtggatttagataacttgcattactagcacacaaacccaatggggccggaataggcagcgttagtcaagactatcactgctggttgctcaatcgaccgtgatgtccctcatagagaacaaaaaccaaaaagtaaaaggaaaaaaaaaaaggcttggcgacgatcgttgagcctttgccactgtcattgttgttgcaaagccacaactgcggtcatggttgtcgaagcgcggtcattatcgtcattgtgctacccaccaccgagacaataaacccttacgatagggagtccgggcatgctatatctaatattggggtggcaatggcacgtgttccctagtctccggcactttggagcaccagagatcgcccggcaaagaggctaatgatgacaccaatcctagccaccttgtagccaaaattgtacatggaagacatcggtcagcgaaagaggggtaagggagcaaagagcaagagcagtggtgtcgggacggagagggacaagagaagaaagtaggagcagcgactcgctacaaatataatagccagatttcccggccgagtggttgtgctctctacatgcgtagccttgacctacttgctgtcaccggcaaatgtggaggctactagatagaatggtggtatcgggtacatgtgaatatattttgaaaatggaaatatattaccattctatacttcatttttaacaaatcgacttgtttcttatcgtttaagctatggttaataagccatggaagaatgagcgaagaaaaaaaaacttatataattgtatcggcagtttaaatggcaatataaaagcttagaatacaatgaaaaacttcaaatcaactccatgattaagttgtaaaaattgaattttattggccgcggctaatgagctaaaatagacgacctgccaaattcggtcatcgcatgacactctggcgaattgcattgcattgcattgcagtcagtcagtcagtcatcagccggtcaccgggctcgcgcttcttggtgccactgggaaagaaggcgccaccgtccctcataaatgctcatgcaacttgcgagagacccgttcgaccgagcaacatcatatctcgtcgtcgtcgcgcgccgtcgcgctcgcgcaacagcagccactgggcggttcatgccaatcaatcaaaatcatgtacgccgtgacgccatgcaaggcctactccgcggggcgcgcgcgcgagataagctagcaatgcaacaacgtgcgtgcgaactcaagcaatgtgcgtactaacatcatgtgcttgcagtatagtagtaggggggggggggggtgtttggatgcaggggtgtaaagttttggcgtttcatgtctgatattacgtaggatgttgcacccggacactaataaaaaactaattacagaatctattagtaaaccacgagacgaattgattaaaccgtcattagcaaatgtttactgcagcaccacattgtcaaatcatggaacatataggctcaaaagattcgtctcgcaaaatagtcgcaatctgtacaattagttattttttaacctatatttaatactttatatatatatatattcaaacgttcgatgtaactggggaaaaaaattataggatgggatctagatagaagcctaaaacgtacgtacgcgcgcaagctaggcgacggtggcgactaccatgcgcgcggccatctggatatgtactacagcctatagctagagacgcgcgcgtcaactgtgaccaagacgtaccacccctcccgtcgcgccgtgcccgtacgtcgccggccggccaggggatcgatctacttggcccgctggccgcgcgcgcgctgcgtctagatacctcatggcgagcttgcattattgtcgtcgctcgatcgactaatcagagccatgcgcgcgcgcggggccggggagcggagcacgtacgttcgtggtcttgtgccgtcgtcgtcgatcgatcgcgatcctgtcgtcgcttgatatttggctgatctatctgcctcgatcgatcgatctaccgggaaattgtgcattattagcgatgagttcgagagacgactcacgactttgactactacgtactcctactacttattaatcgatcgatctacgtgtggtgtgtgtgcaaggcgttgacgtaggcgtgtgcatgcgcgcgcgcggccggggtcgtcgtctatccatacgtacgtggcatatgatccacgtgcatatggatatggaacatatgggcggccggatttgaaggagagccaagcaacacatgcatcgattatggcaatatatagcatgcgtgccatatatacagaacgaggggggtcgaggaaattgtcatgggagaaccgaacagactagcttaataattagctagcatgcagcccgcaacacaaaactttgttcatctagagccatccttctagagatcactggcttggactaacagtttactatcggcttccatctgtattctccatatgcattcctcttgttaactagcaaatcgtacttgactttggggtgattgctattttaattagcgcacgtgcgttctcagcacgtatttttctaaatatttcgttcaaaaaacttttattatttttcaaaaaaagttgtgagttgtgaacgcacatattatatatatatatatatatatatatatatatatatatatatatatatatatatatatatatatatatatatatatatatacacgccaaaaacatatagtctactagttataagaaccttaatagtactttaggtcctgagttcgactccccatgagagtgaactttccaggatttaacggcacagtgctgtcagtagcgagatgtctgtggtgactttgtcaatcttaaggatttgccagcccaatctttgaagatgctcatagaagcatgcactactagagaagtgatctttgctggttcaggcaagcgcctgtggtgacttcgtcaatctcaaggatttaccagcctaatcttcgaagatcctcataggagcaggcactactagagaagtgatctttgctgggtcaggcaaaaatcacaatagtcccggttcgaatagtcgaaccgggagtaaaaatatcttcactcccggtttctttgctgggtcaggcaaaaatcacaatagtcccggttcgagtaggaaccgggagtaaaaatatcttcactcccggtttctttgctgggtcaggcaaaaatcacaatgtcccggttcgagtaggaaccgggagtaaaaatatctttactcccggttttaaagcctatgggtaaagatggttcaataattgctaggcccctaagggcaagtactatgagcctctacacattgtctctaaatttgccacataagattagatgatgaggtggaggagagaagttaggagagagagaatgagccacccctcatgcaaggggcaacctctacacaatctccaagaaaagtgcaagatgatgtgagagtggactaatattggggtttgtgtattagatgtgatatattgtatgtgttgcctcttaattaatgagaagatgacatgatctaaattagatgtggcatccacctccactataaaacttgccctaatgagcccctaatgagctttaattctagttgatgttaccaaccgggagtaaagatagacggttgatcataccaaccaggagtaaccggttcaatacttgctaggcccctaatgagctttaatccaactaggagtaaagatagatctttatcccggttgatgataccaactgggagtaaatatcactaattcccccgtcatccccctctctcgctctctctctcgccttatctcctcgtatcgtgcgcactcagcctcctctttaacttctttctactcctccactccgcctcctcctctcttatccactcctctctttcttctttccttatcttctttcttactatcttctcttcgtcggcgcagtcaatggtagacgcccgggggcgcgtggggggcagcagtaggtggcgggcgcgccggagggaggcggcgagcggcgggcccgccttagggaggcagccggtggtgggcgtgcctggatgggaggggattgatgattttttttgataattttggggatgattttgtgatgtaaatttgtgaatgatttttagatgtttttgtgaatttgttgatgattttgagatgtaaatttgtagatgattttagatgtttatgtgaagttacggatgaatttgtgatttcaattcatgcatgatttttgtgatgttttttttttgtgtggatgattttgttgttgtgtttggtgcgaaatcaatattcaagtagaaaaaacaattaaaaaaagaaaaagaaaagaaggtgacagtcacatggcgctaatatttttactcccggttggtaaccctaaccaggactaaagatggacatctttagttctggattcaggatcccggtttgcaatccgggagtaaaagggttgcaaaccgagactaaagcccacttctcgagtagcgagggtttacgtgcatatattcataggggtgagtgtgcgtgtattgtactgtgtactaaaaaaattttgagtcagcgtcgtctaattggtagtaattaatttgttcgtaattctccgtaatcttcctatctgcgacttgctgaagtggatcaaaaatcctactgggcgcgctgggcgatcagggcgcgatcctccctcctccacgtggtttccttttttggcaccgcattactttcctattttagtaaatttatgcacctaaagtttgtacaccttaagtttacacatctaaagtttatacacctaaagtttagagacccaaagtttataagtcaaaagtttatatatcagatttaaatttgaatttgaattcaaatattctttatatatagtatttctatacatttaaagtttatacacctaaagtttatagaaccaaagtttataagtcaaaagtttatatacccgatttaaatttaaatttgaattatatacgattcaaatttgaacttgaattcaaatatttttttatatagtatttctatacatctaaagtttatacacctaaagtttatagaaccaaagtttataagtaaaaagtttacatatccgtttcaaatttaaatttgaattcacatattttttatatatagtattttatatacatattttttctaactttatttttattttttttaaatttatggtgcagtagaaaaagaagaagaagaggagaaagagagagagagagtagcgtatagggggatagggggtgatcgagcggtcacccgtccgttagccacacccgaagtggatacctacatcgtacaggggatcgatcgaattaagatagatttatgtggaagcggacaaatcaactaccactactaataaatttgtttgttttggcgttttgggagatccggagataacgcacccaccaaattaacctgtgttgtcccctgtcagatgccctcttgccggttaaatttgtcttttctaataggagtatctagttgaggggctaggatcgatcgacatgtcatctttatctgttagcctagtttggattatctctggtgtgctttaatagcatgtttatgagatgaacaacatggcgccaatgttaaattgttaattagacatagataagcatcccacgtatgtaaacattattctgagtaaggggatcatcccccattaaatcatgcttaaaactagtgaaattcacactttttttttgggtggggtggggtgggggggggggggttggttgtggtttgtaaagcgtagtaagcaaataccgtagttaggttcgtgtggcatattcctgtagtttagacatacatatgtgggtctgccattctttgcttgtcgccttgtcggttacaattaaaatttaaactttcaagcttaatcctaattttatagttaattttaaagtttaatttttcattgcttttattttttaagattagcttttaaatagttgagaacacacacatatataattatccacaaactatttgttgttgttctattcatttattcataattattaattattcgtgtattactccctctatccctccccaacaccaccacacacatttgaaaaagatgcaattgtaacattcaaattttatatatcaaaaatgcaattctagagtactaccttctctcaattttatatatctatgttttcttcattacaataaaccagcgtttttctatctctataatattgtatagacatttttaaaagtacagcaagcaacttctggttggcgtgttttcattacgcaaatgaaaaagacatattataaaatatcttagactatgaagtactttattgaaaatgatttaaaaacgccttcccaagaaggcctacccatatgagattattatcgtgaaattgtttgctgatgtagacgtagatattttaaacatacatattctcatactcttagaagttagaacatcagtggttgtacttatacatgtgttcattggtgtaactagactcgtcactagtagtaactatccctccatttttaagttatatgacgttgttgatttttaaacataagtgttggcgtttatttctgactaacacggactcacctaaagatttatggtgttaacggagtcgtcaaccatctcgatatagaaaactctaacctaagatgggttttgaagattaaacaagctagagaagctaatttagagatcaaaagcagcctttaggccgatttaaatcgatttggagataaccaccctgtcagggttatggataccacatacctaatagtagttgactaaatctcggcaggactgtagcgcccgttccgtcgtggcgcctagcgggaaaattatctcttaaaaaccctaattgcgaaatttgtttctttgctgttgtctagtgtctgtgccatctcagatctcaaatccccgatctatcgtcgagttcaattccgaatccaatccttccaaatcaaattcctccgcaaaagtctatttttcctccccgg

SEQ ID NO: 61858 - DNA, 1462 bp, Oryza sativa
gacattgccgcccttaaagccctggcgccctccctctcttctcctcccatcgtcattgttgccgccgtcttccgagctatgtctcgcctccgccgttcatcgccaagcgccgggagagccggtgcgttcgtggacgcggaaggggactccgggcgctcgtcttcctcctcttccccggcccgaggccggagagattactcccgcgccgtcggcctctcgtcacagcgcccctcctcatctcggtagtgcctccctccgttcttcctcctcgctccatctctcctcagttttcggtggtagcacgagtagcctccccgtagctagccggcgccgccccgaccgttgccgtcgctcgccgtgtgctcgccggcatcgccgcccgagctccgtagcacccgctcgtcgccggcctcgctcggcgtagctccgcccaatccgacgctagcaacggattcccgtagccgcgtagatgctctctccgccgggaattggcccctcgtgacctagtcgccgtttcccccttttctctccgccggttgccaccgccgcaatccgccggcgatggactccctccggcgaatccaagccgttggctcgctccatctcattctccctcgtcatcccagtgtacgccccgtcgcccctcatcgtcgcaaggcgccccggagaaaccgccgccgcccgccgtccattcgcggccggcgccttcgtcttcctcccgccagcccacgtggcagccacgtagacgccacgtcggcgccagctcggccgagatcgggtcgggccgaccccggtcagcccctcccgtgcgcgtgttccaccgcgagccgtgaggctgcgcgtgggcccgccgcatccgttcctccgcgaaccacgcgcgtgcaccgcgtcccagccctgcccgcgcgcgtgcgccgcgtgctcgctccgcacggtgaaccgagtcaccgacaagcgggtcccacccgggaccgcgcgccgtgagcccggtccaccggctctctctcctccctcccgcgcgcgcgccttgggccggccggcccatttagctcggccagaccgccccaattctctcgggccgcgccctagccaccgaggagaagtctatattccctccctcttttcttttcttttcttttcttttccaaaaaggatttaattaaatcctttttcctttagaccaaaaatccaataatcttagaaattcaatatcttcccaaccgtaaatccgtttgactccgtccaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctagatctcgagcaaggcaagccacctttgaacatcttgagcctatatttgaaatttaattatg

SEQ ID NO: 61859 - DNA, 9357 bp, Oryza sativa
atcgcacttaatctgttgtcccgtctgcaaggcagattggcggacctacctaatttgtttcatttgatccttcctttgttaattgttatatcatgtccccttgtaaccatctagttgcgtctcgatattcgtgcaccctgtgcgagtatcgacggacgccttcaaaacttaaaatctgattaacaacttgggtaaaacttgggttttacaaaagacttggaaaacccgacacctgggtcggtgcttgcgaactaaatgaatttccaaaactgcggaccggggaacgtaccgggtgtacggtttcccgctcttgcacttaaggaccgtttccttggaatttcatccaaacataagacaagtacgatcacatgggtggaatgggacacccctggctgagtaactagcttatcaggggagccttgatgccgagagacatgtggattcgccggggtggtgtcggggaggacccctgggcttcctggcacagtatggtctaggacctaacctgttgttggtctgggacccctctcgtcggcatatggtaaacctgtgtcggctttggaaataccttgtcatgaaagcctggaggtctcccgacgtggctgatccccacgggctgggtgatccgagttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattactgttgaggaaaggggttcgatgtttgaaaaatctgcagctgatgtgatcagctaggcccgggtggccgtttgaaagttgttggcccgggtggccgtttgaaaagctattggccgggcgccaaccttgtttcaattctaaggactgatacattgcacatactccgaccggacgagacgcactgtctcatccgtgtcgtttgagaagcactcacttagttgttttcagaaagtagttcaaataaaatttattgcaaaaacaacagcctttctttgaagcctgcattaaacacttatttcccatggcttgctgagtactcccgtactcacccttgctctatataaataatcccccccagttgctgaagaagatgaagcggaacctgctgatgaggagttcttccaggagcaagccggcttcgatgagttttagggtttcggcctagttcccaagtcgtgcctgtgttgattggtccaagtcctggcttccgttccccttttgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagtccggggcgtgacaaggacccaccacataccatgtcctatacggaaacaacctgcggatctaggaggagttccggataagaaaagacaaccagagttctacatggaaaccacaaggactactcggattgtatccatattggtttccctagttctacttggacaatgggacacctatgtgtataaatacaaggccccctaggaggagagaacacacaatcaacagacaatcaacagacaatcaacacccaccatggaaaacacccaccatagaagaaacgtacaatagatcaagacacaagatcaacatacaagccaacatacgccaagacaagacgccggatatcgacttcagggataagcacagctagtcccctacggtgtctccggatactgtcaggagagacgaaagcgttatctctgatctcgccgggcacgaacttgaggaggaagactaccctgttgtcgactacgagtcagaccttcagaccgccatgtcgacaacagttagataggctaccccaaatattacactggtgtgattatgtaacgtcccgccttcccccaggccgggcccgcttatatctgatagctttcataggtcatagactgccctcacagaccaacacatatcttttctgcacactttgtcctcactcgtgtgcacccgggaagaatttcccggtcggtcacccatcccaaattgctccaggccaagcacgcttaaccctggagttctttggagattggcttccggaaaaaaagttgcaatttgttgatatgagtattctattaatcctattaagccctagagcgggatgttacaccctcacccccttaagagagatcgacgcccccgtcgatcaaccctaggccaggaacgatcgacgcccccgtcgatcaaccctaggccttggccacgtccatgtgtccagtgccagcgcatgtgccatactgtgtaaccactcccggtctacaccagccatgcgcaccatgcctgcgcaactgcgacaaacgcgcccgtgaaaccgcgagagtcggctctgataccattttgtaacgtcccgccttccctcaggccgggcccgcggtcggtcacccatcccaaattgctccaagccgagcacgcttaaccctggagttctttggagattggcttccggaaaagaagttgcaatttgttgatatgagtattctattaatcctattaagccctaggccgggatgttacaccctcacccccttaagagagatcgatgcccccgtcgatcaactctaggccaggaacgatcgacgcccccgtcgatcaaccctaggccaggaacgtcctctcttggccacgtccatgtgtccagtgccagcgcatgtgccatactatgtaaccactcccggtctacaccagccatgcgcaccatgcctgcgcaattgcgacaaacgcgcccgtgaaactgcgagagtcggctctgataccattttgtaacgtcccgccttccctcaggccgggcccgcttacatctgatagctttcataggtcatttttgtaacgtcccgccttccctcaggccgggcccgcttacatctgatagctttcataggtcatagactgccctcacagaccaacacatatcttttccgccttccctcaggccgggcccgcttacatctgatagctttcataggtcatagactgccctcacagaccaacacatatcttttctgcatactttgtcctcactcgtgtgcacccgggaagaatttcccggtcggtcacccatcccaaattgctccaggccaagcacgcttaatcctggagttctttggagattggcttccggaaaagaagttgcaacttgttgatatgagtattctattaatcctattaagccctaggccgggatgttacagattatggtgaataagagcaataccggcttcagccaacaggatgtagggttattacctgacaattcaggggcccgaacctgtataaaaatcctcgtctccatctcttttacctcagtctcgcatatatcctagtaccgacgatccccataccatgtaaataccggaatcgcgacatcaaacgtcgacagtggcgcgctaggtaggggattttggtgcttcaggatttcgacgatatggttttaagagatggattctccaacaacaagctactcgatgacttcggctgagggagagatctaatccgacccgagtatgtcccccgacaagatcagaatcatcgccatcaactactcgatccgacgagatcgatcaagcttcgaaatgtcgcagcggcataggaccatggtatcggtggcatccaaaactgatccgacaccaacccatcgacgtgcgggacgccaaccggtgggaggcatcggctggccgggtccaagccagactcggcatcgatctccatcaacaaaacaagcacgtcgaggagttctgtagtttgggctagaatcaaatttctagtcgacaaacctaactactcgtcctgatgacgcaggctaatagcaacgagacatcgatccaacaaatatgcctgctcctgacacgtacagtacacatgcatatgcatggagtcagtacgtgtccagccacccatgatcaggtatttagtagattgagtttttaaaattgatctactaattccgtagatatatccggcatatatctacaaaggtatacaatattttatatacaatttatcttacctatttttccaatctatacaatattgtcaaataaataatttattatgtttacctagagcatgtcttttatacaatatctattgtgcaagtgtctctgatgttaaatcgacaacggtttaataccgggggctcgctctattttcttcagtataaatcatgcttgtttacggtttacataatgtgtgatatttaatctgctcgctatatcctgataatactagaagttcatgcagttttttgagttcatactcgatattctctgctatatatcttgtcttctagaaaatatttttcaggaacaatagatcactcgagtaggttgtggtcgagtacaccgtattatcgagaacgatctcgacaaatgcagagtcgtcgcgcccaacctaccaacgaagaccgacgacctatctcatcgcaccggccgtggctggactatttgagaaaaggttgttgacggataattcgtcatgaacgttgtcggcttgatcactcgatatgattgcgaacggacatccggatatgctataagtttggtatgtgagtcatgctggtcacatgagatgcacatgtaataaaccaactctagcgttctcgaaccagtacgtagcaatctcccgcaccgcaaacttccattggtgttcgagagatgattctactcgctcgctggttctcgaaccagtacatagcaatctcccgcaccgcaaacttccattggtgttcgagagatgattctactcgctcgctggttctcgaaccagtacgtagcaatctcccgcaccgcaacctccattggtgttcgagagatggttctactcgctcgctggttctcgaaccagtacgtagcaatctcccgcaccgcaacctccatgggtgttcgagagatggttctacttgctcgctggttctcgaaccagtacgtagcaatctcccgcaccgcaacctcagatggtcgaggtacgactacagcaataacgcagcggtcctcgtactacgacttcaaatgatcgagagacacctactcactggtcctcaaccagtcaattgtagcgatctctcgtacatttacttctagtggttgagttacgactactacctggttcttgactagaggtgtagcgattctcccattacctctacttcaacaaagttgatatcaggtgcataatatcgccaggtgttttacccagagatcccttaccacaaaagacacctagcgttgaaacatatcctaatgtccctttacgccgtcttgacaaaacctctgaggaacctaagggaacttcggctggggacacccagagcggataaggctttgtcggatccttcagagacgaaataccatgtaagatctggtcgtgtaagagttctcgccgtacgtattaatcaagccgtgtaatcggaaatggattttccaacttcacggctgggggctaggatcagtgctcgtccaactaaggcaggtcaaaggtccaagaaccttatcatccgagaacgattctccgacgacaaggctgggggctagggagagtgtataactcaacaaactgactggtcgaagtcggtaaaagagtagacgctcatatacaaaacattggtttgtaaacctaattcattttcagttttccatacattctataacatgttaccctttgagcactcgctcgggggctatttctatctaatattcttttctgaatattgatttcaggaaaattctattcggcattatcgaagactccatgtctctatggctctgtacgaagatcgactaaggcgagtacgataaatgttgacaaagctccgtcgcagtctctgcgccttctcgatcgctcgagaacggttggtagataccgacaaggaatacaaaatgaagaaatggtgtacccgccgagataaaatttcttgacttcaatccaaattctcgattacagcaagacgggagacttagtcgtatgctctgtactttcttggttgacgtcggagattgactcagacaaaccctttaggtgcccgcacgaggctgataaaggaagtcaaacgttatctctaaactcaccgagaacgatcacgtgagctcggtaacagttcctccaaggtctgcggttgagaatatgaacctgttcatttgcattgaagtcgggggctactgtcaggattatggataccacatacctgatagtagttggctaaatctcgacaggacccaccacataccatgtcctatacgaaaacaacctgcggatataggaggagttccggataaggaaagacaatcagagttctacatggaaacgacaaggactagtcggattgtatccatattggtttccctggttctacttggacaaggggacacctatgtgtataaatacaaggccccctaggaggagagaacacacaatcaacagacaatcaacacccaccatagaagaaacgtacaatagatcaagacacaagatcaacatacaagccaacatacgccaagacaagatgccggatatcgacttcagggataagcacggctagtccccttcggtgtctccggatactgtcaggagagatgaaagcgttatctctaatctcgccgggcacgaactcgaggaggaagactaccctgttgtcgactacgagtcagaccttcagaccgccatgtcaacaacagttagataggctaccccaaatattgtactggtgtgattatggtgaataaaagcaataccggcttcggccaacaggatgtagggttattacctaacaattcaggggcccaaacctgtataaaaatccttgtctccatctcttttacctcagtctcgcgtatatcctagtaccgacgatccccataccatgcaaataccggaatcgcgacatcaaacatcgacacacccgttttatgggccaatcggaaggtttacgagacaaacactctcgtagcaaaggcagatgatttacgacgtaaatagacaaagacatatgaaactagggtaaagtagaaaacatggttggaaagtagaggtaaaagaacgattcgatatattgtaatgattgtggtcggggttagagtcgaaatggcatagcctttaaaaaagatcaattaggacttaagaaatctcggattcaagcaaggaaatacacaaaattgtcttaattggacttggactcagggccgccggtctagctaactggccgaacaactgcggtctgactgcccttgtgccgccggtcggaccaacctcgtgccaatgatcagactggccccacatagatggcttgagtactttttaaatctggccatgttttcctatttttcttctagatgtcaaatttaggtgttaacaataagtttgatattttattttatgaaaatgattatatgaatgttatttattttattatgatttggtctatcaataaaatcactttaagtcttgcttatattttttttaattctcttttagtaagttaagtggcctaccatatgtttaaaagttattaatcttatctatatatctagaaatagaagtagtaccgactactacggagtagtacaagtccatgtacacaagtgttatactccctccgtcccataatatgagggatcttaacattttcttgtactgtttgactactcgtcttattcaaaaattttttgtgtaaatataaaaaacggaaagttgtgcttaaaatattttagataataaagtaagtcaaaataataataactagcctggtggcccgcgcagattgcgcggctagcatcattatattttctctcatataatagcatatttgttttctcattatattattcaaatatattaaaatgacaacataattttaaattttgcaataactttataaaactactaatgtgtaatattcatattgtattttatatacgtgttagttattaattatttttaataccaaattttagttatttgtaaattataaatattcctatatggactttagactcgtcttttaatatttctttttttaattccgattttttttgtaaattatatttctatatagactctatgctcttcgtccaatattatttatttttatttctgaatttttattatttctaattgtatttctatgtggattctaaactcatctttcaatattctttaatttttaatttcgaatttcagttattttctaaatgtatttctatatggactctagtctcctcttctaatattccttatttttaattccgaatttcagttattttctaatcatatttctatatagactctagtctcctcttctaatattccttattttttaattctgaatttcaactattttaaattgtatttctatatgaactctagtctcctcttttagtatttcttatttttttaattccgaatttcagttatttctaaattgtatttctatatgaactctattttttctttttctccgattaatgtgagaatttctaggccatgagagcgaacgtagaggtttttttttctattcctttaataatataatagataattttaaattttttttaataagacgaatggtccaacagtgcaagcaaatgtaaaaatctcttattttaggggacggagggagtaggaaaaaagaaaatgtacggtacagaatacagcaagctctctggccaaagagggaagaacagcaagctctccgtactacagaattactcactttgatgaactataaagtcgcatgtacagatttaatttgcatgtacaaatgagcacactttgatgaactataaagtcgcttgcaccttatatatatctccctagtacacctaatttacacttgcacaccgtatacacttggaggccgggagcagctactacacatatactactgcacatataacgttcagacttcagagtttcagacaacaggtacgtacctgtctgttgttcagtaatcacacggaatcaaatcggcctcatcatcacacagaaaattcaaggtatatctacgtactttgggccagttatcgattgggacaatcagctactagattcggtcgcaatatgtcctccgatcatccgatcatcgtgacgatcgagacgacgacggccggcatgctcgcgcgcgagcagaagcagcatcgatcgtacactagctggtgcagctacatgatggcgcagctgtccgggtcgttgttggcgtactggtggtgc

SEQ ID NO: 61860 - DNA, 1371 bp, Oryza sativa
attgcaaatacctgtagccagtatcctctggatgctgaaggatgtaggcatattcttctcttctgctaaccttcctcaagatccatatgcttaacctcaatagtggcgataatatagtgttgcctgctagaacctgtggggtaaccagaagttatagactggatttctttctgaatattgccatgttatcatttaccggggtgaagccgcagtttgcaaatgaggatactgctgtgaagatggaaaacgtccatattttgatatctttactcttcaggagttgtcttgtatctgagtcaatctgagcaaaaataataatgactaaggagctgcaaacaacagctgctatgaagtagcctgtcactatatgagccaacatattgcggcacttctgtttcatggttctgcttccctgtacccagttaagtgatatggttgcttctgattggaagccttgtgaactattttgattgctatcatttacagcatcaaaggattcaatattccttctcgtcgaaggtgatctttttgggaggacttcgtttgtgttggtctcagcattgttgaagtgcagcgccagcattgaaatggatacttctcctcccaatatcatcagaagtattaacacccagagttgctggttagaaaagtcttccatctctactgttgccatgcttgagactgctgctgtggacacagaagtgaacatcaaatccaggtcccttggagttggcttgtgtcgtggcttgaggatcttcagagcaaggaaaccaacaaaggatattgagatgaagtacacaagttgaactattaatggattgctttggaacatgaaaaaccagaaacagcgtctgaagaaacacactgcacatttggagagggaacgaagcctcatggagataaacacatggaggtgcttaactttctctgtaatgtccctaaccacttggaacttgggctgtgggattttcatggctaatggcagatgctgtgatgtaactaggattgaactgaatggatgcatcattggaggtttgtgggcatagtgttcagtatgctggagttggctactggaaggtgtttcttaggtttcaatgattctgtctttgccaccattgctcactgcaaccaagttctggatcttaatatgtaggatggtgtaagacagatgtgcccattttgcagaatcatgatgctgatggtgtgtacagggccccaacccaggcatgattggtgtatgcacaagcatgtgcttagaatattataatgcctaactactatatgttcttgagtgaaatgattgtcagcaattagaatccttcattcacattttttgagtcataagaatatcctcaatttagattagctgtt

SEQ ID NO: 61861 - DNA, 1027 bp, Oryza sativa
aagggagcacactggtgtgaagagggatacgagaggaatcaatccgaaggctctaattcgccggaaggagtttgacggcggaggatttcgacggtgatcgtcggcggtgagcaaaggggatacagcggaggggagacgaggattcaatccaaggcgacgaaagcatctccagggttcgagggactcgttcccgggctcggatggagcgaggggactacgagggaggctggcgaccagcggcgacctccgggagcgggcggcgacggcggccatgccgatcggtggcgccgctaggaattagctcctacgcgatcggggcgacaatgccgagctatctagcgagctaggagaggtcaagggatgggaacggagggactaccgtgtcgggaagaggcgccggaagatggccgacggcacggggcgtcggcctcaggccggggaagaggaaggagatcgagggcgcccggagtcctcgtctcgcattcacgcatgcaccggcctccgacgcgtgcgacgggcgaagagacgaagacaagaggtgggagcggcggcaaggcgtcaacaatggcgcgacgggtgtgaggcgagcgaaaacgagagaggaaggggtttggggtggcctgggttttacactgtttcaattaagagcgaaatgcaaaagttctatcttgttagtattgcaagtttatgcagcagatgttgcagtcatggcatagaacaaataaatgtatatatgactatatgagcacagagctcttctagacttatggtaatatacactgttagcctcttgcctttagttcaggaagctcagaaaaaacaaatcaagaggataccttatctggaacaagaaaacaatatatgctagctctgatcacggctgattattacaaattatccagtaatattgcgtgcattacagctgggttcttttttagggaaaacaacaacatcatgagcaggttcaaaggagccctgacaagaaatcctatcttactactataaagttatcctcactaactcctta

SEQ ID NO: 61862 - DNA, 1875 bp, Oryza sativa
gagcacgatgtagaacagcgcgcgcaccgcattgtgccgcagcgtgtccgcgtccatcgggcggcgtcggctcgccgcctcctctcccgacgacgtcgggttctcgacgtcgccgccgtcgatgtcggcgagcgcgacgtcgccgtggctctcgacgcgccgggatctgtccatggcgtcgctccgcagcttggaccacttggacgcgagccccacgagcgagacgaacacctcgccgccgaggagcatcaggacggtgagcaccacgagctggccgttggagaacacctccatctcgacggtggacatgctcgacaccgtggcggccgacacggcggtgaagaagcggtcgatgcggcgcggcgcggcgccgggctcccgcaccttgagcaccccgaggaggccgtagccgaggcaggagatggcgaggaagtaggcgacgtgcatggacaaagcgccgccggcgagcgcgcgccgcgacgtgggcatattggagcacgcacgcggccgccgtgtgctcgctccggcgcggccggtgcaacggctggctcggcgagcttgtggatgagctccggcgatcgatcgtgctgccgcgctatatatagtcgtgcggacgtgggaggctgggagctatggctgagcaacaaaataggccacgcgtcctacgtaccactaaccatttgatgtcatccaatttcgaatagagtaatactccctcaattctacattgattattatataatcaaaaccagaatttctaaactgattatcatatataatcatcctttcatttaagtgtggcattattgtatctaggcatgtaaatttagtctacatgcatgcatgcagttacaaatgctcgtttcttatgcatgcgagaaagttgaagtatgcttgtttctattttttccatcacatagtcatattaagtgaaatatagggaagttaaggttttcatgatcttgactaaaaagtttatataataattaatatagaacgaagagagtaaataagaaaaaatgataaagtatttcgttactctctccgttctgagctataagacatttttattttctgcaaagtcaatatttaaaatttgtgtactaatgattgaacctaaaatatatggatagaaactaaggcccagttttttagctactaactactagattatggcatgcatatttttaaaactcctaaagattaagattttctttttgaaaaatgttcttcctatatagaaatttcctctttgatgatattcgatcagtctgttagatatcttttaatttagacctctcatcatctttaatgatgtgcatttcttttcctgaagagctacaaaagcacatccaaaacatggaaattgtggaaaccctaagaattcatttcagaaagaaatagaatataaatgatatttgctcatatattccaaagacttgtgctattggaaaatatgtgctcaaatattcctaattctctatgccagtccgccaaaaagattatccataatattcttagtccttagaaagcgagacaaagaacactgaacattgtcttgaaaaaaaaatgtatacttggtactcagagctttgtggttaacctagcctacaaatttcctatgtttttgaggattttatctttttaaaaaattttaagacctacggccgagagttaacagatcgacttggtctgtatgattggatcctattcattcttgccttaggcttttacttaaactaattactccctatgctttttaatagatgttcctattgatttttttatacacatttgaccattcgacttatttaaaatattatatagaaatatgtaaaagatataaattatacttttaaaaacttagtgataaga

SEQ ID NO: 61863 - DNA, 7486 bp, Oryza sativa
ttttgagttgatatttccaccttcatttttcaatataatgacgcatctgctttgtcaccttgtgaaagagatcagtattctcgggcctgtgtacctacacaacatgtttccttttgagaggtacatgggcgttctgaagaagtatgttcgcaaccgtgctcgtccagaggcaagcatcgccaagggttatggaacagaggaggtcatcgaattttgcgtagaatttatcgaagatcttcgcccaatcggggtacctgaatcacgccatgaagggagactacggggaaagggaactctcggaaggaaagcaataatgacggtagacaacaatttattctgtaaagcccatttcacggttctgcaacaatcttcattggtagctccttacatcgaggagcacttggctctagttcacgccaggaacatcggtaagtccgatgcatggattacacggcatcacattgatactttccccgcgtggatacgacaacatctcatgggtaacgattcgatcaaccaacaacttgccttcctagcaaggggaccgtctgggttgattgcgacattccagggatatgagatcaatgggtacacattctacacgagagcccaagacatgatgagcacgaaccaaaacagcgctgttcgtgtcgatgccatgggacacgatggaacaactggcacgtattacggtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacacaagtctttttcatgaaggacatgtctagcaaagaaaaaaagggtagagggcctgacgagcctaagcgtcacgtggttctcccaggcaaaagaaaaatcatcgcagttaaggacaagactgacgaggattacgatcaggtggatgggcaaccccctttcacggtgacgattaaccctagcatcctcctatcaaatgaagacaccccttactcacgtagcgatcacaaggagggaccaatagtgaggagaaagtacgtgcggtcaaccgtcaccgccgatgtattgccgtaattattgtgtacacgatgtaaactattttggatgtattgattatccatataaatcaattgatgtatggcatatgttaattacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattataactactagagaatttttaaaagtttcaaatcatgcatgtggcatttacatatgttaattagagtttttcacaatttaatttactatcattgcatatgctaattatatatgactattcgaatttttaaaatttttaaatcatgcatgtggcatttacatatgttaattagagtttttaacaatttaatttaatataattcctatgctaagtatatatgatgattacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataatttttcgaagtaattgtcattaatctttgtactttaaataattgtaatgcattatcttctattttagaaacacatatgtaatggaaaataatattcaatgcgcttatcagtagtcctggttcttaaccctaaccgggtttaaaaagaatttggaaatagcgggaaaagatctttagtcccggttggggacatgaaccgggactaaagatctagggctatatatattcccgatgcgcgccctcgtcttctccaccaacacttagaagtttttacccgatcgatctctctcggcttctccttcgccgccactgcctagggcatccccgcgccgacaccgccgccgtatctcgccgtcgtctcgcgctcgtcgtcgtcgccgccgcctctgcctccttctccgccgccgcatctctggggtgagagccaccgcgcgccgcctccctctcgatctctctctccgatctcgatctctatctctccctctcggttgccgccggccgccgagtttcagacgccgacgccgacctcgtcacgacacgacgccgcgccacgagacaccgcgacgccgcacgccgccgccgcgccacgccgatgccgcgcgcggcgccacgccgccgccgctccgctgccaccacaccgccgtcccgctgccgccacaccgagaacgtgaacgagcgaatgagcgaacgaacatgaacgagaacaaggtgaatgaacgtgaacgagaacgagcgaacgaacgtgaacgagccaacgaacatgaatgagaacgagcgaacgaacgtgaatgagaacaaggtgaatgaacgtgaacgagaacgagcgaacgaacgtgaacgagccaacgaacgtgaatgagaacgagagaacgaacgtgaacaagaacaaggtgaatgaacgtgaacaagaacaaggtgaatgaacgtgaacaagaacgttgtcggacgaacgtgaacgagccaacgaacgtgaacgtgaaatgcaattataggcaggttaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagtcgtccctcaagccggagtggtagagctagccctcgaaggaattcgcccaggcaagtgacgtaattatatatatatgattgttatatttgtaatgcaattaagattattagatttataattagacttaattaacatataagattgtgtagtgttctaatatacgacagttacacttagaatacatgactaattgagttttagtataagattattggagttttaatataagattattatatttgtaattagacttagtatataattattgactagctagggtcctataatatacgtcacctagacttagcatatatatcactatttgagttttagtatatgattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacctagatttagcatatatcactatttgagttttagtataagattattagatttgtaattagacttagcatgtaagattgtgtagggttctaatatacgacagttacacttagcatacatggctatttttgtcttagcatataagattatttgagttttaatataagattgttaaaacataaatgtctcatgacttagcagatgtttcctgtatgaaagatggctgatcgcaatgatgaacagatattgtacgattcaatcgcggagggaagaagccagtactggaacgaagaagagggaaacgaggatccaaaccagtatttgaacgaggaagggaacgtggagagagatgcggaggggaaccaggaggagcacgtggaaagggatgtggaggggaaccaggaggaggaggctagtggaagtcaaccctccgttggacagaggagggcacgtgggcatgaggtgccgcgaagaagcttgagggtcggcacatcgtaatggaagtggaagaagatggacgacctagtgccccggcagaagccgccaagaactatgtacgtcacagcggttgggttgtgcgggataacgtgcctgtcagtacggtgtactggcgaagaacaagggcacgcggagatcatgagagctttgtcctagattcggagaaagagatgctgtggaccacaatgctcgagacattcacccttcccgcgggtacagaggacaaagtgaaaaagtggactctgaagaaaatgacagaacagtttcagagtttcaagggagagctgtacaagaaatatatcctgaaggggcagacaccgaacttcgacacattcccaaagctaagggatcactgggacgagttcgttgcatataagacagtgaacaagggcaggcgatgatggaaagaaacaaagaaaatgcagccaagaagaagtaccatcaccacttggggtcaggccgctatagcgtcgtgatgccgaagtgggaggagatggaggctagcttgcttgagaggggtatcgaaccggccaccgctaattggccggaacgatcgaagttctagtactatgcttacggtggaacgctcaacccagctgatggctcactggtcttcggcgatcagatacgagaggctgcgcgtcgactaacagacgcagtggaagcctcttctcagggcacgttccgaccagatagagagagggacgagctgtcactcgccctgcagactccagagcatccaggatgaacacgagggaaaggggtgattccttggaagattaggttcaaggaggacatccacacgtacaagagtcggatgaggagcaagagagataccgaggcgaagattgcagatcttgagttcagggtatcgagctacgagctcagcatgcaagaggaggtggcaaggaaggttgatgaacgcatggccgcacatcggtccaatgatccctagccgaccattcctcctgcaatggtgagcccgtcaggaaaccgtagcagctgcgcctcaacggggcaggtaggatcacagagcatggacgccatgcaaacccaggacgaatccacctgccccgttgatgacatcactcaacggacaccatgtgagctgcatattcctttcaagaacttatcaataaaggtaagctcgtagtttatatattttagatttgcccattccgctagttgttgcttatatatgttgattactaataaataacctctcaccacatgaaggtggcgtcgggcatagccatcccaacggacccttcaggtacttaccactgcaggccgattccagcaggatactccaaggtcgaagttgagttggtcgaaggaacgtacgtggacctcaagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccagcaccgtctccacctcaggctcctgcaccgactcctcctcaggctcctgcaccgactcctcctcgagctcctacaccgactcctccgcaagctcctcttccggcaccttcaaagtcaagggccccccaagctccaccgcctgcccacacaagggcaacgaagaaggcgaaagctgacgccgccaagaacaaggacccggggtacgattgcacgcaagaggagcttgacgcttacatggcatcagaagtcaagagacaattcaagcctcgaagtccagaaaagaagattcctatagacccgagtgtcatgaacttcttcaggggtatgtctgcacctgccaaggaggccattaagctatcggactatgagcgaacgctgaagaaagcatcttctggaaagtccaaaccagtccctcagcttggagagcaaccaaaccaggagattgagccgttagtgaccggtaaagaaatgacgatagaagaatttattactgacaccggtctaactacggatcaattgctaggagtcgcaccaatcgaaaaggcggaagtgaaatacatgtacgaactcggtaaaccgcttgtcaagcctgagctctgcagtccctacccacacaaatgtacaagttccatcagctgtacatggagatgagcgccactggtagagagatgatcggagcgaggatcagggacatggacttcttgcaaggagatgacattctctggatcaatttcaagggaatctacgaactataccaactggatgccctcgacgtctctattatgagttgctggattttgtaagtatatcgttcagatagattcttaatacgtctcctttaattaattaggtccttgtatataagtagactatagaaaataatatactcccttttatcgctgtagaatggagattcaaaaggcccgacggcggggagttttcgatactggattcatcgaccctcggaaagtaaacgtcgcaatgctcgaccaatatccgcaagccacagaggacaatctcgtccatctcctgaaggtgcagcattacaagatgttcatactgttgccctacaacacagagttagtttaattttactgtcttcctataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagataggtaccgtcataagttcctctgttaattaagaaaatcttgttatgttaattgctactacgaatcatagctttaaactccatgtagggcttggtatcggttccgtcatttggattcatcaacgaacaaatctttgatcccaagggtgaattctactacgacggaaacacaattcataggtccttagcttgtgagctagcgactactacatcgaaatcgtagctagctaggacatataatggattgtaattaatacatgactacatatgtttctatatgcatgtgtacacattttctataatgtaaatatattttggtcatacacacacagatgcatttgcataacatatatatgtataaatacatatatattatgcatgtacatatgtattgaaacatatataaatataatataatatatatatgcatatattatatatgcatatatgtactgaaacatatatatgcatggtttatatatatataaaccatgcagcaacagggccatgaaaaaaaaaggtcagctcgatctttagtcccggttggtaacaccaaccgggacggctgagacatctttagtcccagtgggggttaccaaccgggactaaagattgatcgttagttacggttatttcacccgggactaaagataacgatctttagtcccggattggtag

SEQ ID NO: 61864 - DNA, 1203 bp, Oryza sativa
tcatcgccatggatgagctcaaactttggatacggctggggcggtagaggctgtgagagggtgggcaagatcaatttgagtggcgggaggccacgttcgaatacttaccggcgaaggattggcttgaccgcggttgaaattggctggcgacgtgttggcgccaatccaggcgcgacgcgcggcggcggcgagggtgaaaatggctggctcaggggtgaatggtttgaattgtgagaggggaaaccaccgtctatcttcaattcaaccgtgcggcaaaaattggcgcgattcaccccggatagaaacaaaatcgcactcggcggcggcttggatgggagcgcacggcgtcgagtgtcgattccttgcggcggaggtcgtcccggctttgtcgtcgtcaagattggtgtggcaacggcgacttgaaggcgttggacgggtgacggcgcgccaagacgatcgggcacgcgcaagcggccccgaggctgacgcgcggcggctcggcgcgcggcgaagtcggacgccagggcggcgcgcgcaaggggaggagaaggtcaactaaaccacggtttttgagtgggatgtggtccccaaggatccaacatagactttgcacaagattgggtggtaattgggctgctctagctgggctgggcattttgtcgagcaccttcagtgcaatgaacagtgttttcaggaatttttgaatattttcctagaaaagaatgaatttaatctatgaatttggaagagtttcactagggtttgaagtatagcaaatcctcactaatattggagtaaactaagaaaatattctatagtttgagatttgagagaatttgttcaaattcactaaagtttggaataaagggaataattatggtaaattagtagggctctaaggaagtaatacttgaaccaattaaaaaatcaaataaatttttaaaacacactaaattaatcaaaagccagcatgctgcagtcaaattttaatttaaaatttgaggatgttacacatttctagatctctgagcttttttttttcatcgctaatggctaccggctgtgacgtataaaagctcaaaataagttttagaaacaccagcagttctgtatacgcaggttttcctaatgattcaaatgcatgttttttcctattagaagtctgttgacgtgataaacaacataaaggcggggctgcaggaa

SEQ ID NO: 61865 - DNA, 666 bp, Oryza sativa
ttcctgcagcccaaacaatcgaaatcctaaacaaaagagcaaaagaaagatcctatttagactaattaatagttccattggatagatctcaattttacggaattattggaagtggaacggagtcaatcggtgttacgaatcgggagacatgaattttctaaggattatttgattttctgtctaaaggaaaggaattattaattcccttgaaaaagataatggaggagggaccggaatcagacttttaggccaagcgtgaggcgcagcccaaggaatttgcgtgcgcggtcgaggcgagtgggtcggcgcgcgggagtgacggcccacggccgagcgaggcgcggcccaaacggacaagacgcgcggcaggaagccagtggacctcggtccacgacgcggggtcccaggatggggcccacctgtcggtggccaggttcaccgaggagaggttttatgcggcgctgcgctagggttttggtgggtgcggtttgcgcgaggtgcaccgagaaggccaaatggcggtgggcccacttgcagccgcacggctcttgtggaccgcgtgcaccaaagaaaagggacggagggggcgctgaccaatcttgctgacccggttgcgaccaatgtggcgccgacgtggcacctatgtggcagctacgtggactggcg

SEQ ID NO: 61866 - DNA, 3096 bp, Oryza sativa
aggagtatctggtgaagtggtgaccaacatagcataagtcgcttccaataatcatgtcatgccagttggaacacatacgagatacgacatcgcgggtcccgttggtatcgactgggtaactactggacatagtacaagtaggaccatataatgggatctagctacaatacgatcaatcaatatgcgcgccactagccaagtagccattgcacacaaaagaaaaacttttctggaattctgcgtgttttcataagcttgccgttcttctttacgtctgggattagtgatctagagtatacatcaaaggacggtttgttttccatctgtctagctatccacattacacattcatatactatactgctaattgtgcttagactaacactagatattgtcccaccaatacggatgcgataccaccagcaattattaccacaaagaattcagcgtcgacgctttgataatttggtctgttgagacttgagacggcgactgatagtgtgctaatagctccaataattgtataaagtatacgatgaatatataacagaggtgttgatcggtacgtatgtactatgacagtagctagagtttagtctttagtgaggacatcgttttcttgtattattaggttgaaatctaatggggaggcgagtggccagcaaaaccaactaagctgtgggcctgtggtgctggcacctccaaattgaagtcgttgccatctctctcaagaaggggcggatctaggaggattaataggagagtttaaacaaactatataaatttatagccccctcttctaatgaatgtatggcagaaaattttagtggggtctttatggggactcccatgattacaacacaggtagtgggagctcgagaccccatagaccccatggtggatccgccactgctctcaagtctcaagtggaggagatcgatgcagccgccgccggcgtgcggaggagggcttttactgcgcccggaagctgtaggtatcagagacagttcggttgtgtttagtttcactggcaaaaaaaattgtcaggtcacatcaaatatacggacatacatttgaagtattaaacgtagactaataacaaaacaaattatataatccgcatgtaaactgcgagacgaatttgttaagcctaattaatccgtcattagcaaatgtttactgtagcaccacattgtctgatcatgacacaattaagcttaaaagatgcgtctcgcattttacacgcaaattgtgtaattagtttttttttcaatatttaatactccgtacatgtgttcaacgttcgatatgacagggaaaaaagatttgccagtggatctaaacacccccttcctccgttccaaagcacaagtcggttggagcagctacaacaacagattataagtcagctatgaacacatatcgagataaaagagggaagagatgagtagcggactacagatttgtagtcagctgcagtacagactctaagacgcaatgtatatatgacaagtgggaccagacattaatagtgttgtatatgtttataggtaattattgtatgaattggatattaaactgatttggatctaacaattgactatactatttaaacttgctcttactaaaatcatacgaatagcaaatttattacggattttctcagctgatttctccagtgatttagattactaccaatgatgaacattatatcatagttaatgagctaagtacgccaccgatgaccatattaattttttcagttttctgacctggaccactaatgattgcctagtgtagagtccgtacacaaagtacacaacttcgcgtggctacccaaccataacgaacctgacaaatgtcgccactgctgctgctgcttctcttccaatctgcttatgcaatactcacatgattagcctagcttcacctggaccggctcgaatgctcgatcgctgtttcttcaaggtacttattctattatgaatacggtatgaattatgatcaggatcagctaactgaagattctgacgattattctacccttcttggccgggcacttgcaatcgacaagttgctgatgctctgacctcaacttttaatagaagtttttccaggaaaaataggcgaaaatgattgttttgattatcgaacattataatgactggattgcatggaatgtgttgcatatttgtaaattgtaatcggggatgcatcatgcatggaccgttgatcagaaattcagtgtcctttctgaacttgaaaggacgcgtatggtagtacacagtacgtgtccgtaagtccgttgtacgtactttctactagtattagcttggatggtatatgcagatgcatgccgtctcgagctgattaaactgctgcaactgtctcctacttatttccagtttttccctgaattattggatcgaatggtgtaactgaatactcgatctgtcgatcagtaaaagagagagcagtttattccaaaccggccatgtataagctagtgtacttgtctttactgcttcttctactaacgttgcaaggtagagttttggattattctggtaagtagtaaaaaccattattcagatggttttgatagattaaggggtgagttctgtctgataaatagtgataatagagacgaaaagcaaaccacataaatatagtagggactaaatacgaacatcttgctaactttaattcttcgtgcaatcccctgttggtagcatcctacgtacaaaatcgacgttttcatatgattctttcaatgacgcagccaaattataggatgagatcacgagattggctgtgtgcattctctcatgaatgtagaggccgagtttcttaatccattatcttaaaaatgaattataggacgagaattcgagcagctgattggttcctctccactagttgcgtccaataatgcagcgttttcccagtgcaatgatgcactttgttgactgatccaaatgtcgcctgtcaggcagaggattataccgatccaaggaaccactcacatggtcaggttgtacggctgatttttgctattgttcaatttggggaatttttttagggttagcctactca

SEQ ID NO: 61867 - DNA, 725 bp, Oryza sativa
  unsure (1)..(725): unsure at all n locations
agaggagtgaacctatgattcctgcaccctgccccttagctcttcttgttgctgcggctcatcccgatcgagaggtaacccacttgcctacacccccataaaaacgttcgttagccggttggtcaaatggaaacttttgcacgactgtcatatgaagcttagaggtaggagaagacatggcgatggcgaaggaacttactgttgcgtatggccggtgagacgtgcagatgatggtgattggagacgatgaaaggggaggagctccgagcgggtagaattgctcggggtcttcttgctgggtggtgtggttggacggagaagagatggcaagtatttatagggggatgagatgggtgagggtgagggggaggtcaattggttttctttaatgcagcattaagagtatagcagtactactactacttcatgtactagaggctaaggaaggacgcattttattaccaaggtattcatggctggagagtggcatggtaggggttgaataatctgtgttgggtgggagagaagtgcgaggtgagaggctttatggttggtcatatacacaaggcaaagaaatgtttttttttcatttatctgaaagaagaaaatttccagtgatgaatcttctctttttttttcttacttcngcggtagttttctttagccacatgctagatgactgtggcaatctcccaacaatgagcctggttgaaaattgtaaccca

SEQ ID NO: 61868 - DNA, 2130 bp, Oryza sativa
ctgcagccccagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccgggggatggagtacatccggtcccagacgtcacgaggctcaagaacgagggtatgttaccagttactctctgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaagatatgtaacagtgcagtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatagctcctcacaatttggcgttgcaggttggctagtttgttggttttcctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatatacatcagccaagccatcgagaagccacttccttcacgcggccagcaccccaccagaaggaacgaagtggacccaagaagacaaaggcctcaccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaagaagggagggaaaccg

SEQ ID NO: 61869 - DNA, 4646 bp, Oryza sativa
cacagaaaattcaaggtatatctacgtactttgggccagttatcgattgggacaatcagctactagattcggtcgcaatatgtcctccgatcatccgatcatcgtgacgatcgagacgacgacggccggcatgctcgcgcgcgagcagaagcagcatcgatcgtacactagctggtgcagctacatgatggcgcagctgtccgggtcgttgttggcgtactggtggtgcacgacggtgtgcgtgttcgtcgtcgccgccgccgccggcgggtagtacgacgacgactgcccgtactgcgggtacgacgacgactgcccgtactgcgggtacccgccgccgccgccgccgtagtagccacccgtggccatcgtcatcggcgtgtagtagccaccgccgctgccgccgccgccgccgccgcgctggtgaggaggagggtacccgccgttgccgtagtacggggccgggggcggcgcgccggggtagtagcggtacgggtactggttggcggcggcgacgcgcatgagctcgtcggcgtcgacggtgcgcagctccaccacctcggcgtggccgaccttcctccgcagcttctcggtgaggtcgttggagtccaccccgaagccgatcaccagcagcaggttcttgtcctcgccggcgagcgtcacggattccacacctgctccatcggttcacgcagaacaaattagtagcatgcagtctgatcagtctcatgcaccgtgattattacatcgattacagttaaattactattagttcttgatctctcaagaaaaatatcaccatctttttattatatatactttcgggtcgactctagagtatcccctgtgattattacatctatcatatagttaaattactattggttcttgataactcaagaaaagcgccatctttttattatatttcgctgaaatatgtgtttgggtgtgcaaggaatttttaccggagactgcagcagcaaccttgatagctttcttgtggcccttctcagagctctgcagcctgatgacaatttccttctgcaaaaggtttcaaacggtgtaacgattagcagcgggaacaaacataaatcttacatctttgcacaaaataacagatttttcactgatgatgaaacagagaaaaattgacagatgagcagcaagaccatatacaattacacatacataccctcatatctttctcctggtaagcaagcaaactaaagcaagcgaagcaacagctcaatatactactcttttccaagctcacaagcttaagcaagagagcgagccttgtgactagtgtactctaccttgcctaacacagcattctgcagagagagggagagaacctccctttttatacacacaattactagtaaactatccaataatctaacgaataaaattaacccggttagttaattaccttaatcgcccccattgactttagcggcggagtcatgcatgcacagcactgcttcactactgaaaacacgcatgtataatgtatcgatgtatatctctacggcctttgagagagcgacatgaattgtagactaggaagacctggatggcctcctagtagtttagctaaaatcagcttaattagtttgcttggagcaggtggtgacttactgactcggccaccctaattccacaaaaaccaaacgcccacttgcattgctcccgtagcaacgcgtgatttgcctcagttttccactgaaaaaattactccatcagtcccaaaatataagtatttttagactctgacacagtcttcgagatgatactttgaccaacaatatttattaaaaaaagatattttaaataaaaagaattgcatattatgatagtttgattaatgataaatctagtaacatcaattttacatgattaatttttttatttcttttgctattaatagttaaagttaaaaatgattgatttggcactatgttaaaaatatttatattttgagacggagggagtaagcagtaggagacaaggaaaacgttgtctaagctgtaatgccggtacgtacagtgggcgactaataatccttctcgtggttgtttttctcgcccggaatttggaggattcgcggtaaaaaaaaaatagtgccacggagctgtcagtgctcagtactgtcagtacttaattaattacaatactgggtaatgggaagtaaaccggctgatctatcagtgacgagtgagtgagacggacggccgagatggcgccgtgctgcgccgggagagctccgtcggccgttcgatcaggcgggtgagctggagaccgaccgggcaagcgttcgtagccggcaaggtgaaaagggcttttatgtggagatattcacagggatgacaggaggttgccgacttgcagggtgagtgaattgaacaatgaaacagcttaagtaaacacaatgttaaccctgacaaaaaaaagggttaaggcgacaatcgctacgcgacttgtttgtttcttttgtgcgcagattttggaagtggagctgtcagtgttgtcagttaattacattggagaagtaaccgatcaagtaagtgagtgtaaaccgttaatttttttggaaacatacttttatttttcatattttgtatttatatacatgtccaagattaacttacaaaaatatacccaatccgcatattagttgcacaggagcgccggtcccgcaggacaggcgagcgacaacacggtgatttgcatgcggagctctgccgcatattggatataagggaccgccgctcccacacatgtcttttcccaaattgggaatacatgtcccgtccaaaaaacagagcagtacattggcacgtgattaattaattactagttaattttttaaaaaagaaatggatcaatatggtttttttagcaactttcctataaaaactttttacaaaaaatgcaccgtttaataatttgaaaaacgtgcgcgcggaaaaaggaaggagatgagttggaaaaattaggggaataacacacgaaaccggagtgctcccgcatattggatgcgcgggactgccactcccgcacacacgtcctttcctaaattgtgaatacatatcccgcacgaaaaacggagtaatacattagcacgtgattaattaattattagttaatttttttttctaaaaatagattaatatgattttcatgagcaactttagtatagaaactttttacaaaaattgttccgtttagcagtcgtgcacgcagaaaatgaaggagatgagttggaaaaaattgagggaataacacggaataacacacggagccggagactggctcggtaccgtgtgctagaaccgcgggaccacgccggtcccgcatcgccgttatgcggtaccgccgcgctcaccccgggtccagacggcgccatcactcccgcgcatcggcgccgcggtaccgactcggtcccacagtctagccgtgcgggaccagctcagtcgcgcatcccggttccgcgtgaccagctcgagtctgcggttcgccctcgctcccgcacaatcattacacggattaggtatatttttacaaattaatcttacatacgtatataaatgcaaaatatgaaaaataaaactatattttcaatttgtttctatctttatcttatactgatcaagtatatgaaacatcaacaatggtcaaattgttcgaaaaaaaaaggtgactgtaacgggacggctgagatcaagccatcttgtgtcaggggagctcaccgcggccgttgattgatgtgattaagctggagaccgggtggtgagactgttttaagaggtgaaacagggtcttggaccctttttagatgggattaaaacttttaattccctatcacattggatgtttgacactaattataaatattaaacatagactattaataaaacccatccataatataatcttggactgattcgcaagacgaatctattgagtctaattaatccataattagcctatgtgatcctacagtaaatattctttaacttaaaaaaattatctcgcaaattagcttttatttatgtaattagttttgtaagtagtctatatttaatactctaaattagtgtctaaatataaagactaaagttaagtccttggattaaaacaccaccatgcttgagatgttcagagaataagaggaggttgcagtagcttgctggtgagcggatggatcgacagcttatctaaccccagtagtggtaaccactgtcaaaaagaaaaaaaaaagggaaaatggaaaattctaagccaactgaccgcgacgtgtttggacgcgacaccatcttccttgccgggttttccgtcttgagtagtgagctttaggctcgcgtcggcgcgtgacgtaggcgtgccgcactagcttccgtcatcagactctgtgttaagttgtcaacttatattatcagtagaaaaattgccagctcaaggtccatggggaggtggcttaattacaggcctaacgataacgatatacagctagcctcgacgcaattaaattggacgaagtgtttgaggtggatcggtgaatttgaaaggctctccgttggagaaatgaaaaaaaaaagaaacaaatcagttttgctctgtgctgttttgtctgagtcagaaaa

SEQ ID NO: 61870 - DNA, 2268 bp, Oryza sativa
gagagagaaaggccggggagagagataagatggagagagagctacacactgatatgtgggtcccaccacgctgagtcagcctgtcaaccgggtcaacaacgccacgtggacgaaaccgccagcaaaaccacctagggaggtgatttgctctggttttcagagaagaaggaggcattatacccggttttccgattaagggaagttattcacgcaagcgcaagagatgagggaggcaaaatggacttattcctcggtcggaacacttggtactcaggtattgtgtgggcctattagtgggccgaaagcctatgggcccagtggtttggaaactgctaatgcagatcgagtccaaaaggcctcgcaagatatctcaggctgtgtgtttagttcagcgcaaagtttagatttttgttaaaattagatatgatgtgactgaaaagttgtgtgtgtatgacatgttgatgtgatagaaaagaactgaagtttagatccaaacacagcctcaggctctaagcgccctgaatgtctatccattttttgacccataaacttacacgcttatgaatgtatatccatttttttttcggagctgttcgtgggtggcgctttgatctgtccgtggaaccagtataccaccacgggtgacgagacatctaaaaattctcattttaatttctccttattgtgatgtcagttatgtcaaacatttgagagtattttctgtattaacgtgtagtagaatttttctacgcaaaaaaaaaacctcctagatttttttgccccatgaataaaaaactcctaaattttctgaaaagagggcagctaacctacgggataccgtgaaaaagtgaagtcacgggacaatttttatgtgtgattaattagtgtacaacatgttataccataggtactaggtaccaccgtaccaggtatcacaagtattaagtatcaggtgtcacatgtattaggtaccaggtatcacagatactaggtgctaggtgtcacaggtatcaggtaccaggtgtcataggtatcaggtactaggtatcacaggtatcgggtaccagctgtcacaggtaccaggtaccatacaactgataccatactggtatcagctggtatcaacatagcggcggaaaagcgaacaccaatcaaaaagagaaagaaaagtaaaatctatgttacataatatcattgtgtcaattaatttacacaacatactaaatctcaatgtgtttcactcaagaaaagaaacaaagcaagaaaaggagaaaacaaaaaaattaaaaatgattgtggtttatagaagatgtaaatcaagcctacagatgtgcatgcccaaattgattcacatggcccaagtgcccaaccagtgtatctagagtccttgtgctgtaggaaggacacatacacgtggatgtgttgtggagtataggcctgccacttagtaggaaatcgtgccgcatgcatgtacaattttttttgatagaaataacatagaccttttaagtcatccccgttcctacggaatgcccgttatctaaattttctgaaaaacatatagtagaattttcttgtgccgctaattttctgcgtcgcgtgggcctaataatcggccaagagctgacgggccataacggcgtcgtcgcgcgaacgtgccgaatcggtttacttgggcccaaatgtgggcctagaaaggactgagacggtccactagggaggtgcaggcaaccttgccacattcagcccgagtggtcaagtttcatttctgcttaggaataagttcaccggagatccctcaacttaacaacgagattttttttgagatcccttaaccacaaaaccagaaatcttcacccataaactatacaaaaccattcactcaaggtccctaggcattatatatggttggtttcgctgacgtggcatcctagtcagcaaaaaaaaaattaaacaaaacacgtggggcccacatgtgatcagctgcacgtttgatttcttctcctcttctttttcctctcttccctcttctctttttcagtgaggaggctggcggcggccggagcggcgatggcggcgtgcttccgctacgcgccgtccggccctgcggggcccagcctggcgacctccgtctacgagaccaacctcgacctcgccgcgctgtcatggacgcgcacctccctcggcctctcactctgcgctgtgctccggctctcgtccccggccatccccgaggagaccgacggggtgaggcccgagaggaggtcc

SEQ ID NO: 61871 - DNA, 4033 bp, Oryza sativa
tactacctaagagatcagtatcatactgcgaatacagcggtgcatgcatcgtcacacatcatcttcaacctggcttgccgcagccgcgtcatcccgccatgccgctgccgtgtcgtccatcatgcgcttggcttgccgccgccgcgttgtccctccatgcccccggcgtgtaatagaatatcttacagtatgaagtgcctcagtccgaatactgcatcgccgcctcgacggccttgctccccttgcggcctctgcaacggcgggcgagagtggtggtgaaacaccggcggcgacgcgtcgatcgacatgaaccggccggcgccaccggcggagacaacgacggcgaggggggcatctgcaacgaggaggacgaggagcccagcgcgactgttggaaatcaaagctattcactcactcaatctcacaagaacacaagcgcatacacacaagcactcagaacacagagagtttgcaagtgcgtagcactctttttctgtttatttctcacactgaaactgattacattgatctctatttaaagatgcacataacctgcttaagcctaaagaaatgcaagaatcctaaataacaaactcacccatgtctaacagaatatatcctggtcaatctccgatgcatgcgcccatgcaaacttcgaccgcttcttgctcctgagctgatcccttcgccacatttgcatgcatggctaactaattagctagatgtactctcacctcctggcaacacgatcaaccactactcaatgccaatctctctactcactaagccatgcagcacaaccactaagctagcactcatgccatgcaacacacatacatgtgacttctactcagctactaccatacaaataaacatgctgaaaacaaaacaacaagattatacttctaatagcgacctccccaactgcacgctctctagcaggcagcgacgacgaggactccggcggcggcggcggatctcgtgtcccacggccggggcagggacgggagtagcagcagggagaagagaagagagaagagagaaaggagaagaaaagagaagaaaataatatatgcagctgatatgtgggccccacgtgctttgtttaatttttttttgctggctagaatgccacgtcagcgaaaccatccatatatactgcctagggactttgagtgaacggttttgtatagtttaggggtgaagatttctggttttgtggttaagtgacctcgaaaaatttcgctgttaacttgagggacctccggtaaacttattcctttctgcttatgatattctttttccccgattacacatgaaaaattcggcacacaccattacattggacctcacccttatgtcccttttaaacttatgaactataaaactgtggcaagtgagtgattgtctgattgattgcaatcctaataaagtgaagaaattttctccatattctccatataattcgaggctctttcgcagcgctgtataactgtgaggccggggaattcttggctgattctgctttaaatagtaggatcactcgcagtaggcccaaggaatgtactttctgtactaattatggagataacacttcatataacaagaaggttctgcatgttattagtccttgttttaggactttctgttaaccccaattgcccggaaacgtacaaagttaggagtacgtactgccagatatcagtatcagaaggtgcaaaacatgaacatggcaaccttcggtgtgatgtgaacccgttcgtttaacgaaacttccactcatcaaccagcttttacgtgacactaatcatcaccgttcaatagttccatttgctaaattaactacattgcttaacctatttaactatcggtgatatatttctgtcttttggtggatttgatgacgatgttgctagtagtcagcactaaactactcccccgttaaaaaaaaataaatctagaattgaatgtaacatatcctaatattatggatctggacagtagagattcgtagtactagattgattttttataggatgaaagaaatagtctatagatacacgtgcctctcagcttaaatagatatagtggagtcgttctaaaaaaaaagaaaagaaaagaaatgaagaggaataagaagaggaagaagaagaaaacaagagtcatagacaagaacctgtacctttcaacctatctggtctcctcactactctctccggtcaaaattgtttcatgttttggagaactaattaagtttagttcaattcaatatatttgaccaggggaaccgtcgaaatctcccgttgcgtctgtcagctcagctccacgagttgtattcctatactattcttcaaaaacgaaccgtataacatttgaccgtcctatttgactaaaaaattatgattaatattttctattgttattagataataaaatataaatagtattttatgtgtgactattttttatttttttcatattttttaataaggcggatggtctaactttgtacacgaaaacccacaactacacttaaattggaacggaggtagtataataatacaatgcatgtttgaaattatatactactttatttatttatttttatggtgattagcttaaaattgaactaaccaacggtcaaatatttgaaaaaaagaatggagtgattaactgattaggagcagctccagagtgcaattgtccagatcgattgcgaaatacacatctgctagtatgttggagattctgatccttccttttattttacaaaaaactagttcttgaaatttgaatagggggtgagacaatcacccaagtttagagtttactcccttgtacagaaatagacttcatgaaagaaagtgatgcacttctgtttgtcctgaagaagaagaagaagaagaagaagaagacgacgacttggacaagtggaatctatgattgttggtttgacttgaacaagaggaccacattgctgtaaaacattgaccagtagaagaccagctcctacgcaatcactgcatagtaatcgagatttttttacgcacgatctattcttatccagatgtttttattatgattcagcgtagaccaaaaaaaaaagcaaatactcgtgacctaatatcaaataattgtgaggcttcgaacccaggtcgtctagcctaccacctgtggaggtagccaaaaacctctgggtgtttctcagatttagcgtagaccagtttttaccgattcatatatttgaactaactgaaaatttcacatatatttgaaccttaactaattgaaaatttcacatatatagaaagtgtcctgttttacgagcctacccttcccaaattactttaaaaaatcatattaatccaacttttcaagtttaaaataatgaatactcaaataattatgcgctaatggctagctcatcttattttgcctatcttcttgatctttcctcttccccttttctcctaaagaaataatcacgtacataatatcaaatacgattaaaaaatacgcaatgcactcaatagtttgttgaatctaaaatcatttccacaataacaacatacacaatatagaatacagcccaaaaatacatatcaagttagaataatagcaaaaaaaaaaaaagaagaacaaaaaaattcagaattggagaagcggaaagaaatcaggtagccgcaaggttttagttctcgctccttactcatgctcccgtcgtcatttttactcccgtagagttcttcgcactacaaccaccacagctctggctcatgtggagttgctgcaccccctctgtcacttcgtgtcccgctccttactctagttccaactgccaccgctcccactcccgctccttgatgtcgctccggccgccgctactttctgcacttgctcctatgagaaactagacgatgtcccgcactttgttgcgggatatatatattaaatattgtagaaatgattaaatgatttggattgaaatattgtgaaaatgatttgagaatgatgcttatatttagtttagttt

SEQ ID NO: 61872 - DNA, 4621 bp, Oryza sativa
tatttttccagagacgatcacttaagatgaccgcttatgaaaacatgtgcatcttcagaggctgccatcttaagtcaatcgtctctagaaaatattccacatatgggtttatatacgttggctcctagtgtattgtagtttagggatatttgtgaatttattttttgagaaaatagtggacagaaaagaatacgtgccattgagagaaccgcacaaaacatgccaaattttcgtacgactgtagcatgtatggctaaacaatggtgcaggacgtatcgatcagctcggagcaatttataggtatgtcaccgatacgtcaattcacgtgacgtcattctttccaagtgatcgacttttgctaatttgacctctcgtggtcgtcatacgatcgaagctatcgattgcattgcttgctgattggccaaccatggattggcagattagcacattgaaagaaaatcgcatgttactgaacaatcatgaggacgcaatcatgctactgaacattatagtaagttttcatttccaattaagtttggatttaaacaaggcgaaggaagccccacaaagatatagtagtatagtatatctaccactcctactatttctttgtacatagccataccaaatcgctgaagaaatcactgcaaaattcgatcgatctgtgtgactatatatgattacatgatggagcaggggtcgctcggctggtcgccgacggccaccggtatcccaccgtagtggtggtggtagtagcagggatgagggcagtagcacggctccggcttcttctcctccggcttcttctcctccggcttcttctccttcacctcctccacctgcacgagctccgcgtggccgatcttcttgcggaggcaggtgacgaggcaggccgcgtcgacgccgtcgccgaccacctgcagccggtccttgccgtcgccggtgacctccaccgagctcacgccggaggccatcaccaccagcttcatcgccttggaccggctcttctcgcacggcatgctcaccttgatcacgatcttttgctgcaataattcgatcaacggacagaaattaagctgtcagtcgcatatgctaaaaaagatttggtcagaattgattaagctgcatgccaaaattaagcgaccacaatcgaacagttttcccctcaccttcatcgtgttctgcttgaaataaaatgccaacgagaaaggctatcggccgatcgattcgatcgtttgcaatgcggctaagatgatcgagcacgatcaatattcgctcgatcgctgcagctatttgcgattgtagctagctgagcttagccgtggaggagaaggccacgcctgggagctcatttatatagcggcgcatcgccatcgttactactagaccactggcatgagacggcgacgaaagagcattccgcgcagctactctggcacgtacggatcggaacgcgtcagctgtcagtttcagatttaagtctgggattagtcgcagactagtctccgatcggagcgtctagtcacgctgaatggctgagcctgggtgcctgtacgttctctctcgatctgtagtgtagacgaccagtcaacgacttgactaaattgggttcatggtcgacgaccctgaattaatcctgatgggagccgcttcgcgaaggcaaagctctgttaattccagcagtggctgccgcggccagttcagttcagggctaacagcaagcacgaagatacatgggatgatttcatttctacttcgatattgattttatccttattttcaggtttttatttttgtcctcacttgtttgaaacgaaggagacatctactcttgtttttgacggaatttagtggaccttgaattatagagctataaaacaagaaaaagaaggaatactgattttgtatttttctgttgaccttttgtaccctaggcagagaagaaaggaagggagccaggctccgacaccattaccccattcccagtcggaccacagccccatactgtgaataagccaaaggaagggagctccaagcagcggcggtgactctatgttccctcgttttccgcgcacatacttttcaaactactaaacggtgtatattttttgtaaaaaatttctatacgaaagttatttaaaaaaatcatattgattatttttttttaaaaaaaacaaatacttaattaattacgcgctaatgaaccgctccgtttttcgtgagtggtggcaaaacagccacctccctccctagcgaggcggtggcggcagcttcgctagcgggcggagcaaacgaccgtggcgacgacccgatgcggggaggaggcgacggcggcggctgctcggctggtgatggcggcagttcggcgcggagaggaggcggcggcggcggtggtagcttagcgcgggaaggaggcgatggcggcggctactctgccatagcgaaatttcccacccttctttccactcccacggaggctaatattggcctagaacgcacggcccaataggcaggagaagaccagtgggccaccttgccttgtccagcccgagtggtcggtttgggcccggcccaataaggaggagcagaccagtggaccacctcgcctctactggcttccagcccaaatggtagctacaaatagacaaacgcattggtggttttgtagaatgccgcggtgcattatctgtccattaatctgacgtttacgaactaaactgtggcaaagtgataatttgaaatcctataattcttgcataatggaaatgtttacgtcttcgtctttttcttaccgctgtaactgtgatatgaagccgacagattgttgcattggctgatgaatttagcagcaggccctgctgatcctacttaaatactactttctctgatttatattataagacattttgggttttaaatagatttcatatatggttatatgtatgtgttttatatacgtgttcaaatttatatagatattagtaaatctagacgaaaaaggaaggtaaaaacgtattataatatatcaaagggaggaagtatatgtactatgcgatcacttgccttaggccgaagggatgtactttgtgtaccaattaaggataagacttcatctaacaagaaggttctgagtagtttgagagccaattaaacaacccagacttcactagactgcagggtaattctttgtttaggacttgcctttccgaaaagcttgcttttgttgcacgctgatctctacaccgtagaaagcgtgttggcttttcgctagaccaagatgaaatcgttgattctttgattgcgtttgttcactgaattattgacgccattattcgtctgagtgctgcatctatccgtctttgttaaaaattttctggaggttagctgccagtcttgacactctctgactaccactctgacgcttggacttgcataattgagcgtgcaaattgcacaagacaacagagagaaaattggaaaagaagtacagagaaaaatggggaaaagtacaaaactataggtggtatgttacttccttgatcgttcacatttattttgtcagggtgtgatttaaattattatatccagctaaagatgtgtgtgtatactagtatatactaccagcttacagaactctcaacagaatcataaataagaaattgacgagacttggaaaccaacggggaaaaagagataacctaacaccaacaccatgtaaagagaagttaccttttcacacgcccagaaaatcagaatgactgactcatataatgcacgaagttggcgtaattcgttcttaaaataatttcttatggctaagtacgagagtctgcagcactaaaatctgttaagtgctctaagcactttctgttaacccataaatgcctggaaatgtacaaagttaggagtactttcagcaattatcccttattaagaagctgcaaagtatatcaaccttcggtgtgaacacgctcgcttaacaaagctgccacctcagcttctagctttcaataattccacttgctatgtgttaattaaattacttgactcatataactattgttggtttattctgtcttttggtggatttgatggtgatgatgtagtcaacactaaattagtctgaagatgcacacgtctctgaacttaagtatacgtagacaaggacattgttacaagctggaaaattgtttcttacaagggctgtgcctttcaacctatctgaactacttattactactagatgtcacggccatcagatagcagaaacaggcaagaaatggggtaggaatacgcacttttggccaaagtatcttggcgaaaacgaatcgtgtatatatatgtgcatctcatgacgaatggttttcaaacatgaagtggtaggtgtaggcactggattctactcgtattttggtagtcataatataatgtatctttgaaattatataaatgattaggagtgactctagagtacaaatgtcggtacacaaatacaaaatggttatgtccaaatcaactaaatatatcgtcaagtatgttggagccgttcctgttttttttatttcacagagactatgggtgtgtttagttccacgctaaaattgaaagtttgaaaaaaaaa

SEQ ID NO: 61873 - DNA, 6558 bp, Oryza sativa
tgtctctcatcccaaacaccacatatgtgtgtagaaaagtttttatgtgataaaaaacatgaaagtttgaaaaaaaaattgagaactaaaccaggcctatacctgagaatctgaatatctgaagacgatacagaaactattcctgggtatttgaatacctgcattgaatgctgcacctgtacttccgtttgtcctgaaaaagaaaagagactgtggaatctagtatggatgttggttttcctcgttgaatttttataggctcaaaggataaagaaaaaagaaaaccacgtcactgttaaatcgttgaccaggagaagaccatcccctagcctaagaaatcactgtataataatagagcatttttacccaccgtatatttttcatattcagatgttttttacatgggtaattttaccatccttgagaatgtacctagaggtgccatattttctagtgtaaaatttagtatcttaaggtacttaaaaaatttagtgtaaaattttgctacctcacgttactttcttaaggactgtaaaatttctcttttaacattcagcattagatcagttccttgcggctgggttcggaatctcgctatatatatatatatatatcttggagaggctccccatttttttaattctgaactcaccaaaaatttcacatatattctagtttcgtcaaatttggtcaatttttgttccccaaccgcttggaattcaattaaaatttgtctacactttgaatttctccctgcgagatttagattattacacgttctgggactatagttctcaggatgctaaatttttgtacatatgccaccctgggactatagttctcaggatgctaaatttttgtacatatgccgttctgggacacgttctgggactatttttgttcgaacaacgatatgatgcagccggcaggacgtgtcgatcgatacaattcagagtacatatttccacgtttgatttgtttacacgcacgttgataattgtgacttctggccctcgtcatacgtgagcagctaatattgattggcttggctagccatggatggcagattagcacatctgaaagctatagctaggagtagatgagatcgatcgatcacatgcgtttaatttttccgccggaaagaaaatcacatccgtttccgaacttcatgaggacgcaaaccagcattgagatgtacacacaccagtgtcgtagttcgatcattttcaaaagtagtactaatactttattgtgtacagccatccatgcactcatatatggatattaattcatggatatatatggttcatcaattcactcgatcggtgtgtactgctgtacttgattgctgatcgatgaagatacgatattactgcaaaaaattcgatcgatctctgtactgtgtgactgatcacatgatggagcaggggctcggctgctcctcgcagtagaccatcgacggcggcgggtagtagcacggaggaggagggcaccacggcacggggagcgtggcctggcacgggcactccggcggcttcttctcctcctccggcttcttcttctcctcctccggcttcttgtccttgacctcctccacctgcaggacgtcggcgaagcgcaccttcttgcggaggcaggtgacgaggcaggtcacgtcgacgccgtcgccgacgacctcgaggcggtccctgtcgtcgccggtgatcgccatcgagatcaccccgtccgctttcgccgccacccccagcgccttcaccctgcacccgtcgcacggcatgcacgccttgatcacgatcttttgctgcaatcaatcaattaattacagcaattaatatttcaaaatttcaacaaaacgtacgccatgaaagcgatcgatcagtctctctgtcatacgctgctactcctgctgcttcagagaaatgctcaaaatgtcaaaggtataaacctcaccttcatctcgtcgttctactatacgtatacgatacgtgatatgaacaaagagagatgcaaacgcgagcaagatgatctagcttgctgcagctaagctgcgtgcgttgcgatttatttctagcggtggatgcagaaggccagcgccgggggctccttatatagcgcgagaaccacacacacgcacactagctaatgctcgaatatcgccactgtagtagcggagacttgaattaattaaattaaacggcgatcgagttggcgacgacgtagttagaacattcgacgcagctatatcgttcgcccaactaaacaaatatacgagtatatatgcgacctaactaactaactcgatctgacggaaaacgtataatcatctgaaactagctagctaatcagatgggtcatggggggtgagtgtccgatcggagggtgcgcgctagctaatcatcgagctgggacgacgctgtataggtagacgcgacgacttgacttggttctttggttgacgtcgatatatcgatccagatctgagcccgcttccagtagcgtgcatggctagctgcagcagcagctcagtttaacggcgagctagcacaagccacaagctttgcagatttaccgataccgttattattattcctaccagagatatacagatactggattttcatcctctcaagggacaccctcgtattttacatgttatctaaatagttatttaaattttttaaaaatcaataagatagattaatataagatatagaacccaacgcacggagacaaggttaaattcaagttctacaatctgtaacaaaaagaacaaattgatctgaaattaagagtgaaactagtatacatgtattcacaattatatattgttgttgttttataacttgtgcatgtctttaaaataatagcatattttgtagagtggtttatgttatattaatctaactcatatatttttttcaattttttaataatgatttggatgatatcggtataagaactagaggataaacaattttccattagagctaaactttctactactaaattttccatctgatttggcaacgatagatactactgccaggactgccctaaaccaacagcagctaggaacacaagtacccctaataaaagagtgcatcggagaaaaatatatagcgcaaatcgcatatatagagtaaatctagaagctatcataaagatgactataaacgtctgagattttttcacgtcattattagtaaaactgttgacgtgaacaaatctcaggcgttcattttttttatacaatggtagtttctagagttatactatatacattatttgcactacatatttttccatatcaattgacatatgttatagtattacacaactatgtagaaaacactttatatcatataaaatatgtcatcgatattgcacttgaagctttatgggccttcagctactgccttcgcagctgcgccacagccgacataaacagtgccgcactcactatgcgcagccacagctgtagctgttgcagccgacctgcctatgtgaaaagcacaataaaagatcagttgttgtcaattaattggcatatgtcatactcctatcacacgattatgctcaaccaataatgatatagatactactgctaggaatatccccaccgaacacgtacaacagtacgttggcagtaaaaacattaccctataatatggtcttgctggcagcatgtgcttcgtaatcttgtttggtttgctttaatagtaaaatatacaggccgtatacaaattaatgtcggtacaaatacaagtatatatgttcagatcaactagaaatacatctgcagatatatatgttggagattttaacccttctattattttacagaaagtattcctagaaatctgaatatctgatgagtgatgatgatgaccccatctctcaaatctagagatactgccttgtaagcctttgacctgctaagatgatccatgtatatagtaggggccgaatttatacatgaataagtctctctcacaaaagtataagtctctcttataaggattaaaatttttgtgggaaggactaaactttagtcccttctttccaaacaccatctaaatgtgaggattattgtggccttgtggggcagatcgatcctttgtacagaaagtatgtacttcttgtcctgaaagaagaagagaagcccggtgaattttctccggctcatgaggaccaggaaaaccacgcctctgttaaaacacagaccagcagaagaccagctcctacaaaatcactgcataataactattgagcttcattattcaccgtatcttttttttttcaggtcataatcacaaaagttcttacgtcaatgtacagagaaacacgatatgttactgacgagtggttttttaccagatgggaggaaaatgtcctggcattttcaagacggggaccatgttgccgggtcatataggaacatggtctttgacctcgtttcttatggccatggtttagatgttttagtatcatttaagatagatggtttaaaatctcactatctcggatactccggaaatttcttttgaactatacatttgtattttgttctcaaacttggttaaattctgtttgaactgcttgaaattcaactaaaatttgtttacaactcgaatttctctctgcaggatatgattgatcaactgcctaatatgcttcattcgctccattgctgtacttaatcgctgatgatgatgaagaaactactccaaaacaaaaattacatgatggaacatgtgccattcgggctcggctggtcgcagaagaccaccggcggcggcggcccgccgtagtggtggtggtagtagggagtaggagggtagcacaccaccggcggcttgggcggctccggcttgggcggatccggcttcttgggcagatccggcttcttctccttcacctcctccacatgcacgatctccgcgtggccgatcttcttgcggaggcggttgacgacgcagaccgggtcgacgccgtcgccgaccacctgcagccggtccttgccgtcgccggtgacctccaccgagctcacgccggtcgcccccgccaccagcgccatggccttggaccggcacttcccgcacggcatgctcaccttgatcaccatcttttgctgcaaataattcatcaacaacgccaataagaaatccatcggcttcagaaaacgctcaaaaatattgcgaaaactaagctgcatggaagcaaaactcacaccttcatcgcgttctgcgtgaattaaagaggctccgtcgaattcgatcctttttcgcgaacgcgcaatacgattgcacgtctttctaattcgatcgttttgcaatgcacaatgcagatgcaaacgccgatcgaccaatgtgagctcgttcgcgatcagctgaagctagctgcgtgcgtcgcgatcgtagctaaagctgtggaggagaaagcgacgccggggagctccttatatagcgcgggaacacgcgctggcaagccgtgccgcgcggcagctaacactgctcgccaccgtactagctagcagagaggtttggcgacgacgtaattaagaacattccacgcagctaatctcccaattaaacaaacgcgcactaactcctctgacggaacgcgttggctgtgtcaggatcaaattaatgtctgaaactaatcatccatctcttggccgacgggttattcccgattggagttgctaattaatcaggcactgagagactgtgtgtgtgattgtgtacaggtggacgtacgacgacttgacttggttcttgtaatcttgttggttgacgtcgtcgtcgaggatccagatctgatgagctgcgcgagcgaaattctattaattaattgccccagtcgtggctgtgcagcggccattcagtttaacggcaagctcgagcttgctagctagcacacgcctgagctgacagcagagttcagttgtgctactgctacgagcatactatttttttaaaaaaataaaccgaaacgtgacatatctcgtacaaagatgttaatttattttaaaacgtatggagtacgactgccaggactgctgaagtgccgtttagtccaacactcctatgtcctgtttaaacaggaacttctagcagctctatagcctttttcctaaatcatctagctagattccaaaactatgtaattgtatataatccagaaaataaattaaaaggttagaatgtactttctccgttttataatgtaaattactttagcatttcccacattcatattgatgttaatgaatctagataggcatcgatatgaatgtgggaaatggtaaaatgacttacattatgaaatggagggagtaacaaatctatatttttagattacgactagttggctactcacaatctgtttctttagaatctcgaataggatcttagttgatactctactgcttaatttcattttttctataagaaaaccgtggtatcaaaaacgaaaatgtctggtatatgtcacgtggatgcgggtatcagatttgaaatacctgaaactttaattatcgaataatgtcgtctaata

SEQ ID NO: 61874 - DNA, 2055 bp, Oryza sativa
ggatacgatcgaccgagctacgcacaaacggctctatatatactacacacagctgcaggtattagctaggggccgggccggggcgtatatatgtacagtacgtgtgcgcaggtgagagagaaggaagcaacacgagcctattcgatcggaaccacacatcgcactccatcgtacagtagcagctaagctccgatcgagctagtaataattagtactcggacaactacgtacgttcctaacacacactgatgactgaccaattaaacgcccgggttctcgggatcgagagctagtgaccatgcaaccgatcgatcgatgcacgcatgatcggaaagtccggacgccacacgcaagaggatttacccgtggagaatattagagagtgactcgacttttgccgagatacgtttgtattgtatgatttttttttaaaaaaatatagtataaatgtagatacaacattcacttcgtgtgttgtactccctccgttcctaaatatttgacgtcgttgatttttttaaatatgtttgacccgttcgtcttattcaaaatttaagtaattattaattattttcctataatttgattcatcgttaaatatactactactagtcaagttcttgaataatattcataaaagtttttgaataagacgaacggtcaaacatattttaaaaaatcaacagcgtcaaatatttagagacggagagagtataatatattttctctaccgatcgatcgatcatcaactgatcgtcggggtccgtccatcggtctaaacgtcgaagacgaggaccgggtcaagtgttcgcgcgcgcaagctaagcacgaacacagatcaacttgcgcgtggcagcgtgcaagattcagctcgcggagcagcaaacgtcatgtacagagctttcaattcagtcgatcgtgcccctaccagggtttaccttatcgcttgggccggggttatcaccaccccgcggtagcgcgataaccgtgataatcgcgtgataatcgtctaaaatcgcacaaaaatcacatccaaaaattcgaattcaaaactcagcggtttcgtggtttcaccgcgataatcgcacggtttaccgcgataaccatgatattcgcacggttatcgcgggctgtatagctgaaagatgtaaatgtaaaataaatagggtaaaaaaatcaaaaatacggttgaatatgtgtagaaaactagaaattgagaataattggaagaatatgtaggatacttaaggcctaatattctcttcctttttcaatttgtaaaccatttttggttttaccctcaaatttgaatttagcttactctatttcaaaaaaattcttcacaattggcaattacaaatcaagaactacatccatgaattttttcagtttttttcaatttttttccggaattttgaattcggtcaaaattcatccaaactatatcgccggtttcccctaccgtaccccacgataagcgcgataaccacgataatcgcgcgattatcgtgcgataagtaaaacctgtcccctactccaccgtactaacaccggagtaggcgtctactctatccatccaaaaaaactcaacctagttaaagatactccctccgtttcacaatgtaagtcattctagcatttttcacattcatattgatgctaatgaatctaaatagatatatatgtatggattcattagcatcaatataaatgtgggaaatgttagaatgacttgcattgtgaaacgaaggaagtaggacatattttactataatgaatctggataacccctattcaaattcattaacgtatcacatccttaagtttttttttatggagaaatacgacgtcgagggaactgggcatgacttgattagctcgtccgctgcatgctcgcgattgacttctggcttctgcaccatactccctggctcgccatctagctagctatagctaggttaattatgctccctggctcgtacgttgactaattaatcaaggagcagagatgcataaacttagcacattgcgaatacatgctatatataaattcta

SEQ ID NO: 61875 - DNA, 3072 bp, Oryza sativa
  unsure (1)..(3072): unsure at all n locations
gtcgccagtataattatgatgattataaatatgttcatgtatnttatgcgttatctaaatttntngntataatatatctcgttctgtttaatgtcgctttntttttcnnnnncctcccnnaaggcgtgttgtgattgcataacgnccaacnncagccnncagnnnacnatagaggagccccaaaatgactgctctgattatgcccatggggagctcgaagtgcaggctttcttctgcttggagccggaggaggacgtcgatgaggggctcctcgcgggctgcggcctgacacgacctctacttctcgaggtgctccctgatgactcggtccatgaactccatgagggactcgacgaacgcctccgccctgcgcagcgttgtgctgataatcgcccgcgccagcctagactacgggaacaggtcggccatggtgaggctgcccgccagccgcaccggctcgtcgacgtaccggagcagggcgtcgcgctcccggaaccgctcgcccatcacgatgtgcaccgtcgtgtccgtgacgtagttgccgaggagctcgctcagattcgtcacgagcggcggcgaggcgacgccgatggcccggacgagccgcgccgtctcctcctcgcggatggcgcggaacgccaggatgcgcctggggctcagcagctcgaggcggcagatcttgcgcacctgccgccagtgctcgccgtagggcgcgaacgtgatgcccgcgccgcgcctggtgcacaccttcaccacggcgctcagcggccgcgacgagaagttgtcgtcgtgcgtccgcaggatctctctggccgcgccggccgtggacgcgacgacgaccacaggggcgtcgccgaaggcgaggagcatgagggggccgtggcggcgggccaggtcgcgcagcgcgcggtgcgggagcgcgccgaagaacaggtggtggaggctgccgatgagcgggaggcgccatggcccaggaggtagccgcaggtcgctgtcgcgtgagccatggaggaagagcgtgatgaggtagtgtagaagaggaagaagagctagcaagcagcagaacacagctgcgtccatgattgagcaatccgagctgtgtgattagtttgtgattaggtgatcccctgctgctcattttctattgttagctgaagttgacttaagagcatcgcattattgttggtgggaatattaatctatcgatcgttggaatactaggggcgccacatcagcttgctttggaaaattaaaacgcacatactccctccgttttaaaatgtttgacaccgttaactttttagcatatgtttgaccgtttgtcttattaaaaaatttgtgaaatatgtaaaactatatgtgtacatgaaagtatatttaacaataaatcaaatgatatgaaaagaataaataattacttaaattttttgaataagatgaatgttcaaacacgtactaaaaagtcaacggtgtcaaacattttgaaacggagggagaatatttaacaaccaccgtggagcttgtgtttttattgactcactaatggttctccaaatgcgttgtatttcgtctactacttcctccaggttgataatacttgtcgttttagataagagcatggtctctaaaagacaactattttctattataatgtatatagaaatatcaacaaatatatgattttattaaagtacttttcaagactaatcacgcatatgatttccatatttttaagataactattttaaaaattatttatagtcaaatattttaaagtttgactttacccttattcaaaatgactaatatttattagtctggggtggaaaatttgggcccatggttttcgtcgtgcaactggtctttttttttgttacaaatagtaatagattcgtaactgaatttggagcttgtttgatccgttgtcttgaaatattttaactttatcaaattacggtgattttggaaactagtactctaaacactgtcaaggtacttaaatagtactcccttcgtccctaaatatttaaagttgttgactttttacagagtaaatttcactttgggctagttttaatagccaaagtttcactatggaccaggcctacgcccatatttttacataacaccaggtaatattatcttccgttgcactttggatcaagctgcactaatttgggccaccacgtcatcttcagcccaatccacgtgagcagcaggctggtggactcagttcacggaagaatcatatggagccgccgatacacgatgcgtataaaactagcgccagcctcctctgcttgagagaaaactagcgcaacacaaggttgggcgccccggcgctgccgcgagccccgctgccgtcgtcgccgtggctaccgcgtccgccatcgccactgttnnngccncgtccgccaccatcgccgtcgctgtcgtcgtcgccgcggccgccaccgtcttcatcgccgtcgccgaggggactacacaagctcgcataatgggagcactactcagcagccatcatgtgatctagtttaccacccttaatccatctctaatgtcaactttagtgatttccggtgaattgacaccttaaccaggttgcagtagcagtggaatcgagcaacaagaattggtcgaatcgatatgggagttcgcttcaatatatatatttttagaaaatcatgaactgtagttaagagaccgatcatcttaagctaacatacgagtttttttaaacagatttcttatatgattacttctgtattaccgaaagtgaacgatcttagaaaccgactcaaatacggatatgtatttctaaaagtaaacgaacttaaaaaccgactcatacacgaatgacataccaaaatactggtaaaaacatttttaatttttataatagtagagatttggtcaaacctaaaagttttgactaagtaaaaagtcaaacggcttatataatatgaaacggagaagtattaattaatgtgcatgtatataaaacagccataggccatgtaacgagggataggattgatttttgtagctgttgcgcacccaaaactaacagat

SEQ ID NO: 61876 - DNA, 10065 bp, Oryza sativa
  unsure (1)..(10065): unsure at all n locations
ctggctccnattgatttgagtattccttctcggtacccccatttatatgttgactttatgatgggctaatagtaggaagtagggttgaaactggttcggatagtttccgtccgttcggaccatttttgggattcggatagtttcggtcagaactatccggaaattttcggattcggaaacgaattcggatattttttttcagaaacaaaaacgaatacagtatgggtaccgtactatctgtcggaatcggaaaatggtcggaaactatccggaatttttttcggttatccgcagacattgagcaaattttagaaaaaacacgtatatatacataacttcttcatacagaatctgatgaagacaaactttatatcaacattgtagagctcgatgagatctacaactttattattgactattttattatttgaggatatttaagggtctaaatattcattacaatataccatattaatttttacaaaatctaagatctacaattcaaacgacatctgatggagattgtcagggttatggataccacatacctaatagtagttgactaaatctcagcaggacccaccacataccatgtctaatacggaaactgacctcgagggagttccggataaggaaagacaaccagggttctacatggaaacgacaaggactactcggattgtatccatatttgtttccctagttctacttgaacaaggggacacctatgggtataaatacaagaccccctaggaggagaggggacacgatcacctcaatcaacatacacggaacaacagaagccacaacatacaagccaacatacgccaagacaagacgccggatatcgacttcaaggataggcacggctagttccctacggtgtctccggatactgtcaggagagacgaaagtgctatctttgatctcgccaggcacggattcgaggaggaagactatcctgttgtcgactacgagtcagaccttcagaccgccatgtcgacaacagttagataggctaccccaaaatattgtactggtgtgattatgatgaataagagcaacgaccggcttcggccaacaggatgtagggttattacctgacaattcagggcccgaacctgtataaaaatccctgtctctgtctcttttaccttagtctcgcgtatactctagtaccaacgatccccatactatgcaaataccagaattgcgacatcaaatgttgacagagatgtgttccatatcaaagttgtagagctcaacgggatctaccactttgtagtttataatatttgtatttgaaagcatttaaagtataaaacaaacattacaaatttcgaagatgtgaaataaaataaataacatctccaattcatacaatggtaagtaagttatacatctagtaaaaggtcttgggaatagaaaatgataatcatatttgcatatgaatctcttagaggaacatccatgaaaatagattttcacatatggttgtaggaccgtctacattgacgatacaaatgttggagatgttgaactaaaataataagcgatatctcttccttgatcaagaaactcaatttgagggggtttttatataccggtaaatattcgctaccgtattcgttccgtctcgtattcgccctgtatctgtattcgataatattcgatttcatttccgtatccgagttttcgattctgattccaattccaaaaaaaatatgaaaacgaatatgataaagctagtttccgtctgtttccgatctgttttcatccctagtaggaagtgagctctactattatccttgctctaatggctacaacagatgaccaaatccttactagaggagagcagccgagcggccacactgagcaacacaggtgaaatcctgattaggccgaccatatccaaatcagggcagtgctgtagccagggggagggagggctgccatctactgagtgggtggtggcgctagaaccctcgtggcgtcagcttcgcgccctagcgcgtgacttcccgcgcggttcttctcaccgtaaacagagtccaccagccgctgctcacgtggtttgggctgaagacgacgtggtggcccaaatctgtgaaacccggttcaaagtgcaatggaaggtaatattacccggtgttatgtgaaaatatgggcctcggcctggtccatagtgaaactttggctattaaatctggctcaaagtgaaatttactcttgaagagtatgtttgaccgttcgtcttattcaaaaaaaatttaagtaattattaatatttttcctatcatttgattcattgttaaatatactactactacttaaatatcacaaaattttgaataagacgaacggttaaatatatttaaaaaagttaatggcatcaaatatttagaaatggagggagtagtattttgtgccacaagcagctctatgataaaaatagaacggagatgctcaacaaagataaccgaacacaacgcatgctgatacatggcacggccgcatgcccttgggccgtgcatggcatggagttggcccgtgcagattgacgttgacaattaacatagtcattaaagcagcaaaggggaccggtatcaagtgaaagacgaacagttggaggctcgacatgaaggggtacgtaatcacaaaattagaagatgaaactattgttctttttttgacacgccaccaacacgaaacggatccacctaaagctttgcagtgttaatagagttgccaaccacctcaaccttgagaaacctgctaatcaaggtgggtttaccagatcaaaatcggctagcggagctgatttagataaattgggataaacacccgtgtcatgggtggaatggaagatttataggacaaatctacaaagaggatttgcacttttacggtgaagataggtggctttcagcttaaatcgacgaagatgaacgagctagactataaacacaaaaaaaatgcaaaactgaaaaaagattcaattggctaattgcgttgattgtacattggtttcttaaattggacgagctatggcatttatgaaggaattggtcttgccttctaaaaaaaaggaattggtcctactaggtctagaaatcagttaggactcgacaaacatcaaactcaatgacggaacccgagaaattttaaattagactcaagtcgaactctgctgatcagaccgatcacctgttgtgggtcagactagacttgcgcaaaaagcttaggtattttctaaatctaaccacatttcccttttttgtttgtttagatgccaaatctgagtcctaaccgaaacaacgattaattgcctagagtattttattagtttaatgttttatttatgagctagtcagctagtgggtgattgctaggccaatattcatatagtggtttttggggtctgagtcgacttgtgttgtagctaggcagaccggcctactcatataaaatcgttgctatggcgcagtccaatgtgtggacaggaacatttcaatccaactattatgaagaaaacattaaaaaaaagcctgataatcctcaacgtcgggcgcccgatcggccggcccgcacgcgccgctgccacgtggccccatcacgtgtgtccgtatgccgccacgcgtacacggacaatttgttttagctagtatacttgtgatgttgcactaagtatagatcaaattttgcagtgaattgaaacattcttgtgcaacaaatcacccatatatttaggaaaccctctattaagggaatttgtttcaatttttgttccacaaaaaatgtttcacctagtgtactcataatgtttcactatgtatagatctaatgttgcagtgaattaaaacattcttccgctatttgctgaaacattgtctttatataaggtgaaacagcgcccgatttaaacgattgaaacattttcgatctacttagtgaaacaatccgatatacttggtggaacaacgtgcaacatttataaataattcaataataagataattttcttttatcagaatataaccatgtgtggtcttgttttaaagatttaattacaacgaatttaatggtgcaatcggatcatgatttggataaataatttaagagaaaaaaattgtttaaagtggttttgcacgcatgtgtcatgctgacgtcgtgctgatatcagcatgacatgggcgcctgattttcccaccccgggatcgggcgcccgtgtttatacccaaatttggcatttaggattaaagtaggaaagattgccaaactttggaagtctaccggtttcctccgagtgggccggtctgatcgccgtgtgttgggcagtcagaccgccggttgagggccggtcagaccggcggtatgcggccggtctgaccggtaggaccgagtccgattttgtttcgtcgggtctcggggtttccttgctcgggaaggcatgtttcgggttttctttggtttctaccccgagttggacgtggaggagggcctgtagagggcaagaccaacccctatatatgggacatggccggttcattgtaaaaaaacaatctactatcaatcaatcgaatcgttttttcatattgcttttagttttctcttagtttgtctatctttgccggtttgcgctgtaaaccgtccaccgccgctgcgagagtgcgacatctttttgtaggtttgtcctgaaaatcttctgttttcaggattaaggtgctgcgatcgtgcttgtcaacttgtcaaaaaagttgccaacacgatttttggcgactccgctggggaaaagatccgttcatcgtcaactcgacttcgatttcgccatgacgaagccgccatccaagacggaggtggagccatccaatgtgataacggtcacattggatgacctcgaatgagaagatcgtaaagctatggaggagtacatcaacgagctcacacgggaggtgttgatgagagcaagcactaggactcatcaaggcgtgaccatcaagcccaggccatgtcccaagctcgctcccgacttggtaagtaatgatgaggtatcacaatctatccaacaacaaattgcatctacaatagattcatctatggttgcttttaaagatcagttagatgcaatttttaagggtaaatttgatgagtttttaaggattaaattcggccctcttatggacgattacacattaaaggataaagcctctaccactgctaaccaacctcctatagatgaaacgggtagtaaaaccgacggaacggcgttcacggccggtccgaccgggcctgacggccggtcagaccgcgacacagccgtcggtccgaccggccagacggccggtcggaccgggtatcaccctggcggtcaaaccgggactcaggccggtccgaccgcacctctgaacgccggtcagaccggcgcaattattccgatacagggaatagatccgatgactaatgctagttatttgtatcactttagaacattcgatcctcctgtatctactgctacaagtagtccccaagttcccccacatgttcctaatgcttataatgatgtttctaggggtatcctcccgataccagacaaggccaatataatcatattgtgccacaaacacaacctattaggccaccaaatccaccgccaaatcaacaagggcctaataacatggaggatataattagtgatattattaagaatagattcgggattgaaactaggaatcgtgctagaacttacaaaaaaccgtatcctgattattatgataatgtgccgtttcctcgcaattatagagttcccgaatttgccaagtttagtggtgaggatggtaagaccacatgggagcatgtaggtcaatttttggcgcaatgtggtgaggctaatagtgatacttttaaattgcgcttgttttctttatctttgtccgataatgcttttacatggtttacttctttataggcaaattctattcatacttggactcaattagaagaaaaattccatgattatttctatactggagaaactgagcttaggtcatgtgatttaacatcggttaagcaaaagtataatgaatctgtcattgattatattaagagatttagagatgttagaaaccgatgttatactttgaatataactgatagagatttggctggtcttgcttttaatggtttaattgctcctcttagagaaagactagatggccaacaatttcttgatgttagtcaactcatgcaaagggctctggctcaagaaagccgggttaaggataatagaaaacttgctagaccatttgacaaaaagcctaatgttaatgtggttgattactctgaggctagtgatagtgaggaagagggtgatcatgatatttatattgccgaatggtcatggactaataaaaataagccttttgtttgctctaacctaatgccgactcctcgcaaagatcgacaaagtgaggttaaatatagttttgatgtggccaagtgtgataagattttttattatcttttgcaagagaaacaaattagattacctaaaggccatgtcataccatctcaagaagagttgaaacgtcgagcatattgtaaatggcatgattctcattctcattctactaatgattgcaatgtgtttcgacgataggttcaatcggccatagatgaaggacgattgaagttcaccgatagctccaagataaagcttgatcatgatccttttccggtgaatacaattaatttcaatgataagaaggtgttgattcggccggagcaagccgaatctactaagggaaaggaactggtcattggttaaccgaggcctaagatggtagtgccaaagaagccggaggttggcgtttggaaggagaataaaagtggagcttcaacttctaaggcccctaggaagaccaaagtaacttttgatatgcttttggagaagtatgagaagcaaggtagtgagagaggtcgcaacaaagggaaaagaccaagatcacctcctagggagcaatttggtcattcatcaagacggtcgtattcaccttcatatcatcatccacaagacatgtcatggggttcttatccaatgccgccgccgggttatccttatccttacttcatgccatggggggcaacgccgccaatgtttaatcatatgcctccaatgcaattcaaccaagggtggggaggaccaaggaggccgattcatgagcgtttgtcttcaccaaacaatagccggttttatggtaagaatcaggctaatgaagaaaagagggaaggaaagcgcgtcaaggtggagacgaggacttcggaggtaattactatcaaagtggggtttcatgatgtgccaatacctactggagatggagttggagtgtccccgaacaaaaaatccgaagccggtaccagctcctcgcagtcagccggtcaatccaggccttctagccggtctgaccgcagtcatgcgaccggtctgaccgagccatcaggccggtctgaccgtgctccggatgtcggtctgaccggcgcgtctggccggtctgaccagtggtctatggctggcctgaccgggctccagcgccggtttgacaggaggattgcaaagggcgatgtggaagcttcatcgtcttcaaacaaagttaatacagggcattatttacctcctggaacagagccgaatcctaggtggatgcctaaggatttgatggcaactcaaaagagaaggttgcaacgtcttcgggcccaagagctaagagagaaaaaggccgaagagcaaagggataaaaggtttaataagttgcgaccaccaccggtatggaggcctaaatccatagagaaggcaaaaccgattgatgtagaggagaaggaagaacaatcggtagataaaggtgaatcatctccaaaagaagacatggatatcaacatggtatgtatgttgcctatggagttttgtgctatggatgaagccgaggttgctcaattctcattaggtcctaaagatgcggtttttgagaagcccaatgaatcaaaccgtcacatgaagcctctctatctcaaaggccatgttgatgggaagccggtctctaggatgctagtggatggaggtgccgctgtgaacttgatgccgtactcattattcaagaaattggggtgtgaggatgatgagttgaagaagaccaacatgattctcaatggcttcaatggtgaaccaacggaggcgaaaggtatctttttggcggagctcaccgtgggaaacaagacgttaccaaccgctttcttcatcgtcgatgtgcaaggtaactacaatgttattttgggtcgttgttggatccatgccaattgttgtgtgccttctaccttgcatcaatgtttaattcaatgggacggagatgatgttgaaattgttcaagcggatacatcggccgaggttgcaatggccgatgctacttttgagtagcatcatgggaatatccaatgcttatcggggagggatctttctagctatgattttattagtatctccgatggcaaatttgtacctatctctgtaaagccggctagtgtggcacggctaagccatataaatttgtataatgagtaaagaggctaatttagagtggttacaaaagagggtgcaagaatatcggtctacaaagaacgatattggtgaannnnnnnnnnnnnnnnnnnnntggagaagcttggaaaaggatttacatcagctgatccattagaggaagtagacataggtgatggaaccaaaccaaagccgacttttgtaaacaaaaatatgagagccgattataaggttaagataatcgagctacttaaaaaatatgttgattgctttgcatgggaatatcatgagatgtggggtcttagccgtgagcttgttgagcatcggcttccaattaaaccgggttttaggccttataagcaaccacctcgtcgttttaatcctttgctatatgaccgagtcaaagaggagattgatcggttgttgaaggcggggtttattaggccatgtcgttatacagagtgggtttctagcatagtcccggtggagaagaaggggagtggtaagattagagtttgcatagattttagatatttaaataaagccactcccaaagatgagtatcctatgcctatagccgacatgatgattaatgatgcctcgggtcataaggtgattagctttctagatggtaatgccggctacaatcaaatctttatggcggaggaggatatgtacaagacggcttttaggtgcccgggatttgttggtttgtttgagtgggttgtcataacttttgggttgaagaatgccggtgcaacatatcaaagggcaatgaatttaatctttcatgatttggtaggtattatcttagagatctacattgatgatattgttgtcaaatcggatggtatggaaggacacatagccgatttgaggttagcttttgagaggatgcgccggtatggtttgaagatgaactcacttaaatgtgcttttggtgtgtcggcggggaagttcttaggattcatggtgcatgagagaggagttgagattgatcctaagaagatagaaaatattcgtgatttcaaagcgccgacatgcaagaaggaggttcaaaagttgctaggtaaagtgaattatttgaggaggtttatttctaacctagcgggtaaaatcgatgcttttgttcctatactttgtttgaaaaaagaagccgattttacctggggggcaaaacaacaagaggcatttgaagagttgaagagatatttgtctactccactcgttgtgtgagcgcctaaagccggaaagccgtttcggttatatattgcctccgaagacaaagtcattggtgccgttttgacccaacaggaagatgccaaggaatatatcctcacatatttgagccgccgtcttttgaatgccgaaacgaggtatgtctttatagagagactttgtctatgcttatactatgctggggggatcctctaaagtcgacgtgcnggcntgcaagcatgcggttatgatgagtnttcaat

SEQ ID NO: 61877 - DNA, 1937 bp, Oryza sativa
catgtgctaaaaagtcaacggcgtcaaacatttcgaaacggagggagtatttgagaactgacattttgaaaagaagggtaatagtaaattctccataaaccaaaatgaaaagttgacttttttaagaagagcaggtatgaatcaatgcatgcatgcaccccatgtggtacacggtttgtttaccaaatcacgcacccatgcatgttcagtcaaatgtcgtcgttacgtccctctctgcctgcactgcactccggccgggtaaagaggaaaccccaaacacatttcacacgagaaaaaaagatgccctgtgtcaccgacgggagaaaagtcttccacctcccttaccttttttccatcctgccccctccaagacgcgaatatatcatcatacatgtgatataataattacaaggaagcaggagggcttcttcgaaattacgaccggctactgctggtagacacgcgtacaggtggtcccgcagaggaggatgcggtgggccccacgtgaaaacgtactccagcgaagcgtaggtgggcgcggtcatcacgcggggaggagaaaaatatgcacgtgcgcgtaatggcggaagcttcctggttagggtgggtcatcgcctctcccactttcatgtgggtcccaccttgtcagttgtcacctgctgtctctctcttcttgtgtggctgaaattttacaagggtccggtggtattctgcaaaatctgttgagtggtggttaactggtgatttgttggacttgaggttatgcctgtgtttcatcaactgagtccccaattatggctgtgtttagttcaacacaaagtttagattttggttgaaattggagatgatgtgactgaaaaattgtatgtgtatgacatgttgatgtgatgaaaaaggactgaagtttggatccaaactttagatctaaacacagcctaatagccacttagccactagtagtttcgtttttgattttttaacaaacctttttttaacattgatcaaatttataaaaataatataataatattttcaacatagaaaaaaactattaaaatatattcgatgttagatttattaaaactaatttgatgttataaatattactatttttatataagtttgattaaacttttaaaaaaataaaatgacctataatataaaatggaggcagtactaagtattggtcatgacagctatcagtctctcttcagctatcatgaatgataaaatcgtatacgtgtggtattcatataatggagtactggtatttaattaatccattcccattatcttagaaaaagttaacattgttctttaagattgcgagaaaaagtctgaagattatgtattcgtagatatgacaaaaaactttgcttaatcatggtgaactctaggtttttcctaataaagtagtaagttcacactagtagtactaaaactaattaattggttacccattcacaacacttgaaagaaagctctcaattgatttgacttttccactcacatatgtgattgtgtgacatttttaaaacaaaaaaaaaaccaatcagttagtatgattgtatacctaaactaattaaaaatcacattgtgttcatttgccctccacaagcaacaaaaagctagctagctaatagctgctcctaaatcctgattattctatctggcgcctaaaggtagacaagccatgcggatctcgatcgatatactccttgcgctttaaaatgcagctgtcagcacataacgttcgattattcgatttatttaaatatttagcataaatatatgcaagtataagttaagaatataatttcttttatgataaaataagttataataaaataaataatatttatatagtattttaataagataaatgatgaaccgttatgtgaatgggcattatatttttaagagcaagtttaacagta

SEQ ID NO: 61878 - DNA, 1277 bp, Oryza sativa
cctatcaaaccatacacgtggagactgcttcacattactacaaatccgggcttcagtgacgggtcatctgtgacgggccaacgcaactcgtcaaagataagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacagatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagttatttagggtgttaaatatatgttaaatgattcagacaagcatagacaaaataataacattgggttagtagtcaatatgtgttaagtaggtgagttggtaagggagctctatatggaggttgaggtcttgagttcgaatctcacttgtagcatacaagttatattgcgtgaaaaattgtgaatttgtaggtagtgatgtgtaaccatgtataggatggctagtaaaattcaaaatatttttttgaggttttttgttacgtttaaaattcaaaaattgtatttcttgctttgtcatcagtgacgggtcgtaagttacaacccgtcagagatgagtcatcagtgacggtcaggtagttactacacgtcagtaatgactcatctgtgacgggtgacaagttttaaccagtcagagatgacttatataccggtcacagatgggttatctgtgacgggtgtttcat

SEQ ID NO: 61879 - DNA, 3162 bp, Oryza sativa
caactactgcttttaaatgctagctttatgcaaaagaacctctagcctcctttggttatatcctgcatcatacctcctcttccggtatgactgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctccgaacccctttttcatctgcatatgcctttttgcacctggaattgttttgggaaaatttggagttttgcctctttggtttgcgggaaaaatcttggtcgttcattcggatcggatttttttttttttaaaaaaaatgagctcagcctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgctccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctaccccctcagatggagacaaggaatggttcacgcgactccaacaacgccagtggcagcgaagagccgatcaatggagcacgtgccaacggtgcatctgacaacagtccgtccccaccgcccgagaacccaacaattgctcaggtgttggacaatcagactcggatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatacaacgagcaggagaaggttgcttttgctacacaccagctacaaggtcccgcttctatttggtgggacaactacatggtgacccgtccaactggggcagaagttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcactacgcccctgaggacgtgcgtaccgatgccgagaggcaggagaagtttctgtctggtcttgatgatgaattgaccaaccagttggtctctagagattatgaggactttgagaagcttgtggacaaggctatccgtcaagaggagcagtgtaacaaaatgaaccgtaagaggaaggcagcccagttcaggactccccaggggaagtgtcagaagcctcgtttcacgatgggacatcacggtggaccttccaccatgattatccggcagcaccgtccctaccacccgggtaacttcaacaagaaccaccatagtgacagtcacaacaatagtaagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgttaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagaggatgtgcgttgactaccgcgcactcaatgagg

SEQ ID NO: 61880 - DNA, 734 bp, Oryza sativa
agagtgaagctgattctacaattgaattcctgcagcccagaataaggcggggtgaaactgggcaaggcatagcaggtgaattagcctggactgatcaccagttgcgtcagatcttattgccatagcagcacatcgcgaccgcatgggttggaaagtaagaccgactgttgtttttgcacacgggacctagcaacgcaccgtcctaagaattctgacgtaacagagcattatattaaacgaacttgatatgcatgcatacgcgatcagacattgacctcttgctatctccatccacgttctggatgatatgatccatccatgtcttcatgctgtgtagccacatattcccctgccatggatcgatctgtttcctgctccgaaatccatccttctgtgtttgcatgttttgctacttggaatatgagtgaatgctatatatcggacaaacacatatgcaattgatcagcaactacaaataatggagtgtgatgaataggcctgaaccatccgtgtggagagtggatttgcgtttttatcagtacatcgacaagctggtcagcacttagacacactgttcttgttacgatcccgatgccaaacataccctgcctcctgtaaaagttgcttgccaacagctgccgatggctgtctgtatttatgtgtgccatgaataccttcacagctgtactctgagacttgaacgaactcactggtggttatatatcccaatacat

SEQ ID NO: 61881 - DNA, 1166 bp, Oryza sativa
ttcatgcttggatctatcgccaaatgctgcaggttcatgcttggatctatcattttatatataaaaagagtttttatctatttaaacaagatttggaattggagattaaacacgagacattggggttgacaccatatacctcttgccaccgcaacatcaagtgcatctcaaaagcttttatctatggtatgttccttaaaaatgttttaaaaatacagtcaattgcaagatgtagtgatggcttattttgtgatggaggcggagagattacacaccaaagcggcacaaaatattgaaaaaaaggtatatattgaaaaaaatccaaatagtttgagcttggagcctaaaatatgaggttcactgcttcagttttgtttaccacgattttgaataagaaatggatgaaaatgatcaaaaacttcttctataaaaaactgaactctggattatgaattttggtgtagcatcagcctatttgtcgcaaagcacaaacattccaaataagggcctataccacatatgaaaattactacattcataatttaattccgggtgtgtttggcgctacctttcccaacctcaacattaacagcttttcacacgcacgcttaccaaactattaaacggtatatttttataaaaaatatagaaaaaaatactttaaaatcattttaattatttttcaactttttagctaatacttaattaataatacgttaatgagctattttgttttcaatgcggggagaatgagttacaaaactgcactatcgagcatacccttagaaatcccactgctttagtaggaattgttggagaatttttaaagtttattgttacattcgttctcaataaatgatgtcctaaaatatgtgcgatcaaatcttgaaatcttatatcatttataaatagaaaaagcattagaattcaatatgcctagcaatgctaatagctaggggtgggcattcggtccgatagaaaatttcggtttcggttttcagtttttgggtcattggaaagtgtagaccgaatttcaacgcaaaaatttcaggaccaacaaattcggtctcggtcttggtcctgaccgaaatttaacaacattttcatatatgcaaagaaataatcgaaattttcaacacaaaatcaaaaaaaaattataagcacgt

SEQ ID NO: 61882 - DNA, 9145 bp, Oryza sativa
  unsure (1)..(9145): unsure at all n locations
gacgtgtaggttagacaatcatgcngcacgccngcaggtcgactctagaggatccccctgctgcccatctgcctctggtccggtgccatcatctccatggccatctctctcgccgccgccgacctctcacctgcatacatcatctgtgactgcatgccggcctgctctatattggaacaacctacctgtatgaacaaacaaactcctcaattgatatgcaaactatccctcccctacaatgctaacaaagcgagtgaagctactgatctttaagctagctggtacatgcagtgcagcaaggaactcaatctacaacatgtgtagtagtgagctatagttagtgatggagaatcatcaaatatgtatcagtctcagaaattcagaacggtctctggctgcctaactacctatatactatgtagctaaatgcagcattaagaatggtccattattccatgcatggattgcattgctcaaggggagtatgaaggaaggaaggaagtggagtcagaatatatgcttcgggagatatttcaattcagctgagaaaaaaagcgactttgcatgggatctatacttgttctacctatctggtctaggaagaggaatagatggaagcacaaaagcatgcagtcgactcgatcttgagtcgtcgtctatctgtctgatctatacaacggcagttaatcccctgttttgtgcttactagtcgtcaaccgatgcgttgcacggtctattagtattgacagtaaaaatttaaattctaattaaatgtgtggtttgccttttgaaattatagatactcaaattaaaaaaagtccacgtcaattacaacttcttaataataattaaaacactaaaattgagagtgcaagatgggcacgatattatatttataaattataaattttagaattactaaattgaaatccgtgctatttctaattgcatgactatcaacacagtctacaatcgtattaatgtgatccatgaaattaacatgtgttgagtgcgctattattattcatattataaacaacaattttttataaacagagctcggataaattagatatgaattttcatattacatacagagcttggatgaattagatatgaattttaaaagttttaataacaatttgctatcagcaaaattaaaataaacgatttattgcgcaacaaaggagagcgctgatgttagcgaggggatggaccgtcgccgacatgcgggtcctacctgtcggtgactcaaggcaagcgagtccacggtggaccgagtccacaggacagggggcgattgtaccacgtgactacacgtgtcacacacgtggcgccaacgaggcagccagccgtcccgaccgagaggcgatggccaagcgcgtagcccgatggtcatcgtcggcggaggggcggcacaaagcagcggtggcaacgaggagatgcggcgaggcggtggcgcacacacggcaaaacaaagtggaggaggagggggcctcaccgacggtggtgacgaccggtggcgaaggacgacgacgaggatggtggccctaggtagggaaaaagaggactagatagggaagataaaggagaaaaggaggccggcggcgagaacatgaatggcggctcaccgccgagggggtgacggcgagatccggcggcgatcggtggtcatgaaccggcggacgaggcggcccacaatgatgcgaacccaatggcggtgttggcttgccgaggcgcggtggctagcaatggcaagcggcggccagagcaatggagatggcggcggtggctagggcgacagcgcggcgacgacctaggcatgggagcgagcagggagcgagcgaaaagagagaggagggtacgagtaggggtggaaacgagtcgagccaagcctggctcgactcagcttgcaggggtcacaacaaactaggcttggcttggcttggctcggctcagttagggaaacaagctaaaacttgagcttggctcaagccagctcgagctggcttgcaagcctttatgttgaaacacctcttcatatatatatatatatattgtaattattaaaaatagtaagaacaaattatcaacatgtacaatttaaataagtttctatattcaattcttcacaatcttaatgataaatttcaagttgacaaataataacgccataaaaagtaaaatagtcgatataaatacatgatggcttaggctcgcgagacaaaacaagcggctcgcgagccagttcggctcggctcatttcagcaacgagctgaaaaggaagcttgggcttggctcatttggcttacgagccgagccaagccaagccaaccaagctcgagccaagcccgagctaagtttacgagcccgggctttttttccacccctaggtacggggatgctttttatagcggtggggagtgcagtttgcggtggatttagcggcggccggcggttaggatagggtttaatcccagtcgcataggagggggtttcagcgcgggagatgcaggggagggaagccgagttggttagggacttggagagggacatggcgcggcggggcggcgcatgactgaggaggcggcggctagggcagccggccggaggaaggggacgggcccgacaggtgggccccacctgtcggtgacccgaccactgtcgagcgtgggcgagctgcggccttgggctggcctagcaaaggcgtgcgcgctccagggagagaaatgggggagtgggccggaaactgccgacggccgaagagagagaggaatgaattttcttaattaaactaaatcctgtgaattggtgtgacttattaaaattatttctttgctatgtaaattccgctaaaaatacgcaaattccgctaaaaatacagttagcgtatttaaacatggggaactcaagaaaaattctaccatactaattcctcttattatatgcatttaataattagggttaactccaaattaacttaaataatttcgcggagcgatttcttaatgaattagaaactagagaaaaagggaaaacttccgggtgtgacagagaaggggtaagtagttgtatattttaatagctatggaattgtaatagtatttcaaatggttaaaaagtaatgatattttttaagactgtgaaaattgtaatggcatgatctaattaatccatatttaacacccaccaactatttaaaataccaagtgtttaaccgtgttttagagaaagcaaaggtgtataaaatggacttgtcaaaaaagttgtgatggccatacgtaaacttaaacctccaatcagaatgggctgggattttgatcggcctcaccaaatggggccttcttcttcttgcttttttttttgaactaaaagggttcttcttttgtgtctttttctttttgagaacacccttcttttgtgtccataccctgaacaagacaaaaacttttcactcatcacatcgaatgtttagacacatgtatggagtattaaatgtggacaagaaaaagcatggagtattaaatgtggacaagaaaagctaattacacagattgcgtgtaaattgcgagacgaatcgtttaagcctaattgctccatgatttgataatatggtactacagtaaacatttgctaatgatggattaattaggcttaataaattcgtttcacagtttcctgacggaatctgtaatttgttttgttattaaactacgtttaatatttcaaatgcgtgtccgtatatccgacgtgataactaaatctaaaatatttccccaactaaacaaggcccgagttggcatccaacgtataaaagaaatccaacgtggcccctaccccgggaggacagagccattgaagggaggagtgccattccgctccgccgccgcctctggcttctgcggcgcttgcgatcgaggtctacctagccggacggacgcgccgcgctgatcgcggatgggcggccgggcgcgcgcgccaccggaatggcgtacaatcagcgctccagaaatcagacaacaggtttcgtgaatcgtaaatccttctctccagcgtctttcctggattaattaactcgagaaaattgggtatcgcacgaccgggcaatgtacgtattcattaattccttgtacgttggtagataaggtttctacagccgtatgtagaaaagaagatgaagcgggtagagcttgccagttgccacatcgtcgggtcgtaagtcgtaacccctagtcagtgccagaaatcgaaccgacagtaaacattcagaactgataatatggtcatcacagctaggttaagaatcggcactgatggttcccacaagacaaaaaataaaaaagggcagctcgatcaatccgttgattcattgaacctattcttcgagtggtcaactgaacctcaggtctcccgagatcccccaatcaacatagacaagtagacaaatatgacatatccaattaagatcaacatcactaatactccctccttccctaaatatttgacaccgttgacttttttaaacatatttgatcgttcgttttattcaaaaacttttgtgatatgtgtaaaactatatgtatacataaaagtatatttaacaataaatcaaatgatagaaaaagaattaacaattacttaaattttttgaataagacgaatagtcaaacatttttaaaaaagtcaacggcgtcaaatattttgggatggaggtagtatatcgcatcaccaacacatcatcgacatgttcattaaaaaaaaattcatcaagtcgactaagacccattaataaatataaatagatcgcatgcatgtttatctaacagatggagaaaaaaaatcaggaatcaacaaatgattaaaagtaaagcacatgtcacggcaggaatatataatcgtactcggagtaggcactgtgggtgcagtggtcctcggggatgtgggcagcctccatccctgatgcattcaacgccatagcggccaggaggaggccatagacgtcgaggttggagtcgccggtggagggatgcagggcagagaggtcggaggcggccggattcggtggtccatggtgagagatggggaaaaggggaggcaaccgttggtgggctcctgggcctcaccaccgacggggagaccgtcgccgccgatgcccccgtggccacgaggccggctgctactgccggtaaccatgaccataataaataataacaagaagcgtaaaaaggaacattacaagatcaactaaaatttagaataacaaatttaattaaattagaaattaaattactatatcaattgatagaatctgtcgtactaattttccagtcacaaattacaactcaccattatcagctttactgttgtcaatgataaatggcctataaagttgtagggatttatgtgtacatgttatttgtcaatcgtcgttagactctcgtctagtctcattagccattagaagctttatcgatcaccgatattgtagcaaggtgatacaattaacccaacacaattcgtggcctctaaatagctaggattcggtcatcatataattattaataaacagaaaaatgaaggacgacatgacaacaagtttcatgccgcaacgagcttcttcttcattcaccactacagcaacactttggactgcgagaatagacctccaaaggcaatgcctccataagaaaatggaacacgcacgcgccatccttgccatgatccaactagcaaaggccatactattggtttttacctagaataattttatcatccttgagaagatatcgagaggtaccatattaaaagtgagaacactagcatctgtagagacctcagcaactaaaatattttgttgattgcaaatctcaaagatccttgggaagcaagttttctgagggcaagtgccataccacgcatcatgccaaaaccaaatgtggtctccccttcccaaagacctttctgaacctaatcttatccatttcctgatattcataatccccttctagaactaggatccagaatctggacattgaaaaaccccagaattcctcacatactttttcctcaaaagctcaacacacaaactcttatccagggactctatttttatcaaccatttagcaatcaaggcaatgtttaaagctcttgtttcagtgagactcaaaccaccaaaatcctttggaaaggctagatcagtccacttaatcatatgatatttcctagaatgtttgtcaccagcccagtagtatctacctcttatactgtcaaaactctgatgaatcccttcagggagctgatgcatcgccggtagtgagaggagggttggcatgcgagggttttggtatagtctgcatatcgcctcctggaccccttgtcagagggatcgattctcatatattgccatctttggttgctgttttttttgtttgaacatgatttattatcatcatattattgtgatgggagcagttttggagatgggctgcatttgagcaaacttaaattgagatagctcaatttgggcacatgttttcattgtggatgttgacggttgttatcgatcagtttcgaccatcaatattactaaaacaggagagaattggtgatgcttgcaatgcatatgtttgttaaaataataatattccactagtattaggtctactaacctttttacagagaatgacaacaaagtggaggagaatcgacatcaacacaaacgataaatcaatcggacgatgtcgacaaccaaacttatgtatgaatgggccaagaacttagaattgacacgatgaattgggccaaagttcacaagtctgcagagtggagcaatagaggaagtcgctagccgaagatgggctggtttgggccagcccatggttcggccgaaccagggggttcggccgaacccccatctccaccgttgaggccagggtttggcatggacgtccaagatttcaccccaatgacggttggagggtacttcggacaattccccttccataaccgtcatacctacctctatataaagagcttactctcttcacttcaacacacacctcaagcaagagctctatcattcctctcaagtttagtttagtagtatctagctggtggaatagaattagaatagaaatcaggagtccggaagccttcggaagagttcgggtatggctctagtagctttccttttctcttttgtaagctttgtacttttattagaatactcttctaaatacattccgggtattgaaatactttccgagtatatgagtacctactttacattatgttcaagttatactgaatatactgctagcttacctggaagatcctttggtacgggtatagtgtttgcttatgcaattactctatgtcataataatgacattagagtagtatctggtagtttacacatggtgtctaaattacgggatatcattatttggggttatatattgcggatgagaggtgggccgctgatggtgacagctcagtacgggtattcctccgcgcctatatataatcctaagttaatttcctggggagggtattcctccatatttagccccggttggatggtcatgacgggctgtcataaggaactcgacagtcaggggtggcttctcgaagtaccaggagggcattggatagagggtattggctagtatatcagttaactagaatgtatgtatactatgtatattagaagtataggaatagattctctttctcttttctttccacctagcttagattatttattattatgaggataagtagtaatgcttgtgtgtcactctacccttggattatattaacccctgcttagaatatgattatcacaagtaatatataaattattagttgagttctctctacatgatctttccacgggataaaacaaatacgatacccttggaatactctcgagtgaaatgctacaatggtatatccgtgcgcctgcggatgaactctgtaagcataatataccagaagtgtttctacgccattgctgggaattatatttctagtaatgtcgttaagaaataccaacagtggatatgataaattctttcttaatatttggtcataaatgttttaattacaatagaatgtagtcatctatatattgaaacataattttgagcatgtacgagctgttgcctccaactgttttaacttaaccaaactttggtaacttgtactcttaaagtgtacacaaaattgtgaaagatctcatacctaaaatttttcaaacactacctatagattcaaaaacttcaagaagttttatggtaactggttaagtagatgtgaagactgaagaatcttcggctgcgtggagcttgggtgatcaggaggagcagagggcatgccgagagatgctgagatcggtattcaggagccagttatagtgatggggccagatggaggccgaaggtgatgatgaagaggaaggcatgtcgattcagctccgggcatgtcaacgatcgatcgaggatgcactagtgagtgaagatcagagaagaagaacaggtaaggaagtttattattatctctcattaacagtaacactgctatcctgatgttatgttttcgagtgaagatgcaaattttgtgtggcaattccttgtactcaccaaaattctatgatattaattgatacactttcttgttgtctatttttttattacattagcttcactgccacagaaaaggcaatttataccagtttagaaaaggaattagtgccaacaccatatttgtacgcattatgaatgtggattgagaatctgtcctattgagatcggtgagcaaaatataaatgaatcaatgaagcttgaattatggaaacacgatgcggacccgtgcatagatctagccatcaccacctacctattggcggtcggattcgacaaagtcaaggatagtggtgtagagtctccccgcttctcacctgagtatccaacacttgctgctgtgaaaaagtttgtccgcccgccactgttgtgctagtcgccccatgtgcggatctgttcgttgtgagctcatggaggtcggatctaaccgcccccgagcttgtggtagctagatccggcgaattcctcctctccacactccctccatctacccctcctttttt

SEQ ID NO: 61883 - DNA, 3324 bp, Oryza sativa
caatgaggctgatggagtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcccctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatcaaaaaacttgtgctattaattggataaaggtcttaactccctcctttcacttgtctttagatgccgcgttacaagcctgagtacctgtttggtgttgagggttttgtccaggagttgcgttcgatgtcctttgtcattggatttgggactgcccctttttatgcccagattcctcatgatcgtcatgaagagaagtgccgagtcaaagtcaccttgaacagtaatagtgaagatatccccttagtgatgtttgaagctggaggaagaaactacatccatgcatgtcaggaggtggcaaggatcgccataggagagctccgtgatcgctacagtgatcaattggccgacactgagtatcgctaccatcctcgtcaaccccagggaagtgaccgtggcagctatcttgagactgaaggaattgagaatgatgctaccacgaagcatttggttgagatgttgtgggctatggatgaaagtcgtgcggagactgtgttagccgctcaagatcgtgaagaccggaatcgtggtaagatttgtaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccaatggtgaacactcgcagcaacgggaatggtcccaacaaccccaataacaacaatggagagaatcccattctggcccaagttcttgctcaacagacacagcttatgaacatgatgatgcagcaatttcagaatcaggaaaaccaaggaaataaccatgcacctccccagaacaagttagcagaatttcttcgtgtgaggccacctgttttctctagtaccactaatcctgttgaagctagtgattggctgcatgccatagagaagaagttggatttacttcagtgcactgatcaggagaaggtctcatttgcatcacatcagttgcatggccctgcctctgaatggtgggatcacttccgccttaacaggactactgctgaacctatcatttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatctccggaagatgtgcgcaatgatgaagagcgccaggagagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacgacagggaaataatcagaagccgcatcttactttaggaccccagcccatgccacagggaggttcttcgtctgttgttcgtccgcagcgtcagttcttcaacaacaatgctggcaacaacatccgtaatcaaggtccacgtcctgttgcagctccagcacagcaacaacctgtcaagagggagcaaggcagcaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgtgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttgga

SEQ ID NO: 61884 - DNA, 3304 bp, Oryza sativa
atttcctcgcaaaaagaaaaaaaagaagtcctcatgctatccacttgtcgatcagtttgactgtatgtgccgttcccgtaaagcagttgtggcttaggctgtgtttagttcctgaaaaaggttaaaagtttgagaaaagttactagtttgaaaaagaaagttgggggtttatatgtgtagcaaagttttggatgtgatgtgatgtgatggaaagttgaaaagttaagggttaactaaacacggccttaatccggcaaccaattaataacacgcgtgaatgtcgtagtacggtacatagatgctgtggtcgatcgagaatcacatcttgtcgatgtcgccgttggacaggggcacagccctgatgggcctgaatgcccccctgattcaatgcttcatcgtagccacgtctcagggtgaacagggtacgtatgcacattgacgtaggtccagcctgtggatcggcaatgcttcatcgtcgtcagagttcaatcggccaggcagccagaggcaggggaacgtggtgtcgcgcggctcgtccgtctccggtctccgcgcctatgttgtccggcgttcgggggaggagtagggtcgccgccacgttcatcttgttgttagtttcctcatctcgatcagtcgatcgcggctgcgattctaccgatcgatgtcaaattgtcaatcatggtgcattgcggtgcagtgcatcgcgcgtccgcgtcaggattctgcagtgctgggtccgcagcagagatacgctccggcggccggtgctcgatcggtcggctccctaacccaccaccgcgtcctactatggctacagaatgcaatgtccgttgtttgtttgctgcttccatgtcaaatgcagtacgcggtgcaggaagaaacggacagcaaaaaccgtcgatcgatggaagaaggctacttgtgtttggaaactcccaacaccatgatcgatcgccgagcagcgagagattgcaattgaaattgaccgaccgatcggtattcggtcaggttcgttcggtgaggccaaattaaaagcggacgtacatgggactgcggggcggcaacactcgtatcatatatatgccgctttccacgtacgctttcgaggaatagcgacggcacgacgggctgctgctgccgctgcgtttctctgtacgtgcccatactccctccgtcaaaaaaaaacaaaccctgatttccgtgtctaacatttaaccgtccgtcttatttaaaaaaattaaaaagataagtcacgcataaaatattaatcatgttttatcatctaacaacaatgaaaatacgaattataaaaaaaattatataagacggacagtcaaagttggacacgaaaactcaatatttgtcttttttttttttgggacggaggacgaatgttgtatcggtcggtcggctggtctgacatttctttctcatctcacaaagtcaagagtctcaggtcatcctcctgcgtcagggagcgtcctcccccgattgttgtgtagccaactgcatttgtacacatcgatcgatatcctagcatctgccgagctgcagccatgcaatcgtcaacatcactgatcttattatgatactagtattatctatccctaagctagcggtgtgtgcgacatcatcgtccattatctgaccaggttggcatgcaggttcccatttccaaaccatcttaccgtctgttactagattttactaccagacagaattttttttcctttgaaaaatagtagatttacagtttgtgcccagaatgttttgttagcatggtaaaagagataggagtaccagtgagcagcaagcaggtcgacagttaaagcggtactccctccgtcccaaaatataaatatttttagcataatggcaagttaaacattattaactttaactattaataaaaaaaataaaaaaatcaatcatgtaaaattaatgttactagatttatcattgaacaaactatcataatatacaactctttttatttaaagcatcttacttttatagatattgttagtcaaagtagcatcttggagaccgcgtcagagtccaaaaattcttatattttgggatggatggagtacctcttttcaacttactctctccctcttttttcttaagcacgttttttgaattactatactctgtgtgggttttaaaaaatatatatagaaaaattgattttaaaaatcatattaacctatcttttaagtttattttagctaatgcttaattaatcatgtactaataatttttttacacgtcggaaggtaaagtttccaatctctactttcaaacgcagccttatagatgtatcgaaaatgcagtggaaaccatgggaatacaattgttagagggtactttcgtcttcgggttcatgtacggtgggaaacggtcggaaatgatatcatgtttatcaaacgattcacggctgagttgaaattttcatatttatcaatttaattaatagtggtgatttgatgcttcaatttcaaattttatatactatttgaattggaacagtccagaaaaggacatcacctttacagaaaggggcccttacagaaacaatatatgctccgctgatgggaattttagtcaccattttcatttgcgtgcagcaaagggaaattgctatgtatatgatccaacggttcgacttatgttcgattgaatttaatcaacagttacaaacgactgcaatacacatgaacatactctttttgaatgatctatgatcgtatgcctctagttgtacatgagttgtacaactgagtcatatgtacatgagttaggaacagacgtggcttcgtggcccagctcgaagaggcccgttggtgaaatggcctcttccatgatcttcacaaaatttcggcctttcagtcgtcagccgaagccagcaaggccgcaaagcctgttccgcgaaaaccgcagaattttcgggcccagcctgttgaaagcgctccacggtccgtcggtcccggttggaggcctggaagtgggttactgggcttgtgatgaggcctggaagtgctccaactgggctttctgggcttggcgctcagtaatgaggccgtggcccacagagagacgaggccaccactactattttgattttccatgggttttagtactttcagcaaattactgttcttttcatctaaacaaaaatgaaactatacgtgttttcttcttcttgatggaaatatatactccctccgtttcgaaatgtttgacgccgttgactttttatcatatgtttgaccgttcgtcttattcaaaaaatttaagtaat

SEQ ID NO: 61885 - DNA, 709 bp, Oryza sativa
  unsure (1)..(709): unsure at all n locations
attcctgcagcccggttcttcctaggaacttccgggcagttgtaaattgctatttcaaacacctcacaacaagtaaattaaatcacaaggaagcctaaactatagagaggtacaacatgtctcaaacaagagtaatacacatgaagatacacaagatagcacaagtgatcatacaatgggagacatgatagaacaactaggcaaataaagagataagcatcacaatcacaaagataaagagagtgagaggagacaaacgatttgtttcccgaagttcggattctccaccgagaatcctattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagcgtagtgtgggtcaagatgtcaaattttcaatggctgacaatttttatcacaattttgtgaagattttgatgacaagattcagaggaatgatgggtcaaaccctgttccttggtctgcaggtccatgaaggcaatgcaggttatctgggatatattaatgagtcaccaacagctcataaatatgtggccttcatgccattggtttctttggagtaatgcggtaccagatgattntaatccaagagattgcaatgtt

SEQ ID NO: 61886 - DNA, 2139 bp, Oryza sativa
  unsure (1)..(2139): unsure at all n locations
ctacccgtccgccgacgctgccgccgagccgtactccacggcggcgcacgggcacgggcacggcaggtacgcgtacgcgccgtcgccgctggcgcggtggaagatgctgggctcggcgggcacgccgcggcggcacgagtacttctccggcgagtaccggtggtgctacccgacgccggtgcgcgagggcatctacagcctcgccacggacgccaaccgcctcaccaccatcttcagcgaggagaatcccaacgcctgtgccatcgtctgaccaagaaattcacaattgtcagagaataatcaaaagttcttcttaggggacaaactatatatatataactagtgattagaggaatatgatgctttcagcgttttaatttgtagataaggttggtgacagtagtgtgagtggagtagcagtagtagctttagttggtgaaatggacctgttctaatgtttcggcttatattctcattgtcccatgcatactggcttttgttagcacgagtacttttgttaaccaagttggcagtgttaattaagtaggtctagaaatagaatttgatcagcaccaacagtttttaccagggagaacgaaaggattgatgcatatggatatatatgatgctcattattctatacccatcatctaatttggcccgaaatttatatatgtaaaaggagatgcttcgttatcccctactctactcgcagacttcatctgactttgcttgataatggcagagagaggagcacagtacgtgggactttgcatgattaacgagtaaatttcactttatgccacctttaataaccaaagttttacaataaactaaggctcaacctatattttcatatactaacatcacacatagttacacttcattgcaccttggaccggggtttacaacatagattagcacaataataagatatgtagctggttatatactacatcctatcaaataaatcaaatggtatttcattacaccgggcaaatagcaaatacttttgcagcacactaaaccctgcttggcacacctctgcattataatccaaagctgattttgaattttattttttttattttaagattggttttatgtgtttttttttgttacttttggtgcccgttgtttgtatgactgctgagaagacaagtaaaaaaatatatatctaatgtaattcttaaaactcaaacttcaaaattcgaattgaattgagttggattataatctaaaggagttccaaagcagagccactggtatgttgcgccagtatacctttcatgttctgttattttcaaccaatatacctttcaacattgttatgttgcaccaacaataatgctagagatctaaactctataacatctttgataacttcaccactaaatatatatatagttttgtgatacggtgccttaaatatgtagttccgtgaaacgttcgatgataaatatatagttttgtgatatacattcttaaatcagtttgcgacgagctcacctctggccctctgctaccttctgtttgctcctccggtgacgcgaccgcagctacttgctccgccggcaccccgccactgcttgctccgcggacagcactgccgcttgctgtgccgccgtcgccgctcattgtgtgacgttcaagccctgctcgctcctttgccgccgctgcttgcttcaccagcttcgctgcttgcgccgacgaagccctcggctagggtttggagctacatttggggctgattaacaaagataatagttattgtttcctcgtgtaaaaatatagataatatatattacggagcacacacacgtgagctacccgctactccctccgtccctaaatataagggattttcgttggatgtgatacatcctagcacagcgaatttggacaggctctatatctagattcattatattagaatgtgtcacatccaaccaaaatcccttatatttagggatggaaggagtagtattcatgtgcaaagaatagtgctggctgtagcaatattattatcaaaaaaataaatnagaatgagaaaaataagaagatggaacaatngaaagatataagggtaaaaattttaagttcacatcaattactataaagaacattttaattatatta

SEQ ID NO: 61887 - DNA, 744 bp, Oryza sativa
ccatttatcattcacacaaaaaaagaattgtgggacccacggacatgtgtgtcccacatgtcaccctctcctatcccttcttcctcctccccctcctcccttctctatctctccctctttctcttcgtgcgtggggagcggcggcggcggcgacggcgacggcaggcaatggacggagcggcagccgacagtcttcgcgcctcctctatcgccgccgttgcagcagcagtagggattcggggatggtggcggggcgagggcatggcggcgagggcaccttgagcgcccgctcagcgagggcatggcggtgagagcacaacagcgacgagcaggatgattccgacgatgatggcgcggggcggccacggcggggagggagcaagtcgggcgcggtggcacgaaggaatgtgcgcagcgggggacaccgagcgcaccgaggaggaggtggaggagcgcgaaaacgctgccgccccggcggccaccgagccccctgctcctgccgccaacttcccaagcctccacgaggccgctgcgggcgcggccggtggcaaatccaagaggaagaagggggcggtctgcggaaggtcaacggacggcgacggcgacgaggaggaagcggcgaagctcttcggcttgacgatggcgacgaagctccgacgatctccggcgacggcgaaggggcggacgaggacggcgacgacttggcgagcacgacggtggtctcccgagcgacggcgacggcta

SEQ ID NO: 61888 - DNA, 4628 bp, Oryza sativa
aaatttctcacctcttttgacccaaaaatttaaaatattgccttcagtgtcctatagccaattacataatttttgtagtgtccatcagccgtgtcacgtttttgcggtgtctcccaaccaattacacgtttttttgagtatcctgtagcaaattttgcctttaggtagacaaaagatgttttgttttgaataaaaaagaaacaatttaactagattattttttagagagaatccatcgtgggccgctgactttgtccatgttctataatatgccactgagtttgttaagttctacagtatgtcattgtattttgcttaaattctataatataccgtcaccgtccatttagattccgttagtactgtacaatttgtcctaatgattgaaatatccctaggaaaagaattccaaaatttggccgaaaattcccaaatatcatattataaaccaggcagagaagttgcccatctcaaactttgtaagttttacaatctatatgataaaattgtacaatgctaacagaagttaactagacgacgatggtatgttatagaagttaagcaaaatgtgataccatgttagaacttgacaaacccaacgacatatcatagagcacggacaaaatcaatgacacacaatggattatctttattttttatggttgttcggttaactgcttatctactatgatacggcatttttagaaaaaagaaggttaaatcttatactataagtccatatcttacacattaaattgcatacacttataatataattttcaaattataaaatgccctattctcattttataggagaaatatgcttatctactatgatacggcatttttagaaaaaagaaggttaaatcttatactataagtccatatcttacacattaaattgcatacacttataatataattttcaaattataaaatgccctattctcattttataggagaaatatggaagaatgatttattatctatttaattaactttacattcccgacctcaacggcaatcataacaatagtgtgcatcacgatagaagaggagaaaaagacatgtcatataaaggcaaagcggaggaacaatggtggctcatggagaaagagcggtgatggcagtacgtagagtggcagcggttgctggtggtatgaggaatttatcgtcgacacaatcgtcatttaaatattgataatatgtgggtcaccagttatataaataaatagtactagctagttttaaaatagtaaaaatattgagatactagtccaatgcccgtgcgttgcaacaggtcttaaataacgtgaaaacgtaataaacttatgcattattgttctataaatgtatttgtgaatacaataatagttactctaaaaaacattcaaatgatatcaatcaactataacactatgaattggacaatctaaattgcaaaacatatacaatgaatttaaaaattgataatagactacatttagtgagcgaattatagaaaatatgcaattagaatatagtcagattgtatggcaaacagaattttgcagttttatggtttggagctaaaacttgggcttgtgcgggcctgcgttttgagataaattaagctagtaatgtgtgatatcatgcataaatcgctctgaactttaatagtctgaaacttgcacatgtattgattctgaaatctgaacatgggcgtgcaattttttgtcaacctatctgcacagatagctaccatccactttgaaggaagatctgacgatgatataccatagtgcatctatcactgcatattagttgtataacagaacacaggtgaacacacaactgcatggatcaacatcctcccgttcaccgagatgatctccaagctttatcaagtcccataactgaagatgtccaaatctggcactgcaggttatactatactatacctgtgtatcacgttcaaactatgatatatcagattataacatcagatacaattgtttgaggaaagcaaaacaaaatagcaaatccaggattcaagggaatcctgatacagtagagcgcaatgatgctatttcatctggctaacaccagcatccatgacttttaacccattaacagaggcagaccagctcaaatttacagcatatcccagagtctgattacatattttggatacataaactcctgcttatatcccattcctccaagctgattttagtgcatgtgtttaaaaccatgaaaataagtatcaagtcaaataataaccatgaatataattttcaaacaatcacgaaaggatcttgagtataatacatctatgtaagtgttgttcttgctagctggccctttcaccatgacagcaaagaatcgatggcaacatagattttttttttataaagcaacaactaagagtttttttaccacaagcagtggaggcagccattcattaagttttagaagaagcacaagtacacgcccttgtttacctaagtattggggggaacaatatcaaattcatcacaaagaagaaaacaaagtgcttgcagcacccccttcactaataacgatcgacatagcaatgtatggccatgtacctcagtaataaggtagaaattttattcaaccagcttctcgttgaagttcctcacctccatccttgatcaccgagaaatcagatgcctgcaaaaagcaataaatggtcagcatggtcaacatttcttatcaaggcaaaacactataatgaacatatagtgggcagactattgtactcatgttgacctacgcctccacaccatgccgcctcatatcaaaaaatgttttcatttgtacgacaattgcgcactacatttttaggaacatcaataagatattaatattaccttcattcaattcatatccacacaaaaaataaagaatctctgcatgtccattttaacaaaatgattagctgctagctcatcttgttcttgaaaatattttatcctattctgtctgagagaggcaatagagaactgaggatatacaaaatgatatgaacatattaatttagattgcagcactaaaacacactatatctagtgttgtggctgtcaataaccacctaatatgtgccttatggaattggaagcaatgaaccaatgagatcaaatcagtggtggaacaaaattagtttatcctaaacagttataggaacaaaactatatataaattattacttctagaagcaaccaagtatactttttgaaacagagtcttgccattttgccatagaaagtgtgctttagtagcccttcaaaaatatttttttcacttgtccagtatgcatactgtcagctgaaaagagttcattactaaccttgaataatattgaaagcactattcagaaaaggttaatcttttaagtgaggatggattatagttggactaaccatcttcctttgtcattttgatacagtatagtttaattgttgttgatctaccgtgtcaaatatagtgcatgcgacatcatgtaaagaatacagccttaccctctgagttgttattcaggtcatttctcatatatttattctattaggactttcaactttacgtgatgcatcaacatatattaattgttattatgaagataaaacatggcagcatatgcattcagcagaacttacctagaactatattatattggagagatagatggcatgagggatgagtctagtcgccaacctagtcacgtccagccgggatcgatttgcagccgccggggagagagtggagaggcgatacggtgtgcgatggtggtggaggtggtcgaaggggagagagcggagcggagatgcagaggaaggcgtctactttgaagctgctcaattaatttatccctagacaattcagaggaaccaaaataatcatttgtaaactgaaatgagattaaaatgcagatggaaacacacagacatatccaaggagtggatgctatagcagaaaaagacagattttataacgatggcatcaaatgtagacaaatatccacatatgaaatgcattctccatcagttcaaattacctcaatactgtatagaactattgatagagccgcaagaaagcatgcattttttttccgtaagagacagatgaactattcagatatatagggaggatttagcactattagacagtgaaaccaaacaatgtccatcagctttaagttaggttggacaccataccaggtggaggtgtaggggaggggggaagcgggtggctcccgtcgatccggcggtggcacaggtggagcggctgcgcagccgatggaggaggtcggttggaggctccctatgacggcgcaggtggagcggctggcggctcccgtcgatccggcggtggcataggttgagcggcagcgcagccgatggaggaggtcggagtgcgtaaaatttcaggtcaacgcattctccctcatctgccaagcaaaagcataaaaacttgatgtataatataagaagtaaaactgaaacaaagatagaaagcaatatgaaccatgagtatgtctagataacagagaaacctactcagatttgctatttaaatttggttgagataaatgcatattacaaataattaagggaggcagagctgag

SEQ ID NO: 61889 - DNA, 5491 bp, Oryza sativa
tgccttcttgagcggatttctgtgcaatgtattttatatttttttggtttttggaatggagtatactacttagagtaggtacaatagcatgctataaaccagatataaacatattttaagcagataaaagaaaagagagaaaagcagcgggctacagatctgtagtcagctgcagcacggacaaacataatgtgtgtatgacaggtgggaccatgtattaatagtgtagtaagcaaatattgtatgaattgactattacattggctatagataatttggagctagtagtggactatactattaaacttgctcttagtaccactgtaatgtgcatggttgattggctggagcagttgaagcagccaaaattaatcttcgtaatggtcgaaatggcacccaaaacaacggcccgtttccttctttggaagatgagatggacttcttgtgttctttggggtaaatataactgacagtttgaaatggtcattattgtgccctttctttgtacctacaactcatgtgagaatattgcattgttttctattcgttgaaactggtggggacagtttgatatgccattttttgaagtttgagtatggacctattgattgttttgtggatttttttttgtctaggtacgaaatgaagccattttagacttttcaaagtcaacaaaagactacttaattattttgtataattcaaaaggaaatgcatgactgtaaaatttattgttataagtttttcatatgtaaaaaatttatgtctcaaacaataaatatgatcgatgttatctggtaataataaataattactacctccgtcccataaaaattgcatttctagctaatttaggacaaaatagtaggattggaaaatgacaacaataatctaatttaatgaacccactgcatgcacacattccatatatataaatgattaaaaggaagtttgagagaattaacccatataattagcatacttaataaaattgcaagcattagcagcccaaattatgtgggatgaaaggaaacttatacatatgaatcaattggttgggtcccacatggctagaaatacaatttttgtgggacaaagccttagagctagaaatgcaatttttatgggacggagggagtatatggacaaacaatttctaacatcagtacccaacactttcccctgttttatcaaggaacacttcaattacaaatgtcagcgtctgattggatgacctcaaaggtcaagcctcccaaacagtggctacacaaagccctctcctcgtccgaacagccgcctttggttttggtcaaattaaggaaacgcatgggctcaaaaactcctaattgtgatgcaataatgactaattaaatccatgacactgcttggaaattcagccagcactagctcaaatttttagttactactattaatttgacaatgtgcaattactccattattgtactacgattgtaactgacattaaacaaaaaaggcatttcacatgttatgcctaacattttggagtcaataatgtcaagatagatgcatgtggatactcttcttttatcttgagaggagactcattgtggtcaccctatcatgctgcttttgaacgttcgccagcgtttgctgctaatgcatgacaattgttcaatccatttcccttttgatatgatcagatcatgggtgacaggcacaggatggtacaagaaaaagttattctcatcaaagagctaaaaaggatggggacaatgcatctcaatgaagagttcaagtaaatgcatgctattttcttctcttttattttttcccttttttttttgagaagggtgttgttttcatgcgcatgctggtaatgcttgtccttctcactgatagatgataggcatatatatagtggtcctatccaatgacacacctgttggatctagctagattgtgcttgaatggggattccattaatccaaatcgatcagttgtgaagtttacattgatcttactgtacacggttcagattaattttgttgacaggggatctcagttagttcaggatgcaggtcgtttgcagtgttgcatgtgcagtactgatcattgacacgtggacctcatagcccctcggatccacgtatcaatgagcagtactgcatgtactgcaggggatctcaattagttcggttggcattgctaaggcacggagcactgttacggggcttgcagctgcaagctgcgcagcgtcatcaaggttagtcgagcaacaacataattgatttctcaaatgtaaatatattagtatggtgtacaagtttttgttcatgtggaatttttttgttgcaaaacatgaactctgaaatcagaagtgcaaaatagtgcttaccagtaactagatttttccttgaacaacatatatagtcatatttgtaatgcgggaatcacgggtccaaaattaagcagtgaaaaaattggactttatgtaaagaacaaaatgttctctgataccaaaccaaataatttttttgcaaaaactagcaaacaacattctattcaaccaccgtgtgcgcttgggcttactattgtgggagcaaaaatgattgatctatgtcgcttctactcattagtctactagctccacgacgcaagtcagagcaagacatcatccatgtctctccaattgcaatactaaacacaattattacccaaattacccaccccaaaagagaactgaatatgcaagtgtcaccgttacgagaatcatgcacaattatgtattcaacacatctacttaaattattggtctacatttaaaaaaaaaacttcaaactgcatcatcattcagcccatgatccaaatcaacgttacaaaaaaaaaacatatttaaactggaattatgcgtgaggtcaactgatttttatagccactcgttccatttcttccttgctttcccttttaataattgtgcataattgatgtcttctttattattatttttttatttacagatggagcctcacctagttcctcctcctcatgcaactgcagctgtgtagtatcacgaaaagggagacatggcgatgaggaagagccaaccctgagaaaactcaggaggcaaagtggaattgctcctctgtatcctttcaaagattcagagtttcagttagctcttctctctttttagtttttcttttcccttcaaagtcttcaaaaagacccaagaggtgaaaggtccgttcttgtttcccttctgtcctttggatggtagctaatgaacatggatggacaggtcaatctcaccgtcccttgttagaaatggacgccattaattagtttgaagccttgaagattcaggtcatcaggtctctggcaaattggcaacctcgaacaagcttcatgacatcttcctaagttgagtgattggacagaaagtttgtgcactactactaaaattcttgcttccttttgttggattgccaatttgccatttcccccagaatcacattctgcagtttctgacggttcatcatggttgcaatgaacctatccgtgtaattcttctcttcttttttttttgtgatgttacatgagcgactttaatggtggaatttatttgtttgataccgtagcctttatgctgtgttaagataggcattagtataaggttatcagcttaatgaaagcttgttttatacgtgcaaattagatgtgtgtggttagtgactgtaaaattagccgtgcgccatatcggtcaattttgttgggaagaaagctacaagtcgaatcaagtctacaaaacctgcgatccttttcgtctcatctttttatgtttatttttatttttttgcctttctgctgatcttgtttgtgtggacttgctctttctgaaaatcatactactgctatttaatggatatggccacgtgcccaaaattcagttcggtaacacagttgcagcaagatgtaaaaggagtttaagccgtactatagtagtatttaactataggcctcgtgctaagatgcatggacattttaaaatgactcttatggtgacagaaattatctgatgcaccaggagatgtggttcaatgaaaaaaaacgtaaaaaaaagttttcgtaaaaattctaagtgccttatgtagagattgggtatgttctcagtgtagttgtaccaccttgatataatcgaccaagttaaatatataaaagcttctattataaaaggaatatatctaaacacctgagcaatgtaatttgttcttttcatactcgtgcatgtggaagaatttgctagcttggtgtggtcacaatttggcggtctttggcacatgcagcttagtccatggcattatgtcatcctaagatccattcgtctaaaacaagaagatgtggtgtgctgaaagtttcaccttttctaattccattccaaaagtaactagttttccttgtcaaaaataaattcaaaagcgggtcattagtgagacgaaacaggctatggaaaaataggaaaatctttgtgcatgtcatcctttctgaaagacttgataaaaaagattaaaaaaagatgacttgatgcattgaaaagcagattggaccggagaaaaaaattagaagaaaaaatgggatgagaaaaaaaattcatgatcctactttgaaactattttttaaaaaacaatagaggttttattgattcagccgattatatcaaggtgatacaaccgtaatgagaatacttccaaaatctgtataactaggatgcacacagctacaaccgcacgctagttttcatcaaaacaaaaatatattacgagaaatctgtagactagatcgccacatatactcctaggtaaaacgctcctactggcatgttattgcaacagttttgtaatcccaacctctaaagaatatcctaggaagagagctagagtgaagtattaggaaaataacctacaaaagaggggggatatttttctttaaaaaccacatcatttttaaccataatgattaaaacataacaaccgctactaacaaaacatattgctctgaaaatctgactgaaagctgaaagatcataaagataagctagtcgtctgtgataggcttatcaggagaactgcactttgatgctgtaatttttggctgtatccatggcctagctaggagtagtttctttcactcatgaacaatatagaccggaattttcaaatgggcactatattgcccttcacatttctccaataaatctatgtctacatgcgcacctaacattaaatcacgtcactttttgtaagatggagaaatgggatgtgatatgccatcattcatgaaggggagccgtcagacatagagaaaccggaccctctgatcaaatatatctagtaattaattagttggttgttgttgttcatgtagcggcggctaattaatcttctcggcaacatttgggcaattaatcatccaatttgaatattctgaacgaattaaggatcgggagtttcag

SEQ ID NO: 61890 - DNA, 713 bp, Oryza sativa
ttcctgcagcccctcgccagctttgattttgatgttttgggggatctccaagcatcctagcccactcctaagcaacctgggactaatacaccactaggaacatcttcttgcttcaccttgagggttgtctatgtcaacaccatttcactattgggactattctcacctacactcattaagcatattagtcccaaatcaattatacctttgccttgatcaatgcccactttggattttgacttgatgttcatcgaagaaccacatcctcttgatcctcggcattccatcttgcggtcttcttataattgatacggattactcatagcttcaaatggcctcatacggtccatcatgaccatcatgacaaagccttcactcgcccttcaccaccggattcagtccatcggcgccaagcctcttgcttgcccttcaccccccacatggtccattgtagccgagccttgcttgcccttcaccgttttgccataaatagccacttcataccccgcatcatcaatgtcttcacttgctcctcatcaaggtataatgtccatcttctagccgagccttgctttctcttcaccggtttgccatagatagccatttcataccccgcatcatcaatgccttcacttgctcctcatcaaggtataatgtccatcttctagcttcaatcttttaacttgatgctgaaacttaacctaatctcacca

SEQ ID NO: 61891 - DNA, 11315 bp, Oryza sativa
ttcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcctaatcctgcctgatcagacgaaagattttcaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatctttactcaacctgatttgaatctcagacagcgaagatggttggagctgatcaaggattatgatatgggaatacattatcatcccggcaaggctaatgtggttgcagatgccttgagcaggaagagctactgcaatgttgcatgagtagagcaactatgttgtgaggttcaacgcgacttggaacatctgaaccttggtatagttgagcacggattcgtggctgccctagaggcacagcccacactggtggagcaggttcgcatagctcaagcaagtgatcctgaaatagcagagcttaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaatttacttcaaagttctggcaggaattacaagaagaattgggaacccggttgaatttcagcaccgcttaccatccacaaacagatggccagaccgagcgagtcaatcaaatactagaggatatgttgagagcatgtgcgcttgactttggtggagcatgggacaaaagcttaccgtatgctgagttctcgtacaacaacagttaccaagctagtttgcagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgttttccaagtaggggattatgtgtatctccgtgtcactccgctcaggggagtacatcgcttccaaaccaaaggaaagttggcaccacgctttgtgggaccatatcggattttggaacgtagaggtgaagttgcttaccagctcgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataatttttaccaattaaaaatcaccaaagtgcaatttttaatcccaggaaaatcctttcttctttttcttttttctttttcctcctttttcctcttcttgggccgtcggcccagtccaccccgtctccccgcgctcggcctttcccttgtgggccggcccgttctccttcccctctctccgggacgctgacaggtggggcccacctgtcaggtcgtccccttcctccagccacccgcctccgacggcaaccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaataggatgggttcccggccacgtccgcctccccctccgcctataaatcgttccccgcgtcttcctctctcgttttttcgcactcgccgcgctctcccgtgccgtctaccgccctcgcgccgtcgcacccgagctccgccgctggccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctctttccacgccggtcgccgccatcgcctcggtgaggaatcccttttcctccttcctttcctctcccccgtgagcgccgccgccctccgcgcgtgcgccgtcatcttcggctgccgccgccgccttcgcgccggccgccgccgtctccccgcgccgccggtcaccgccggcggtcgtgcgccgtcgtcgcctcgccatggccggccggcttgagccgtgccgagcatgccgccgcccactccctcccccttgagccactgcccgtggggcccacatgccggcgcctccctctcctttccccttagtgccgctgaccagtggggcccacctgtcggcgcagccgccccctcccttccgctgacgtcagccctgggactattgcgcaataaatatattaaggcttttcttttatagaaataaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgtgatctcatcagtgcgagagcaaggcaagtcatacattgcaattgatcatattgtacccaatttacaaatgtcccgcatttctattaaatattgcattgttttacaatgtaatgtgggatgggtcctattcctcagccacatattggttaccttatgccattgataacttggggatcaaaatgactagatgttggcctaggaaatgcttagccatgcttagctcaactagcacacaaaaagggatcacattattacatagactttgtctattggcatagctttagattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacacgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgtcttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgtatcacccgcgaccggtgatgctgcggatttatcaaccctctcgagcgcctccccctgcttaggactttggtgtggaggaggtgggggagtacgagctcgacggcgtgggtttggctccccgtcgtcgccgctcacactcggagagaggtcgtgcacctttgcttgctcggccattaggctgatcaagaaaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagatcgcttgctcggaagaaacgcgagacacgtcggcgatctatacaggttcgggccgctgctcagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcactgtactgcgttgcatgcagcgtgacacgcttgaccagactgcaattaatgctgttaggtgagcacagctgtgctcacttatcccatatatgtggcgcagacttccttaaagggtcggggtgcctcggccctcggggccggggcaagcgcaacccgacccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagcgccggccgccgccgtctccccgcgccgccggtcaccgccggcggtcgtgcgccgtcgtcgcctcgccatggccggccggcttgagccgtgccaagccaacagccacgcccctctcccgccctgtgccgctgcccggtggggcccaccagccggtggaccacccctcccttttagccgccaccagtggggcccacatgccgacgccccctccctctccccttgtgccgctgccagtggggcccgcttgccagccgccccctctccctcccttagtgccgctgaccagtggggcccgcctgtcggcgccaccccctcccctcgctgacgtcagccctgggacttactgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatatcatgtgggatgggtcctattactcagccatttattgtttaccatatgccattgataacctgggtatcaaaatgattagatgttggtttaggaaatgcttagccatgcttagttcaactagcacacaaatggggatcacctttttacatagactttgtctattggcatagctttagattggtgccaccgcaatggtgtgagttaattaaaatacactgaatggtgggctgtgggtgcatggttttgctggtcgcacccatggcggttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgattggttaatattgattaattactacaactgttttactgctttcaactactgtttttaaatgctagctttatgcaaaagaacctctagcctcctttggttatatcctgcatcatacctcctcttccggtatgatttgctgagtacagtgggtagtactcagtcttgctctctttttcccccacaccagagctggagatcttcctagttggagctgttttgtcaaagttggtttcgtcgctgccgtcaaggattgcctgtggagtggagtcgcccgctgctgaagtcaagcttcccggtttagctcgcttttatttttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacacctgctgactcgggtagctagctagtcgtagtatgcagtacttataagggcatctgtagttgagttcggcgagaaccatccacggaaacaaagttaattttggttcgggtgctacttcctccgttcaaaaaaaagtcaacctagtactaggctgtgacatatcctggtacaataaatttagacacagagtatgttcaaattcattatactagtatgtgtcatgtcgtagtacgaggttaagttttttagaacggagggagtacaacgctagcatcgatttatcgggcccatctagaatcagccgtaatctttcctccctcgcacaaactagcgaagaaacatttttctaaacggcaaaatcgactatgcgttaggttcgagatgtttttacctcacgcgacttttttttttgttgagaattacacagtacaacgcagacactcacaacgcacgcgcactcacccctatgaacacacgcacgcaaaccctacccctatgagcatcttcgaagactgggccggcaaattctggagagattgacgaagtcaccacaggcgcctcgctgtcgacgggtacgtcgcctaccactgaaagcacaacgccgttaaatcctggaaaattcgcacccatggggagtcgaacccaggaccagtggcggatccagcatgggagcggcggggtctcgagcccctactactggcgtgaagactatgagagaccccacgaagaccccactaaaattttttaccataagtagatgggagggaggactgtaactttatctagtttgctcagaccccactactatttatttctagatccgccactgcccaggacctcaggtgctactgaggctcttgtaaccactaggctacaggccctttcgcacgtgacgatttaacccaacgctgcagatgctctaagctaggagtacgtagctggtagatttaggttgagaccacagcacaaatgcggctcgagacgaggacgtttcacagatcgatggtgggatggatggatgggatgcctacgatcgagtggtcgggattcgatctctatctccctatcctatgtatccttcctaatacgcgcgtgatggatgctcgcggtgctagcattcatgaatcatgaatggtcgatgttccgagttcgtgtacgttggccatgtgttaagcatgaggagtgtacagcattagctagttatatgggtagctggtgtgtagtctttgcgtgggagccactccactacaattgatttattttctatagggataagaaagttgccaagtgatcgaccggtggtagaacctactcaccctggtttatgtttatagacttgacacgggtgctgtttacggttaaatatttttataatggtaggtagcatatcatcgacagcaaaaaccttgatgctttatgactatgatagatgaatgcccgatccagtctgtcacagcctcacaggtactcgtaacaaagaaaagactaaccacgagaagctaatagctatctagtatgtctctggaaaaagaaaactaaccatgagaaggtaatgcctatctagtccgactcgggacaattagtattgctcgggtcatatcccaatatactctccagcttctaagctagttttgagtttggacaaagagaccgtttcagatgacaaatataaaccactcatgagaaaaaaggatatcaaaatctcaacccaatacaagccacatcgagtcgttatctgctctcgaagctagccaccaacttcattgccgaggctaggtggtttttccacctcatattgtgtactcaatgcatctcggatcaatacatataaagaagacgtgaggctagcaattatctgttctggagggttgaattcaaaattatagctttaaattatcaggtcctatccatcacataatttaaaagctaattttgaattgtgcggattgattatccttttgcgacaaaattataccgtaccttctcactaagattatgcaagttttgttttcccttgtgctacacattttctttttaacgaacatttttt

SEQ ID NO: 61892 - DNA, 7551 bp, Oryza sativa
ttgatctatatcacaaaatagtcgtatgaatgaaaaaattataggctcaatcacacacaagtgataaaattactcacaggtgaatcaaactagaaaagaaaaaaaatgattcagccaaaaatctatctgttggctttgctagatcttgttataaggatgaagagaacggtctgtgtcttgtgactagtagtggagagagcaaccgagtggcaagcagtagccgacgatggaatcatggaaggatgtagtggtgtggtatagagatgagctcgacgttgcgcagtaacagccatccatcatctagcaagcacgaaaaaaaagcaaaaacattctcgttcatgtcaatagagataacgagcaaaagaaaaatagtaaacaacctccatcaccggcgtactctaccctatcctctgcggccagcaacatggagcatgatgtgcaaatgtaggacctgtacaacccatcaattgagattaggtaatattggagattgcacgtcaatttgatttgcaaaaaaaaaaaaaattgggccttcatgcgtgaagtagaaggagagtatgcagatacaaatcagagtgtcatttccttacttgcttgttctattaatatcgccgacgtggagtagccgctagttcttgctattggcccaggtgaacaccttcttgctggttaaggtgctgcccaacgtccggcagtgaggctcgaagcagtgctttcgcctcaactgccgccggccaccgctcgccggccgccgccatcaactgccatggtgtcgtcgtcctcctccatagtgtgtcgacgatctgtgggctggaatggttgatcgatttagatccgcaaaaaaggaaaaaaggaagtgggggcgagagtggttggttgggtacggaaaaaaatgaatatatatcgcaaggagagaagttgtttttatcgaagtaaatcatttactccaataatggtgggagcacgatgcagaacgtggggtgggatcgaaagcaggggagttgtttttattatcgaagtaaatcgtttactcgaataaaggcgggtggttgaggcgtacgataggagtaaatcgtttacttcgataacggtgggagtgggatgacgggacgtggggtggggtgggcctgggctgatgcatgtttggctcttggaatagctgtgctcctaatagtagttctgactaatataatttttttttgttgtaacatattataatatattttcttttaacccaaatcatgccatgtgcattttgctattccctccattgaaaactacttgttgttctacttttatcctaaaccaaacatttacagtttaatcgttaaatttctatatattcatataggttaacattataggttttatgtttttatgaccatgagaaatattttcataatatatgttgttaaactacatgaatttttaaaattggtggttaaagatagatgtctaagtcatattacaaagcagtggtttagttgtggatttatgggtgtatggttctactcacgaggatttaaattctagtgcttagattcaaatctttacgcccacaaatacgttttcaacggaaatttagtaagatgaaggatgtgatgctctagttgaacgtgtgtgagtgggcatatttaaaggaccgttagtgtggtgcgacatgttagcggtgtttgtgcgtatacgtctacagtgtaattgaaaaacaaaaagaaagaggagtaatttaaacggaaggaagttgtaatttttaaagactagctagttatatgctcatgccttgcaattttttttttattcgtttagtgaatggtaggtttattggttttctatattattattattccattttttttgataaatctgtttttaggaggaagtgagaagaagagggataggaggacgactttttaaagtagcggagaaatggtgggagcagacgggcacgccggaattgcgcgttgccgcaagcgtgcagcttgcaaatactctttgcgacttgcgagcccattacttatatatatatatgtatatataatatgtacatatacatatatgtgaaatttatatggtactaccgggagtccctccctatgcgccctcaattcgatcgctactaatgccaatgccaatgactgttaccgggtctaatgaatcgaatactcccgtccgtttttatttttctcggtggtcaacagaaggtcgtttatcttctacagtagatccaaaaattgaacgaagcctcccgagtttgttgtagatatgaaatttgaaacttgtgtttgtttatccaaagcgagaaagcaggatatttcttccgtcgttaaggaagagcagaacattatcgatctaaaattgttctctgcgtttggagggttcataacccaactgaagtcagatttgtagccgccggcgaagccctagtatggaggattccagttccaaggtttgctatcatattcatctgttattttttcatcttttggattcttttcctgatctcgattcctttattgatagtttctgctcctaattcgctttctttatgttttgcatttgtagcaactttgcagtcctgcagcaggtgcaaatgtatcaggtggtggtggctctagttctgttttcaccagaaactatcatgctggtgtaaatgtaattaggcgataagaaattaagaagtaatgttctgctcccacttctgctgccgtcgtccatgttctgcaacatctctaccaaatctgcaacatgttctgctcctcagaaatcagatagcagatcatgctctgctccaaatgagtgcatgtccatctctaaacccaaaaaaagaagtgatgttctgctcccagttctgccgtgtgccatgatttgctacatctctaaacccaaatacaagcacaagcagaaactacgatccatgttctgctacaagcgcagaagaagcaggaatgttctgctctcgtttctggacgggccttgctctaatagtagattaaatcgtttgaaggaccagaagctattctattacatatccatagtttaaggaacgggagattagcttctgctgcatgcgcatgcatacttctctgatgcagattagtttctgccattttttttagttgatgctctgccaattttttctgttggctctaataaatatcttctgctggctagtagcagaaaatcaatttgaaaagagcagaacatcaacaatttcatgtgccgccaaacagctgatgttctgcttcctttcaaacagaatctctgctcgatcttgtgctctctttccagttctattctgctcctaattggatgagcagaatatcttctgtccgcttaaatttttttcatgtgagcagaatatcttctgtccgcgttttttttttcatgttctgctcctttcccgattcacattatgttctgccaacgatattttcaaaacagttatgttctgccatttttttagctgacgttctaccggtttttaaaattggtttgcatgcaaccgatgatttagaaattatttgaactaactacaagctaaaattttgtgcaaatattattggattatggattattccactaacctgatccaataagcggagggagtaactactcccggtagtagcaaataggtaggtatatatatatgtatatatatatatatatatattacacacttgcatatatgtgtacactatatgtatatctatatctatatataaagtattttttttaatttagttctgttgccttctcgtattgttgtatcatcaggaagtagtatgaacctcttataattctgctgcaccaggaaatggacgatattgtcctcggtttgtttcacgatgtgttcactttgcgcaaagaaatgaatccagtattgaatttgttgtgctgacggcacaactgaatctccattctccaacggggaaaaggaatgtgtgtgagcaacgttcaaaggaggaacaaaattgaactataaacagtacttacaaagtccacgcactgagaatagagacgtcgagggcctttaagtggtataagtcgaagacttctttgtggcggatccaaataacatcttctccttggtaataatctgagtttcgcaccctagctccgaacatctctctacccatcactgatttgtccatgtaccattgatggaaccggtacatctgtgtaggtagctctctgatcttatcaggcgtgactagcggttcaccgagtttaaacatgtacatgaccggagccgtttcgataggtgcgtcctctagcaactgctccatactctgtcccgtatctttcaagaagttgcatatctctagttgtgccggttctacgacgaatggttcaacctcttgtcgtggctgttgccccagctgagggacttcctttctgcacttcactgctgcaaggttggcttgaagagccttcctcaatgttcgatcatagtcagaaacttcgaccggtttgcccggttcggccatcttaataaagtgatcctaaacctccggggctatagggatcttcttttctggactacgtggcttcaactgctccctaacttccgctctaacggcttcatcgagctcctccggagtcaagtcgtacgcccttttcttgagagcggggagccgtggctcgtcagatttggctttcttcttcggccttgacggtgcgggttcatatgggcgggaccttgacggcgtagacttggtagcaggtgcacgcggaggagtagttgcccgcgggcccgacggtgcagacttggcagctggtgcacgcggaggaggtggtggtgcaggggaaggagccggaggagattgacgagccggtgatggcggaggagactgtgcttgcggcggggaaggaggagcgggcagctgttcttgcccgggaaacacgatgtacttcttacgccagagtatgatggcgtgggctgtgtctccaagtctcttctccccgtctcctcctgggatgtcaagctcgagatcctcgtaggttcgttccaccagctctatctcgaccttcgcatatccatgtggaatgggcctgcaatggtatgtacccgaaaggtccgtgggtatggccatgcccaacgcgaccttcacaagaaatatagttcattaattactaatcaacatatatatgtaacaaatttcgcatttcgcataccttgatagacaagttcctgaagggagtatgcatatcgcagggtgttcgctgcgtgatatcatcaacggggaagtgggttgcttcgtgagctgccactgccttaataccctctgatccaacttggcccgttgatgcgcagctgctgcggttgcgcgaggggctcaccatgacgggcgcttgtgtttccattccgcgctgctcggccaggcgttggtccacctgtcttgtcacctcctcttgcatccttgcctcataggtggacaccctgtactcaagatcgacgatcttagcctctgtatccctcttgctcctcatccgactcctatacatgtggatgtcctctttgaatccatatttccaaggaaggacacctttcccttgcgttcgtcctggatgctcagcattctgtagtgcgagggtgagctcgtccttctctctgtcgggctggaaagtcccctgtgtagaggcttcaattgcatccgcaagtcggcgtgctgcatcttgaatctcatcgccgaatatgagggagccatcacctagattgagcgatccatcgtgtgtatagaaccagttccttgatcgctcaggccaattagccgtggccggctcgataccccttgctatcaagtcggcttccaacttgtcccacttggggattgcctttccatatccgcctgacccaagccggcgatggtatttcttcctagctgcattggctttgttcttttctatctgtgcttgcccttgcgctccagtcttgtatgccacaaacgcatcccagtgatcccttagcttgttatgcacgttgaaatcaggtgtcaagcccttgaggatgtatctcttgtacagatctgatttgtagctctggaatagttctgccattttcttcaggggccattctttgcatctgggacgatctgcatcagggatcgtgaatgtctccaagatggtggtccacaacatgtccttctctgtgtcagggagaaagctatcttcatccccgcgtgacctagttcgacgccagtacactatgctgatggggacgttgtctctcacgacccaaccacaatgattcacaaactttcgtcctatacccgccggggctactggttcgccgtctggggcaatctcagtaacgatgtgccttccctccagcttcttcgcgggacctcttttcccgcgtggcctcttctatccggccgacggttgactatcagtcccctcttggttagcctcctggttaccctcatcgttgccctcctcgttcaggtattggttgggatcctcgtttccctcctcatccacctagtactgactgctgccctctgcgatcgtgtctaacaggatttgttcgtcatcgcagtctgccatctgtacgtgcaaagaaaaaaagacagtgaggtcatgcacatcgacatgtacaggtcatacgtctaaaccctacaattatacatgtataattcactaagtcgttgttctcgttaagtcgttaagtcgctaagacgttgttctcgctaagtcgctaagtcgtcgttcgtcaaagtcgctaagtcgtcgttcgtgaaagtcgctaagtcgctaagtcgctaagtcgctaagacgtcgttctcgctaagtcgctaagtcgtccatctcgttaagtcgctaagtcatcgttcactaaaacgttctcgttcaaacgttcgaccgtgagtgttttcgttcaagctgtgtcggcggcggcagtgggcggcgtcggtgttggcggcggtgacggcggcggcgttgttggcgtcgacggcgcgcagcggcggctgtgcaggccgacgcggttggcagcggtggagtcggcgcgcggcggtggcggcggcagcggtggattcggcgcgaggtggcggcggtggagtccgcgcgcagcggtggattattccgcgcgaggtggcggcggtggagtcagcgacggcgatggcaaagtacgatggtgccggcaacgatgatggcggcgaggtccggtcggccggcgcgtgtcaagtttgagagagacagagagagaatgcgagatcagaggcgcaagatttgcgccctcaccttgagggaggcgacgcgctgccggtggcgttggggagggtggctgagctcggcgagcacgacgacgacgacggcggagacggtggcggcgtctagggcggtgatggcgcgcgaggaagaagatcgatcgtggagaagtctaagtgtggcgcggggaagccgatgcagtggatatttaaacccggtcatctttcgtcctggttcgtggcttcaaccgggactaaagatatctttagtctcggttggtattaacaaccaggagtaaagaacaaatgtttactcgggtaccgagctctaatacagcgtctt

SEQ ID NO: 61893 - DNA, 636 bp, Oryza sativa
cctgcagcccttgtttaaaataataaacagctaaatttctggaaccaataacaaaaaattacaagctcattcttatagttcagttatcttacactgctatagcactcaataatagacaaattacttatgtggtagactctaacccatgatatccttctacacctttgcagactgatgctgattactggcttctcaccgatgatgatatcagcattactcatatgtggacaacagcatgtatccttgatgaaatatagtcattggggttgtcgttggtgatgtactaccagaccttcctcgatgaactggtgatctacctgtgtgccactgccagctagatactcatcttatagctaagagatcagatggacggggacgacattttatccgaagaaagaagggacacatccggtcccagacgttacgaggctgaagaacgatggtatgttaccagttactctctgtcccatatcgtaaggtgttttagtttctgctctaagataaaaatcctgtaactttgaacaattctataagaaaatatattaacatctactcttccaaagaaatctatcatgacatatttcatatgagtatttaatgaaactaatgtgatattggagatgtgtagcacttttt

SEQ ID NO: 61894 - DNA, 3938 bp, Oryza sativa
tataaataagttttggatatatttatctttaaaactaaagattagaaaaaaaaaatccagcgtactgtggacaaactatagtacggctgtcgttgcgctgtatatattcatgggtaaactgatctgcaggctgcagcaacactgcttgactggttcaggcgatgacccgtggcgtttactttccaatttcagaagtacaggcttgcttgaatattcttccgttgcaaccataaattaacccacttgatcattcatggtcgtggaatccggccgttgacctcttctgctaccttcaattcgtttggtacacagttgcgcgtagtagtactgtatcttttgaggcgcatgcaaattgatatgtgaacggctattctaaaatcgatcgagaagcttttcgagagctcaatctaaaagatgcaaattcttcgtgtggttggttacccaacaccgcagttcgactagcttaaaattgcccaatgatgctaatagtgtggatcagctagctatagctagcagaatgtcctagcagttgggtaggcaggcagcatgcatgcataggagcaggtacaatagcaaactattagccgactataaatatatttttaatgagataaaagataagagagaagagtagcgggctacagatctgtaactagcggactccaagacacagtgtgtatatatgacaggtgggactatatattgatagtatagtaagcaattattatatgaattggctactagattggttataggtgaattgcagttagtagtgggctatactattaaacttgctctaagaggctgcaaataattatccctcgtactgtactactatttgatagcaaccagcaatctactactaataagtgctaataaccattgatgggaagtgaaaaaacaaggggctggaacggctcatttttcagggtcatatgattgaattggtactcgatcgtaatgttgacactctagcaatctggcaaaggaagaaaacttccactcttgtagcattaataatcgtcaatcttcccctagcaatgtggacataagaagctgtgggatggtgtgagttaacagtcgctctcgcattcttaaatagttcaaaagtcgtcctctagaataggtcgtcgatccatttctctggaattttgtcgggttttcaactaatatatttgtgtcacatgtcagttatcttgcatatacagtacacatagatatatgtccatttcactgcattaagcagtttgtacatttggtaagtagtcgttagtagacctttttcagtttttttactcatgttaacatgtgtactccaatcacagcgtaacgaaccctggtcgtatatgctccctccttttctaaatatttaacgccgttgatctttttaaatatgtttgattattcgtcttattcaaaaacttttgtaaaatatgtaaaactacatgtatacataaaaatatatttaattatgaatgaaatgatagaaaaaattaataattacttaatttttttcataagacaaacggtcaaatatattttaaaaagtcaacggcgtcaaacatttagggatggagggagtacatatgttttgatactgacttttgtttaaatttgcataaaaaaatttgagcacaagtttctatctatcacgataacatgttaattagtcaacgttcaacacattatggaagtattgttttcaaggtagattttagtccaaaaatacctaacttctagtctagctagctacatatacatacatacacgcgctatatagacacacacgcgcgctatatggtagctccggcatgccagtctatcattgaattaatgggcgatcgatcgaagatttttatgtatctcagctcaccaactcatgcatgatccctgatctccttcgccgttcagtacagtgtatatatacgtagtacgtgcatttggcagcacctgaccgattcaaacacacatgacacatgcatgcatgtcccacggttagagcaaaggttaataatacagccgacctgttggctataaggtttttttagccttctctcagcctgcccatataatagttagttatttacaattaatacatggcccacttgtctttctcgtagagttttttagtttttgtgtccaagccggctataaatttacagcccgtttttcctctctctcctctctttcttctccacctcagcatttagccggcttataccttactattatacttgcacttagaagaagagaggcgcaggctagctggatgcccggatctttttgtcagccaaggacgaagctgcatgcaggctctggctgtcatctgtcaactcgtgtaacgtacagctagaaacaccggctgtcgaccgtgttaggtccgtgtacgtaggcctgatttagttccaattttttctttaaatttttaactttttcatcccatcaaaacttttctacacataaaattttaacttttctgtcacatcgttctaatttcaatcaaacttttaattttagcgttaactaattaaacacacccatactctcttgaactgctggtcgcggcgcctcgctagctcgatcgccccgaaccgcatgcaacgcgacgcgcgtgctgttgtgttgccggttgcccgcatcctgcattcctgcgttacgtcctgcagattttcttcattgtcatgctatacgtccgtccgggatcggagcgcgactatgctagcacgcgcgcgtaggctagggcaggcgaggctaggcatgcgtgcgcgcaacttggcaatttgccgtgggcgaaaggcccgcgaacaacgcctatggccgcgacccgcgaatccgcgcgccgccgcccgcgcgcggatggtgggacgtcggacggtcggtcgcgcgcgcgagtactcgtacgtgtatgtgcggccgatggccgggcttggaatttcatcacgcacacccagccgcacacgtacgactacgaggggggttaggtttgttacgcacgctagctactacatactactatacatacctcgtcgtcgtcgtcgtcactgtcgcagtctcacagagggtaccaacatatgcatggagggaaggcagggagaagccgtcgtccgtgccggactcccggttggaggcacgtacatcagcttagctagtagctagctagccgtgtttttctgacgatggattgcggcgttcaaggcgttgtgttgcttccgttccgtatgtagtaaactaatgacgcgccccgtacgtacgttgcgaccgtgcaagttgggagagactaacacatactctccccatgcatgaacacagattagttggagaggtgtggcatgcagaaaccggggcaacagggaaccgtgcctaaccccctaccatgatatatcctcggcacatttctttcttcgaaaacacatcctctatcggaacatttgcattgtgttgtagagctagctctgcaacaaccaacaagttgttgtgaggggaacaaattaaaaagcgtacgtgtacagtaaaactttatgatatatacaagagaggggtggtttgcctaactagctctagggccgtaccctatatatgctgctagctatatagaccgacgtcgtgtgatattatgtaggccggccggttgttttgattttaatattcgtgtgagatcatattctacaaaacagcaaattgttaatactagctttaagctaggttttagtatcacaattaaacctggcactcgaagctggtttaggtaaaaacacttccactcagaaatggcattaactaattaattccatttctaggtcttgcacgttgtgtttttctgcagtgtaattctcacctcaatatcataaattcatgaaatccttgagtttatgtcttcaatccgctaggctaattatgtgtcattgtttaaagacgtcttaggaggttacacgttgttg

SEQ ID NO: 61895 - DNA, 7925 bp, Oryza sativa
ctctgaagctactatagtttttttgccaacgtgtggagccgatgttctctcctgtttcctgtccaagccaataagactgaagatggcatatttagagggtgtttagatccaggggtgtaaagttttggcgtgtcacatagggtattatatagggtgtcgcatggggtgttcgggcactaataaaaaaaactaattacagaatccgttagtaaaccgcgagacgaatttattaagcctaattaatctgtcattagcaaatgtttactgtagcaccacattgtcaaatatggagcaattaggcttaaaagattcgtctcgcaaattagtcacaatctgtgcgattagttatttttagcctatatttaatacttcatgcaggtgttcaaacattcgatgtgacatggtgaaaagttttggggtgggatctaaacaggccttacacaatcgtcatgtcatgttgaagtggccagagaaaagccctctgggcccaatggtcatagttgtgcgtgttccttttctagttcaagttgagaaaatttgacgatgtcgtacttagacgagttatgccatatttgaggtagtcagagacaaaaccaagctagccaaatgggcgtgcctgtgtgtatatatcatgcccatgtggatggtctcgtagaaacatatgtaatgaaaacctgaaaagttttataggaggtaaaaatttaactcatgataacgcgaataaatctcatacttatgttttctcatcttacaatagtttcagattttcattatatattttctgcatgttcaatgccaatatgtgaatttttttcccctcagtccaacctgagaagactcgatgatatcacatttagactatgacggagcgtggggctcctcaccgggagaccgcgcaggcccccctttgccggttcggccgggggctcagggagagattctaagcactctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccagtcccccatctaagtgggcaaggtcctccttttatatcttaaggggataccacatgcaccatttctctcttttttgtggggacttaccccaccttttcataaatggacggagatttgtatagttgtcgtccgagtcaccatctgatgagacggctcacaactacctccactttcgccgggagctggtgcgacgtggaatcgtggctgtctgctgacgacatgaccggtatcagaccagtcacgtcggtcattcttgtccaccacgtgtcagcttagcattctacatgctcccccttcttcacacaacatcttgcctgtaatggttaggatgaagcctggcatatatctgaccagatgactaacgtgccatctctgggaggcaacacgctagctccagctggggacgagcgcctagaagccctcgtcctgacgggatggggcgaggcgtgcgtcagatcgcctgtcgccacctaacccgcgatctgaccggtctgtgactggtcatagaccggataaacgagtgcactgcactgcgttacatgcggcgtgacacgctcagtcaaaccgcaataaatgtagttaggtgagccccactgtgctcacctaacccatacacgcggagcaaaaacccacgaggggtcggggcgcctcggccctcggggccgaggggggtgcggcccgaccccctcggggggactaagaggagggcgaacgcatcaccctcaggcccaacgtccctcgggggtaccaggccacgtgtgcgattgtgtctgcctcaaacctctagtcatgatactcctgatcccatgtcaccgacagtagcccccggcgttatgccagggcgatcgccttctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatacccacctcatgcgccgcacgcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgccgcgccgcttcatgccggagtctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgccttcgacttccgagccagcccccggcgcaggcctccagctggcgggcgccggtagatctgggggatggctatgacgccgtcctcgaccgcctggcgggcctgcgatcccaggggctcacaggggccatggtgtacggtgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaagaaatcctccccctctgcagtgatccagaccgcgcctccatcctgaccattatgatggcggtcggggcctcagaggagcgagctccaaagggccacgacggcgcaggcgggagccgcaggggggaacaatctaccccgagagggggtcgtgcttctgggtcccgtgacaggggtccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcagatcgcctacgggaagccgaggaggccgcccaggaggccgcccgggctcgccaggccgaggaaaccgctcgggaggaggccacccgggcccgccaggccggggaagccgctcgggaggaagtcggatttcgccaggacgaggcgatggcgacttccgaggcagctcgcgacgaggccgcgagcgcgtcgcttgggcccactccctcgggcgacgctcaggcgacaacttctggggcagctggcgacgaggctgcgggcgcgtcgcttgggcccactccctcgggcgacgctcaggaccaaccgggtccgggggacatccccgagtccggcacttccattggcggcccgagccgcgtggcatcctctccaaggcggctcttccccacgccttctatcgccccactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacactcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctaaggaagaagctcgacgccgcccagggggtgcttgacgctgccgctgcccgagaacagcgggcggcggagaccgaagcggcgtcccggcagcgtgaagaggcccttgaggcgcgcgccatggcgctggaagagcgcgcctgcgtcgtggagagggatctggcggaccgcgaggccgccgtcaccatccgggaagcaacgctggcggcgcacgaggctgcttgcgccgaagaagagttcacgctccgcctccgcgaggacgcgctcaccgagcaggagcgagctctcgagggggccgaggccgcggcgcaacagctggcggttagcctgtccctccgcgaggcagcgcaggaggagcaggcacgccgcaatctggaaggtgcccgcgccgagagggccgtactgaaccaacgggccgctgagctcgaggcgcgggcgaaggagctggacgcgagggcgcgcagcggcagggcggccacgggcgaaagcgacttagccacccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgacaaccagggaggcctcgcccagcgcctctcgaagatggccggggctctccaacggctccccgaggagctcgagaagacaattaagtcatcctcgagggacctcgcctaaggagcggtggagctcgtcccggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgtccccaactccgacgaggagagcaatgccggtggtgcagacgacagtgacgtcgaggcaggcgatccgggcgcatcggattgagcccccagacccccgccattcttcaattttttcttcttttctttcttctaaggcctttgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagattcacatgtcgagactggccaggccgggaacgtggtgaccgagggttatgggtgacccgattgtgggtttttgccgattccccccggagttcaccacgcctcggggcacggctcggttctgggccccgtttggcgattttagccgacccgagcccccgagggcaggactgagcacgagtgacctacttcaaatcaagattcttcaaaaggaaaaaacagcacagatacagcctttaggaaatgaaattgaaactgcttttattgaaatacagatgtaagagaaataagaatatgcatatgtggtagcccccggccaaccctgcacgcccgaggggggtgcggggttggcccgagcccaaaacctgacacccgatcccccctttaggggtagaagcgacgaaggtgttcgatgttccacgggttaggcaactctgtgccgtcacccgtggccagccgaaaggagcccggccgggggacgccgatcactcgatacggaccctcccacattggtgagagcttgctcaatccagcacgcgtttgaacgcggcgtaggacgaggtcgtcgacgcagagtgatcgggcccggacgtggtgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcgatttgcccagagcaccgctggcaactcctcgatccatgaattgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgagccacttagtgaacctgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacaccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccatacttggcgta

SEQ ID NO: 61896 - DNA, 11008 bp, Oryza sativa
gagtgttgattactactcgcatctcgcagcctgcagtctggtctatagatccccccgggactaaagatatcgatatctttagtcccggttgaagccacgaaccgggacgaaagatattttcccgctatttcaaaatttgtattggtcccggctactgttaataaccgggactaaagatgtttacacaaaaccgagttatggcctttttaaattgtcttacaagtcgaaataaataccaataaatccaatataattagcacatggccgatttatatggtttcaaagtccaaataaatacgaaaaatcgtctgtaatttacgtatggccgaattaaatgttttcaaaattttaataaatagaaataaacatatataattaacataatacctaagtaaatggtctcaaagtataaataaataaaaataatcatttataattaacataaggccaatttaattctactcaaagtgtaaataaatagaaattatcatttatgattaagatatggcctacttaattgttttcaaagtgtaaataaataccaataatcatttataaataataacatattgccgaattaattgtattcaaagtgtaaataaatggaagtaaccatttataaatatcatatgacctatttaaatggttgaaaaatagtaatacattacaaattaagtagttgagaataatatattgatccaaattgttcgaccttcaatacaatacaaataatttacatcttccatcaaacaacctatgtcactgtcttcctcacgtactttctcctcactattgttcctttgctatgatcgttgcgtgagtacggcgtgtcctccttactacaaatgggaaattcatgagaaaacacaagggactgcacttattacatgagaccacatatcactcgatatacagataggaaagccacacaagtccaaatccatgagcatagacacaaccattatgctcaaccatagtgccaaaacacacacagaggcagaatatatacaaatgcacaccacacatatatagcagacagaaacacacaattaagtagtagcaaaccaaacctcatgagcacccaaatgcaaaccgataatgggagggacacgatggtgattcccttcagctcgacgtccggtgccgacgcttgtccttggggatgaataggcagcatggcgcaccgtgtacttctttcacctggttagggtgtataatgaattttatctttatgcgactctatcggctgcgagaagtcatcacatcgaggaggaagaacaactagttgctcctgctatcccagtaagttttcctttgtttcaacaattacatcggctataatttacccaactcttactccttctgaaatcttttctgcaggttctagccgatctcttctcttttgatatcagagattaccttgatgaagcagaagaagatatttcaagcaaagccttagctcccctatccaatgatgtgagaaaaacactggaagatatctctcatcggctagaagcatcactagataacttggtgaccaactgcggctcgatccgggcgaggttcacagacatccaagctctactctattgttgtataggaggagaagaaggagggggctgtagaatagacaagtgttatatagagccggttgagtttgattaagtaaaagaattaaagatatcttactggtggagccgacttggcaatcgttgctactggctttttcttcacagcagtcttctttttctgcaaccgcaaagtctatgggcaattagccgaagagggaagtacttttagtagaagtcaaaagaggtgcttactcttgtaaaatgaacgggggtagaaggagttggaggcgtttgcttgggtgaagccgatggagttctttctgtgtcacttatctcggctaaagcctggtcaacatcttcaccaatttcctcttcatctaaggcttgttcaatagatggatccaaggcgggcagatcatcagccggcttatcagtcggcttggttttcttgaatttggcttttttctttggagctaagaccaaggtactcacagctgatgatctggttttccttttcttgcctgcattggctggttccctggttaagccgtgaaggagagttgaagtcttggggccatggtagccgatgacagggggagataatccacctccattcaggattaaacctgaagcatattaaatattcttgccactgttactttgatgaggaggggaggactctgttgtctgcaaaacaggagcaaaagattattcaagtaatgaatcggctaactgattatgcagtctagtaatgacaaagtttacctgaggtatgatgtcagggaatagatttgtcatatacatcgtagccgattgatgaaatagatgcagcttctattcaccccaccatctgtcaaagtttttgcttctaaatcctgccaactcaatattttcaatgctacccagagaaggtcctggtaggttaagtagccgatccatcattaaagtggacgtgatttgtcctcggcactgaattttgtcggcaaagaataagccgattgggagttggcccaatccaagttgcctggccgagctcattgggtgatagaactcataggagacttggatatttctcccttgatgaatgccgacaggaaggatgcatgggctgattgcagctgtaagaacttctctggatttttggaatttctcatgattaatatcttcaaatctaaaatccgatggaagttcaagatctactgagtcttcataaggaaaccagattcgtgcatctttcttaaaaccttcgtagaagctgcagaaccagtccttgagcagcttggctgatagttttgctccagcatcagttggtgtggatgcatatgctccatatgacatacatctgcgatgggtgcgctcttctccgtcatcttctacaatcggctctggcaatgggaactcagcttctgttacatagggccgattgacaaccttcatgactatcagatttaaccaagtttgcagcagccaccatggtccacctgctccgactattgagccgacggctattttagccgatgcattgttcaacatttgatacagatagccgagaagaattttgcccaaagggaattctttctttgattctagggcttcggctacaaattgccagttggttgtagggccacaactggatccacagaagaggaatttttccagccacatgagcaagaaagctacatgctctcgaggggtaacatatccttggcccatatatgccgccacatagccagactagccacctatgtttttggtcttaaagtcaaattggttcttggtgttcatgctcatggggttagccgatgaagtcacatctaatccagtaatcatggtgatgtcgattaaagtcggagtcatcggtccttggttgaataagaaagcattgatggtatttgaccagaagtaggtggcggcagtcatcagatgttcatccttagcagaattggctgtggtgagagcaagcgcttggccgattctaatctcatcccagtgaactttcttactagccgatacacgttggtaccaagtgatccagctcttatcaggtgtaggtttttcaagagatggccaagatttgaaggtattcttctagtgacccaggttagggttggctagcctaaaggggatccggttggtttcaccaatgatgaaatgagtggggtcgagattgccgatcgggccaagaaaatagtggtttttgtgcgaaaggctgggaatcgcgacttggttggagagatgctacaaatccaagacaaccgagagaaagagagcggtataatataggagaaaatcgatctgctgctaagaaaggggatctagccgatggggacttacctcagcgtactcagctgatggcgcatcagatggattggtggaagacgacatcactgcaggcggaggtatcgccggagacaaagtcgcccgggagtcgcttttgcgtcggaggaatcgccggagagagaggataaagtttcgcttgagcggtgaaaacggaagtcacggtgtgagatttctcgagggtgacggttagtatttaaagcacggcaataatggtcggaaaacgacaaagtgcgaaagttgctcggagtcgatttatagcaaatccgaaacattatcaaatattccggacttggggggcatgtgttaccaacaaaatttggtaacatcggcattgggaaagaagatcagatcgaagcaaagtcggaggcagagatcgagttcgataccagagcagaaatcggctggagtccagatcggctacgataagatcggctgagtctgagtcgggctaggtaagccgatgtagccgatcccgacaatacaacttgatgtgtgatgtcgggttggatcgtggtgctccaaggtgattgccgcacatggatagagtcctgaggaggcaattgtatctattaattaggatgttttatgtaatttccttagagatacgtttgggcaaaagtctgccgcaaagacttatggtatcttagagtttgttagagatagtagtcgtgtccgttatggacgtatattttaattcttgggtataaatagacccgagtcctatgtaacttttaacacacatgttcaatacaatttcggcgcatcgccacccttttgctttagttttgtttcgacgagttcttgctttcgggttgagctgcatcggtttcgatcttcaacaagaggtaaaacttgttatgacgacttgtattctcgggattagtgcttccatctttatgacactctaatcttgtttatgtaattcgtcgagttataatatatcttacataatctctggcaatatcgctatctaacctacaatcggctaacacctatcgaagagggcagccgattaggttagattttgacgttgattcagattatgtaagatatctaccactctatgagacttccagcggcttgattgtctagatattgttcttcttttcatacttaatgctacatcagttgagtttgatatgttaagtcgtgcttagaatatcaatctctagcctgctttctagttgccgattagggtagcatcggagtttcagccgatcttatctgatttaactatatttgctgtgtatgcttcattgacatgttaaatctgcccttcatgtcaagatattgctgtatctaagtatattaggcctttgtttgatatattatacttgttttaatatcctgatacagagtagtatcggagtattagccgagacatgttagatctatctgatcggctatgctataaacatatatagtcctgttattgatatatattttgatctaagtgatttatactgtctcgacatggcgaccgatctatcccaatcacttgatttaagtatatatcgatataaggagtatatattgttaatatctacagccgatcgagtagatttaattccttcttacttattcatgactgccgatcgatacacatatgacatcggctcaaagataaatgatatgtcttcggcacctagccgatcggctatcatttatatatttaaccgcggtttctttgcttctatttatttcttgttgattacaggatcaaatcaactggcacgctcatacattcgaaggcgagctttggacctacattggagttaagcagatctcccaggccacgtgttttctgttaacagctgtgcaaaatgaaaaaggtagcgtgtgttgaggttctggataaaaatgtttgcgactttaacctcttcttttattgtgttggtaaggaccaaagataattcaaaaaaaatcttttctacaaactccttaatcagaaatatctgattattaattaggtgaatcgtgttatcttatccatagatttatttttcaaacatgtctttaaagttgggggcctaataaatcccaacaaaatagcagtttaatatgtatatatattgccaatcccgttgcgtgcaaacttatgtcacacgtacgtacattgtcttcagcaacttgttgctgtaggtacatgcatatttcttgagattatacggaccccttcaaataaacgtgatgtgttatttttaggtcttgcatcaatcgataaatatttgatcttgaactcagttgctcattaattgttttttaactcttacacacccatttgtattcatgatagatactttgtgatgaaggcgaagcaatgagtggcaaggagacatcgcgatgagatggcgctattggtgatgagtggctttatggcgtagaggagcaacaacagccgccatctttgccacgacccgccgctatgtgcctgcgtagggaattgcgatagggtgcagccgctattgggatcgggagtgggagatttgggaatctgggtttactatttacatggtttgtttactcaactcaatgggctagttaggcctatattattgtaatgtgctatttttagggaggtaacttctaccccaaggccccgcctggtctcccatagggtgaaattctccccaattcctaaccccatagtggggggtcaccggtcccaacggagaaattaccacccctaaacatgtggatgtagttgtcctctatatataagagtatgttttctggtagaggtggatactacttgtaatttcatgcataccatatattaataaatttagagcaaacgtacattagattgtctctaatatacaatctccaataactctaatattctcacatttttattggagttttttattggagtttgtgtatgggttactccttatatgagaggtggctctttctgtttctgtctcttcattcttgtctcctccaccttaccatttagtcttatatgtcatcttgagttttgtgtttagatgaccatagcacttgctctaatatctaatatttaagcaaaatattggatcaattgtgcatgtactaattattgagcattcccgggaattccatgttaattaaaaacgttgccgccggctagtaggatcaataagcacgaccatagatcgcattacgaatctttcttaaggatctctttgaatcgcaggaatggaaaaacagagaaataggaaaaatatatgattctgacatgaataaatgtgtaaaacagaggattgaaaaatacaaaaaaaaacataggaatgaccgtttgaatagaccatatgaaaaacgcaggaatcggatgacagagatagattcaaaggaatttttcaatgaggttagagctcttgctaacattctccaaaatctctataggattatccattccgtaggaattttaaagaataggatatgattcaatcctttgcttcaaaggcttccacaagaatttttttcgtattattaaaatcctccaaagttcctacgcttttcctggaaatcaatggcgccctaaatcaaataggctattgaaaataccgcagattctttagtttctactacaatttcgttttagatgtcattcaatttaataattattaaatccaaaattaataaatatgaaattgtataaatcttactcttaattttgttcctaaatttaaaaattaataattattgtgttataattgacacaacaatatttatttagaatttaaatattatgatactaatcggtagcgctattccgtgctctacagaatattagttcgagcgtcgcacaacaccctctcctttcgggttttccattttttaccaccccacctttccttcgcattccaccttttctcggttctttttttttgtcttttaccactccaccttccatgattcttttttctcttttccatctcatccgtgcttcatcaatgggcccggtaaaatattaaccatccagatttttttgtttttggttccttctctctagtttttcatttttcgcatttcagtaaaatatttaccctgtagtttttcttttccgagttttccatttttctagtacctcagcacgtttcaaaataatgaatttactccgtggaactcctagcctcccacatctgctcattcaaaagtaacaaatttacttgcatgaatgcctccacattgtataacgccatacctagatggtcgtaaagaattactactagattacaacgctagtaattcttttaacaatattataaataatgtttagatttcatggtctgtgagtaaaacaattactatcttcctctcgatatagccctcctctcgatatagcccatgatcttatagccaccgtgtagtaatatgtttactgatgtgttcaatacacagtatacaagtaaaaactgagatttcgtggtctgcgagtaaaacaattaccaccttcctctcgatatagccatgatctcgtagccaccgtggagtaatatgtttactgatgtgttcaatatacggtataagagcaaaaactgatactaagagtattgttgatctgtatcacaaaatagtcgtatgaatgaaaaatttacaggctcaatcacacacaagcgataaaattactcacaggtgaatcaaacttgaaaagaacaaaaatgattcagccaaaaatccatcagtggctttgttggatcttgctataaggattaaaaagcacggtctgtatcttgtgactagtagtggagggcaaccgggttttttaggtgcacatagaatgtttttgttgttaaccagcccaataatgtttacaagttttctcacttgaagttcatcgctacttgaataataagttatgtatataatatgttgtgagattacctatttaggttaaatgaaagagtatgaagggaaacttctaatcagtagtaactaatttgtgtttaatagaatctctggctggcttaaaccacctttgtttgggggtctggctaaacagtatggtcaaaccgactttaatcacatttgtagttcttctcactgtctttaacatcccgcaggccgcatggacttagcaaacgtccacaaagggtatatacttcacggcgcgatcagagctcttctgtccacatttcttgatagtctgtgacgatgtggaatggaagctacccgtttaagaaatcctggtgcctccctctcctagcacaatgaactgctttaatttttgcctcatgacctacctctcggattatttttgcccattccctcatacctctatctcagatatatttggcgagttttgtacgtatcatggtttctcagatttcaaccgtacgttggcaatttgactttttatttcgttatctctcgttttttctttgagctacccctagagttcctggaactagcaactatctaggcttaatttggttgtagcctccatggagactacagaagaagatgcttgatatttatcaccaggacaacacggtaaggatatgagcgcgttgaacaatgaatagcgatctgaccgagccatccaccaactgtccttcagaagtagcttgcgtaggtaaagttgttgttactatgtactcctatagtaatgttagtacaaaattagaacatatttggatctagcatacataattcccactataattagaatgtaaaagaatcaagggggtttgaggtctggagttaatctccctccaaccacttttattatgggattgagcgaacaaaccattactaggatataggagagagatattggacgaaagatatatggacgatcaatttttacatttaagacaaagattttgattgccatggtatagaatttataatcctatctgtgtaattttagctaagaaaatatcgatactctgctgtatgtgaactaatggtaggaagagcgatgaaaaggatcagtcagatcagacaatgacagcgattatgacacgacaaatacggatgaaatcaaacatcctttttgctgagaccggaacttccaatcccataccggaagttccgatttgaatcgaaagttctcttcattctaatattctatgaagttgtgataaattttaggaacgcctattcacctcccccctaggcaacatcaaggttctttcaacgacttctctgtgtccggtatatattctatttttcccataccgaaccaaccactcttgcccccacctcattttttcccttttttttggatctgaatcgatccaccatccctcccacagatcggcgacacaccatggaggaggacgacgacaccgtggtggttgatggcggtggctggtggcggttaaggcgaagacacttcttcgggcctcgctgccagacgctgggaatcaccttaaccagcaaggaggtgttcacctgagccaatagcaacaaccagcgactgctccacgtcggcgatattgatagaacaagcaagtaaggaaatgacactctgatttgcatatgtatactctccttcaacttcatacataaagccccatttttttttttgcaaatcaaattaacatgtaatctccaatattacctgatctcaattgatgggctgcgcaggtcctacatttgcacattgtgctccatgtggctagccgcagaggatagtgtggagtccgccggtgatggaggttgattgctatttttcttttgctcgtcatctctattgacaagaacaagaatgtttttttgcatttttttcgtccttgctagatgatggatggctgctaccacgcaacgtcgagctcatctctataccacatcgctacatccttccatgattccattgtcgactactgctcgcgccatgatcataagcactatataaataatcggaatcttgttaagagaatttttctttaattactcttaattacacaagtagacgtgtaattacattactcttaattacacaagtagacgtgtaattacgtcatgtacacaacttgtaatatactaccatacagtgaagagatttttaagccaattaaaatattcactataagtagaaaattttacatgcaaatattataaatgcagttttgctataaatctgtcgtcaaattttttacttagaa

SEQ ID NO: 61897 - DNA, 1473 bp, Oryza sativa
cggtttggttttcgtgtgtgtggctttcgcgataagccgccatgcgtgcggccgatcaggctcgctgcattgcgtttcggtgctttgcattgcagcgcaagatttgaccattggccttggcccgaaaagctgcgcgtggcatcttaaatttagagcctctggcgtggtttaattctcaacttttttttcaaacttttagacttttttatcaaataaaattttttttacacacataaacttttaactttttcatcacatcgttctaatttcaatcaaaattctaattttttgtgtgaactaaacacaccctctcggagtctcggagtttttgttgtgaacgcaagcggcgaaggcaaatctcgcagactgaccgctcaagctccgagccagcgaccaccaccagtagtagtactgttgcttgtctcgcccaggggtgatggaaataaaaggattaaacaagaggtcccggacaaggatgcttttcgacgcgtaattaaaggcctgatgagatgagaaagaaagaaaagaattgaaggcagccaggcaaaggacgtaaccacaatccacaagcgagcgaagcgaaatttcttcagatttcatatcatatcctgtctactgtagtagtatatcctacgtgcagtgcagcgtaggcccattcttctccgaccaacaatacctgcgctttccatcctatcatcctatccccgacctcccttgaaacattttttagcctctcatgtcaaccaaaacttcgagagatttacagggattttcagataaaaatacaggcagcagcagtaagtacagtactgttgaaataatctgtaatggaagaggaggcctcaccgtggcgttgtctcactgatgagagctgagagagtgaagccatgcgaggtgggggcccacgccgcatagagaggagcgaggacaaaaggcgcctacgtcccctcctctccgcctcgccgatcccccactctattacccgcccttttctgctccgcgccatctcctcctctgctcgcctctgctcctcctcgtacagagcaagctgcgcaacagcagcagcaagcaaccaaacgcagcccacacaaagctttgttcttcttgctcttcttatactcgagcagccgcgcattctgtggagctcagagcgcagcgcggcgccatggggaggcacaagttcaggctgtccgacatgatcccgaacgcgtggttcttcaagctccgcgacatgcgcgccgcccggggaggtgcgggcgctggcggggcggggccagccacggtggggtggtcacgcagtcttcggtggccgtgtcgcgggcggggagggcgtgccggccgctgccgaacacgcccaggcacggcgcgttgtcgctcccgcacagggcgtcctactactacacgccgcgggccggcgacctgctcgtggggtcgccgctccatcccaagtgctccgacacgcaattccctcct

SEQ ID NO: 61898 - DNA, 2405 bp, Oryza sativa
aattccatgttaattaaaaaccttgccgccggttagttggatcaataagcacaaacatagatcgcattatgaatctttcttaagggcccctttgaatcgcatgaatggaaaaatagaggaataggaaaaacacgtgattctaacatgaatgcatgtgtaaaacagaggattgaaaaatacagaaaaaaacatagggatgactatttgattagcccatatgaaaaacgtagaaatcggatgagagagatagactcaaaggaatttttcaatgaggttggacctcttgctaactttctccaaaatctctatgggattatccattccataggaattttaaagcatatgatatgattcaatcatttacttcgaaggctcccataggaattatttttataggattaaaatcctacaaagtttctacacttttcctagaaatcaaaggggccctaaatcaaataggctattgaaaataccacagattctttagtttctactacagtttagttttagatgtcctaaaatttaataattcttaaatccaaaattaataaatatgaaattgtataaatcttactcttaatttagttcctatatttaaaaattaataattacagtgttgtagttgacacagcgatatatgtttacaatctaaatattatgatactaataataattactaataatagtaatagcctgtgcaagacacaggttaacgactagttcaatctaatattctcttttgtcacataacatgtagggtaaattggaaccatgccattataattttacaaagtttgagataggcctaaattaataattactgtgttgtagttgacacaacgatatatgtttagaatctaaatattatgatactaataatagtaatagcctgtgcaacacacaggttgactagttcaatctaattttttcttttgtcacataacatgtattctatgaacaggattttggaggcctggagccaaatttctctacacgtatacatgtgctagcttacatcctatcgatcgactttatgtctgcaactaactcgacgaaatatatggttggcggaccgctcacatggcattgcttgttgtcaaaatgcacccttgtttggttgctttggcgataaatatgagttttgcagaactttcttgttcatcgatgcttgatgaacctgatatgaaccaaaattgaaaccatcttgttgcacgaattcgaattctaggagagacagcaacagaaaataaaagtcagatattagtttgtcgcaggaactctaagaggtcatgaggtaggagagggaggcaccgggaattgccgccctactttcttttcggctcgatcattgaaccccatcagtaaacgatggcagacatgcaagggtggcgcattcaagaattgaggtactggagaggggcataaactaatgcaggcagaattccaagatgatacttcctccgtttcattttataagtcgttttgatttttcaatcaaacttcttttaagtttgataaagtttttaaaaaatatgaatatgcaacggagggggtaatggacaaggctccagtagtagagggttatgtaggtatcagccatatggcaccatttccatccaagctgatgtccttggtacccccgtacacatgggagtggattctaatccctcgaggggatgtcccctcgtgcaaatttttcttttatattcgatgtgaatagtcatgaaaaattttgaaaaaaaataacaatgtagagtatcgtaatatcttctaggccacaaaaatcaaagttcaaattcgatctacacatcgagaaacaaaaaagacaaattcagatataaacaaaatacactactattcatacgccgaatttgtctttttttatatctcgatttgtgtgagttgagtttggactcaagatagatagatctattttataagtgttgccaaaattttctagaatttttcataaccatttaaatggttttaagcaaacaaggggacatctcttcgagggataaaaatattttccccactttcatcctggtctgtatcaacgatctgggcataggaattgctaatggtatttcttgttccctcattctattaatttttttcagttcatcccggcatcatgtatatccattctatttcttttgtttcttttcgatattttttttaaaaaaaatccaagcatgtaaatttcttctattgtctcaaaacaaaataacaacctatgatgccattataccctactatctaagatcatgaaatattttctacctattgatgaaatatttttcaacaagtaatgaatatctgaaataatttttgttaaaatagttttttaataagtaatgcccatctaaacatttcctgcctagtgaggaaatatttctcaacaa

SEQ ID NO: 61899 - DNA, 15375 bp, Oryza sativa
ctcacaacaactcctttcatagagtggcaaatctataccttgtatgctactctatgtgcgagtcactgcaattttataaaggatgtgtaacatactaagttttgtgataggatgtcgttatggaatgggattacttatggtgttgacatcatcctgcgcttctactttctcctcacaagtccagcgccatccaatcaatcccagcctgatgccttgagcaaggccaccatcgctggctgcagcaacaactgggcaacgccgtcaataggatgaaggaattgaggaaagaaagggagaagcgagaggaggcgccaatggccggtggctcgccaactagtcaggtggggataatgcgcccagctctctacacctttatactagataccaatagggatgaaaacggagcggatacggacggataatgctcataccatattcgtttttatattttttgccggatacagaaacgaatacggatagctcgaatacggaaacaaatacggactatcttgaatacgaataagaatcgaatatgattggacacgaatacggaaacaaatttttctcggaacacgaaaaccaatttaacttctaatagaaacaaatatcaacatatataattagctcattttatataaaatgtagtattatttataaatatttttaaaattttaaataatattaataatgtggactagtgttaagagatgaactactattaaaatctaaaaaggtatattgaaggtcatagagttataaagaaattgggtatgtcttgtggcttctgcggatatccgaatagcactgttcaccggatatccgaattattatctgtatccgacggaaatcttgataccatattcgtattcgtatccgatagaaaatatccgtattcgtatccgtatccgaactatccgagaattatccgatccgagatgtatccgtattcgtttttatctggagcggacggaaactatccgctccgtttttcatccctagataccaagggtagcaaacctgatacccgtaggtatcgtacctagcacctttgggtaccggctagtacctaagttccatacctcatatatgcaggtaccagacccactggtgctaagcctgatacatgtgggtatcatacttgatactcatgggtgctaaccaagaataatgtgtcatacgacatacctgcacacaacactgacaagcagcaaaacgggttggcaaggagcatgatggctataccaccacattgatagccaatcaaagctccagatatggtcatttcgaagaaggaaggggtgaggcccttgtctaccatcatcgtgggggagaacaccacatcccgtccccatgggctccgagaacttgatcgccacccatggccatcaggaatcccaacttccaccaccaccatctccacatccatacgacggtggggttgatagtacctccacctccagatcctcgaccaaatccatgaaaccacaccccctctctcgccgtgtccgtacctaggtaccaggtacctcaccgatgggaagcggggggctacgtcaggaacatggagccacaacaggaagtagagagtaggaagatgagctagggccagcgaagggcaggaggaggagtggcgagccatttttggctggcatatgggctaggaataggaggaggatggggaagacacgaggaggaggaggagggcattggatatgtggcgttggcagagagtgcattgggcgtgggtctttaagtatgtcgtcccctgaagggaactgtcctacaatatttcataagaaataaaatcacatgccctttagatcttgaaattcatttccatatatgatagttttctataaaaggaattcactaacttgtaggcatcatctttcttcatcaaccacatgcaactactcctatttattagataaacataaagatccgtgcattgataacattttcatcttctctcgtaacatggtgattgcatccgcgacgatactcgatttgtttcaagctagtatggtgaggctgcaaggaggattagtgatatttccttggttttgagggatatcatgagaaaagaggttatggtggagatggggaggaggtggggattcaacgttagggaattcttagtggttagataaatttggcaacaatatagttgttggagaggtggaagacggttatgtgtcggaggttcgatgagaaagtagaagatgacggtgatggatctagaagctgcaaccacctgagaggaggaaaattgtcacaccccgaagttctcctcccaagcctaaaatttaatttataaatgaccctaagaaaatgccggtgcaaatcaagagaaaaccctaaggaagtaatacaaataataatcgaatctgacatgtggaatttttcttgagttctacatgtcgaagttcactaacaggatttttagtggaattttcagagccctagaaataattttgaccaattaaaattgagcacaagcaatatttaaatccctggaaattcctttcttcctttttcttttttttctttttccttttcccttagtgggccgccggcccacttcctctcctctctcctcgcgccttgctgggccggccggaggccacgccccagctcagcccgcgccccctcctctctcccggggtcaccgacaggtggggcccacctgtcggacccgtctcccacctcgcgccgcgccgctgcgcccatgcctccgcctcctccgggccacgtcggccacgcccgcgcgtgcgccgcgtccctcgcgcccactcccctctctctcccgcccgcgcccgcgcccgagatggccgggattcgattttcgaatcccgcctctctctcctcccccacttccccacgttggccggcgattcccgcctctcccggccacgtccggcctcctctctccctatttaagctccgacgccaccccctctctctttttccccatttcgccgaactctcccgagctctccatcactcccgcaccgtgcatccaccagccgccgcctttcccgtcactccggccgccgctagccgccgctaggctcgccgccgcaccgcgccgtcgccgccgtcgggttcgcgaggctaagctccaccctggccgccccttccccgtcgagtttcgtcgccggaattcgcattccctcgcgctccggtgagttcaacctctaccgccatgaataccggtcgccgtggttcatctccctctctctaatctctctctctctcccttccttagggcaccccgaagcccgtccgccggttgccgtcgtcctcccgtggcttgccgtcgccgttccccgtggtcttcctccgcgccggccaccctcggtgaggcttcctctcccatctattcccctccctctccttcctagccgccgcttagcgccgccgccttcgcgtcgcctttgcgccgtcgcctccgccgccggttgccgtcgccggcaacgcgttcgcacgcgcgcgccgtcgccatcgccgtggccggcgggccggccttgagccaagccgagccgggtcgccgccgcccgtccgatcaaccccgggggcgatctgggccgtcggtcccgtggaccggcggtggaccacccgcgtggtcccggtccacggtgaaccgtcccccccccttgagtcgctgccgagtgggcccgctcgccggcgcccctttcctccctctcccgagccgctgaccggtgggccctgcatgtcggaaccgagcctcctccccccccccccccccgtgctgacgccagccctgggatttattacgcaataaatgatttaaggactttttgttatagtaataaacacagtgaatcttctaaaattcatatctaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcgccgaggttcctccagcagcagagcaaggcaagtcatgcttgtcacttgaacatgttgatcctatattgcaaatgctctattgttttccttcaaatattgcattgttttataatgttactatggggtgtttacctattgtcatagccatgctattgttgtaccatgtccctttgtcagcttggggttataacatgactagagattggactagggattgcttagccatgcttagttcaactagtgcacaatggggagaatcctattaatgtttagactgttggttctaatggtactgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttagttagaaggggttatgcgaagggtcctgttacggcctctttccggtatgtcgtggtggcatgtcggcgcacggaaacgtgtcgtggggctgtgtcttgtgggtatagttgtacacctctgatcagagtaaaactattcgagtagccgtgcccgcggttatgggcggtcaaccagattcaccgtgattagtctcaccctagtgtaatcttttgaatttggatagtttaggtggatggttgggcctgtcgcaacgtgggatagcgttggacagtggatagttaataataattaattattacaacggtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagttcgggtatgtgtcagatggaggtttctccgaggagtaggcttcatccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattatcgtttgtgtaccccggccggtcctggacggggattttaatgcacattctgcttggaattctattcgggaatttctgggcgtgacaaaaatgcacaaggttgtttgctaagaaagtagaaatgtagaaggtcgtggcaaatataacagtgatgtgttggcaaaggaatgtgatggttcccgaggaaagccgattgtggcaatatgttcatgataggcacttaagaggggggaaatgaaagttaggaggttttccaagggaaatggaagatggtggtggtggatttggcaatggtaggcattggctaaggggtaagacgatagtgctcaaggtgtgtgacagaagggaagtatgcccacagtggtggatctagatattgtggccacttgagtggtgaaaatggtaaggggggggtgtgtttgccacataagtggaagattgtggtggtggatctcaaatggtaggcattggagaaagggatgacaatggtgcatgaggtttgctagggaggggaaagcccgtggtggctgttgggaagggagaagacaacaacatgagagaggtttgccaataaagagaaagtcgacagtggcaaatcaagtggtggtagccaattgaatgaggaacgcaatggacgatcgcaggaggggagcaggtagggaagcacggtagtcagtgggtctttactcttgagagggtgtcggcaaaattaggccatgaatgttggtagtggtacatagattatgtatgagagggcgggcaagagacagagagggagcggagtccttaaggtttataaagggatggaagtactaggaccatattggattaagggagtaactatataacattttcgacaattatttgggtgaaaccttttcaaatataactataatataattgaagtgtaattatagataactaacatataactactaggtaaaaacacgtgtgtggcctaggctagaaggaccggtgttcacgaagcatgtcacaggcttgactctttgatcccacatgtgctagcgaatgttttttattctttacccgcacaaatctcgaggtaatccgacggtcagaaattcaaatgttttagagggaaaaactagccgatgtttttttagtaattctgttggatcaaatggttaaaaaaatatagggtacaatgcttagattataaaaacacatatgcgctatacatcatgatttatgtaaaaaaaaagagccactttacatgcacttcactaaaacaggaggcatgtagcaccatcgagatcctatttaggagagtttctagcggctgcaattttcactagaacctctaactccccaaaacagttgaggttcttacttggtttctaaaaatctatagctatagaatgtagaaaatatactgaaaatccgaagccgggaaaattagctactaatcagctacattttagcatttgaactttctaaacagatcccaaatcaaatttcaggtcgttaccccgttcgacagtgaaacaaaacggtcaatcccatcgcccttgcgaagctacgctgcctacgcacacaggttaaactgctgcagacgcaacgtggcctccattccccgccgacacgttcctctgcacccacccacgcggaccgttcggcctcgtcgaacagcagcacgtactacccgatttctcaagcgcgcacgcaccaaaatctatctatagattgcgtgcgcgcgcgcgtgggggcaaccccaattatcccccggtgtccggtgaggcggtgagtgctacctccttaatactctcctatctgcaagaaccaagtaatcctcctcgttgatgtttgactgtttgtacgtgagatgagtctcacgtggccatggtgttggtgcgtatatcatcccgagaagtatagcggcagcatccatcccatccagccgtccaaaaccttgctatctcttgcagccctcccgtcctctggcacagtatataaagcgtacctgcaggtgcagcacctgatacctgcaaagtgatcgatcgatcgaggccggcattgtgcgtgcgtgtgccaaaggatgacgaagtacaaaggtgtcaggcagaggcactggggctcctgggtcgccgagatccgccaccctctcctgtacgatcatcattcaatctccctttttctgccatgaactaacatgcatcatacggagatgtacgtgtactacgctgacgatgtgtgttctgactggtacatatgcatgtaccgtgtgtttgtacgacgtttgtgtgtgtgtgtgtgcaggaagacgaggatatggctggggacgtacgggacggcggaggacgcggcgagggcgtacgacgaggcggcgaggctgatgagcggcccagcggcgcgcaccaacttccctctcagcagcagcggcggcaacgcccgcagctgcctctccccgaccctgcgcgcgcggctggagaaatgctgcggcgcggggtcatcagcgcaggcgcaacagggcgccgtcgctggccaggacaacgacgatgctgctgcggcggcggcggcgatgggcgtcgacgacggcgacgagtacgtcgaggagatgatccaggagctcacgttctacggctccatagagatcgtccagccctgatctgcttaattagcaaaagcctagccggccaacaaccgcagtgtaacttaaaacttaaattactagagtatagacgtatagtatataaaaaaccttgtgctagctacttctgtgccgtctcgttaggcacattgcgttggcaattagtaggtgtcaatggaacaaggtaatggacgagcattgcagagtgtgcatgcagctagccaggacatctccctgggatcgcgatgtgtttgcaaacaggggaaggggaccaagaatctttcaggataaggcctcctgatttggttcatgatgtgaagttgggtcgggctctcgtcttctagcttctttggatagtactactagtagcactcctgtcttccttcagtcaccaggctacaatttctggtacggcgcccagagagatggatgatgagatgtgacgacgcgacgcaatgggatggatccgatgcatgcatatcttttgtgctagagccccggtacgtcgacgagccgtcgtttccactgtctgctccatttcgagatgtcaatgggggattgcaaaatgccatgaacggagttaaagagggaatggctaggcacaaaacgtagcggagcttttgagccatacaagtggccatgtacagaacaagatagcaaacgaacgcgacgggtgaggcctctctcctatcaacatggctcgcgtcagcggttagacacatctaaggagatgatttagtatgggcaaacagtgcccgtgatggcggtggtcgtgccccaggttcacgttttcaatgataaccgacagtagatttcaagttaattttcaaatggttttcaagaattcagattcgaaacagtaaatgtgacacaaagatttttatcaaaattcagcaaaaactgtcatgctgcctaaggttgggatccggcgctcgctcgaaaaggtgaaccatggtcgtgctgcctgaccttgaaccaacaaacattaacgttacaaaatgcaaaccgtagccgcagttcatttaccacacaatgaatagaatatccgtagtacgaaatactggttacatgtcgagaatcctcagcgtccagcgctgcatgatactgaagtagtacatctctagtcacctagatggctagccatttactgctacaacaatactacaaacaaaccatttgttcttccatctgcacaaactactcataagttttacactgagaagaaaaaaggaggcatctaccagtcctagtaatcacatccaaatcgtgaaacgtagtcagtatgacgcctacaataatacaacatgggtacaaagagtgggtgcacgataaaatccaccgatcaatgctaactctagttaacctaggtatcattatcataccacccatttgggccgttaatattagtggtatacaaacaattgtgggtgcagtagatgctcttctactttgctcttcctctcgtgcctcggaccacccttttccgtcctcgccgaacgtaggctggttttgggtctacctgcgcaggttcttctgaattcaatcgtgtgccattctccacagaatcaccatctgcggcatcagctttaggatcattaacctcgttattggtgggaggcacaccggtgctcgagttggtgcaactgggattatcattgcccgaagattctacccccgagttggcatttgattgatcccgaaggctgcagtagaggaaacagacgaatgccaaacatgtcagtccaaaacaacaacaacaaaaaaaaacttctgcacttgaaatataagtggcttgtgcacattatgttacccattggcagaagtttttttggtcgacccatttaagctcgcatggatgtggggacctgtatcctttgttctcaactctgaagaaagtttgaaaataaaccacgataagcatgcatagtaggtactacattcaacttagagagaaaaacatctaaactaagatcaagtcagaaacagaggaatcatatgcacaatttctgctttagcttaagtgatagaatcagataagacatttcaagccttcaactaacaaaaacaagaagagatgttacaaaattcattcatatttacagtagttctgagtgtttggtgttatatgacctgaaggattatacccttgggtcaatgctcaatagtttgtactgtcatccaaagcttcagaaaaagcatagctgtgctcttgtaagtcatttgggccggttgctggacctattcaggcaattttgtttttctaacctatgccacagtttaactcagatggaaatcttgaagaacaaaaccatttgtgcaatcgaaattgacgaagtactaaccacaaatagcacttttttctgcttttcttttatgcaaatcaaccataattgcagacaagcctgtttgattaggtaggatttctctctaattaggcaaaatccagtccttcccaaaccgttgtttactagttagctacaatatttgtcttccttattccttaaaaaggaagctgttagcttccgaccttaggtaggagcagtagtcatatgtcgcctacttgatagattgaccaaaatttaattgcatctcgtcgggccagcgtatgccggacgaattttattaagcttgggaaaagagttataagctacatgttgcaacgaaagccaaccaacatgatcccatgcaactggaccacacaggaacacactggcaaatgacagctacaggttacaaaccaggacgctacatcggcagctccttgctgccgcaaaagttaataaaatctgaaattatacccacaacatgtggtttataaaatgtagtgactgactaggaaatacagttgccattagtatccaacaccttggagttccaaaacctaataaaatcatgggttgtgatcattttcagggcataaaacaaattacacaatatcagcttggtctctataagttacaaaattattgcagtggagcagacgaacatgattcaaacaacaaaggagtaacaagagtaaaaggaacttctccaactacatcagatcatgcaacaacagagattttattggaagttcagagttaagaaaaatcaagctgattcaacaaaaagaataaaatgcataggcacacgagtgaaataacacacaaaccatggcaaaattaatgtcagaaaagggacaccacacaaacctgacgctgagtttatatctgactccatgtgaatttccggttctgcaacaggagctttaacatccccatcacggtcagcatcctttgtaacactgagacaagacagcaaatatcttctttgaggaaccggctatttgaagaaacatgtgttcaatgacaaaatgaacatacagaaaatatctccataggacccaaaaaaaacaagttcaatttcaaaaaaaaaaaaaagttcaggctacataagggttaagaatgaaacgcagcacatattgagagcaatttgtgctggtgatgtaatcacaaagcttacaactagatgttgcaagtgcagcaaatgttagtcattttcaatgcaaaagctgaccttgtggaagatatttggttcccctgtgatatctcctctgcaccataaacaacaacccatgtaaattagtccaggatatgcgtaaattttgatttaagtcatatacaaaaattatacaagtcaaatagctgacaatattttttatcatcaaagaacacaaacaaatagtgaaggaaaaggagagtctacctatatgaactttggatgcagcattgcattctttgacaacattccctatgtcatttgcagggtccacaggatcaacaaacaccttaagattgatgaaaaattgcaccggtaaataaagaaatgatacttgtgatatttaaaacatactatagagcaatattttgaactcatatttacaaacagataagaatgtccaataagataatgctatacatacttttttttttctttaccaaactcttacaaacgctgacatggcatgctatgagtatatctagttttcctattacttccatctagctaaatcaaacggttgagaactatgtttgtgagtttcgtaagaaccttttgtacgtatagcagcattctttccaatatatctaaattacttccatagatatttgaagttctacaaagttcaggtgagtaaatgacccatcatcgtgaagggcagccaaacaattttatatcacaaactggtgaaagtcaaagtaattttcgcaaaacatacaacagaagcaataagcaatatcaaacttagtcaaatgtataaatacaaaaactaccatgactcacatgatttttatcagtgataggtgaggagtgcccattagccggttctgctcctgcaaccttatcagaacctaaaatatatgaaataaattattttttcaaagccaaaaatttctaagaatgagaaatgatccataatattcatgtcaaggaaagttcaggtgagtaaattagtctcacctttattattttgctcaggtttgtcaactttcttatcagtacccgatgagaatatagatgtatcattctcaaacaatctggaagtagaaccatactgcctgactttagaagcatctggagaacttccagatgatcccaggcgagacctacgagattcctccaaattttcccaaaaattggaaagatattcttccttggtggtgaccttcaaaaggtaaagcatataattatgaagtgaaaatgcaattttagttgacataaccatgtaggtactaactaataaaagaaaagcctgcggcatgccaccccaaaaattcattaactttcagttaattttattccgttccgaaattttataaatatctgcagtatatatgatacatgaccagtagcattttctcaatacctcgtattctacagtagctcaagactccagaatatgaatcaagacagccaatgtagcaatatttacagtatttcctaaaaacctaaaagggatacagtatatccaaaaaaaactgaagttcatcaagctccgaaccaaatgacattatctgaaactaagcatcaatcaacatataataatcaaagacaatcatgcatcccacatttacatcaaggacctagaattaaattgccaatgctttttaacctttgcattacctttgatgaggggagagaatatttggacttcccttcataatcatacatatgtaacccagcagagggtggtgttttaaacttctggctacctaagaatggagattgccaaggaggcaatgactgcatgtatgattttgctaaatcaactggagaacccatgtcagattcaaacccctgcaaaaatgaaaactcataaaggtaagtcaacaaaggaaccaaatattgctgtgacaagcacataaagattgatggctataaagatgagaatgaaaacacattaatactaacagagttaagcatatcagtgtttaatgtgcaaggtccatggtcttcaggctttgaacctaatccctgccttttctcttctaaccatttctttgcttccataactgctgcgcttaatagctcgggcgatgcatggagaggagaaccaggagaaaagctaccagatccaatactagagaatggaactggttcagtgccatttctgtggcgactcaaggaacgccaagctcccgtgaaatcatttccaacaacagtattcctggttggaatttctttcggcgttccatactcaggtgcttcaggaagtgcagcatctgtaactcgtgactgtatgagctttaccattttatcacattcatccctataaaaataaacatgaataattgagaaggaaagtaataggttataaggattttatttagagtaaatttcagataactacaactattttgccaaaattatcagtttactgtaacatgcaatactcatgcaaccatgtgcacctttagctaggcatttcagagaactgcaactataataaaggattttatcagaaagctgcaactttatttgtccgacaagtttttggcccacctgtcacacccatgcaatattcatgctggtaagtcaggcccacatgtcatacacacataagggtgttgctgctttgtgataaagttgtttggtatgattgcggttttgtgatatagcagttaaagttgtagcaaagtgatagttctgacaaaataattgcagttctgtgaaatttactctgtttaagaaaacgtagaatatgtatggatctattcaacataaaattctcagtatctcggcagcacacaccacaggcagaattgcatgcttagtactttgaagtgcaattttcctcatcctactgctacagagtgtctatcttatccagttgcaataatatcatgactttgattccttctccaactcaaatttgaatagttttacccttttaattcatagtaccctatagaattcatagtacaaaaaatcaaaagaagagtagctccaacttaggccatatgcacctatgcttgtattatcagaactgttttgtaaatgagaaataaactagatttctttactgttaaatttaatcgttagcagttgtccagggaaaaaaatatacatctaagcacacatgtaaagaacaatagcattacagttaccttgagaatgtctccttcataaccatttcctcaatggcaagctttgactcattgtatgaaactattgctccatgattgtcttctgtttcatctgcacaggtattacaaatgaacgcactcataaaccatcccaaaaatagttcatctgaatgtgggcagcacaatgtagttgtgtgagcgaacagtttacgaaaggtaaaatggctcaacagaattggaaacactgttccttcatatgcaaaagtacaaaacactgattagtctgcagtgcatccctctaaaatggtctaaggtcaattaaaagtgctgtccaccattacaaagctaaagatcgagcaccttctcaaaccacaatagaactaacaggtcaataacaaatagctcaactattctacattctggaaatatctagcatatgtgacaaaagatggctcaattattttctgaattccaataatatgcaccatgtcatcctaactcgatgttcatgcaagtaactgtggttcccaaatgaggttgattctgaaaacaaccatgccagatctaaattaagccctctgcacctcgtatcataattttcaggacattataaaccttaggatggtggcagctaaccaaatacatgcctttaattttgtgttgatgaatcaatgatggtatcttcgcaagcataccaaatggaagtgtgatgctgctgaagcatcgattgatgaatacagcagccggagcactccacattgtaaacttcaaattctaattccacaacactaggactgtgtaattggagtcaaac

SEQ ID NO: 61900 - DNA, 789 bp, Oryza sativa
tccgcgcctatttgcttgccagttgttgatcttggagatggcggcagctcagcaggcgcaagattcagctggttcgttgctttttttccccttttatttgggttgcttgttgattttggagttcttttttttttttgcttcactttgcatatcttctgtgttgaatttgaggagttgggtgggagtttatctgtgaaggtcgcgatcttggcggtgtttgttcgtgtggggatcgtggtaaatttgcgaattttcatggttttctggtcaaaattaaaattagcccaggactgagattttgtacgacgctgctgttctgatgctgtaaaatctcgaccttctcttctctctcttatttcttttcgttttttctttatttttttgttagggttgattggagaatagcaattttagatgccatttatccccaaaatcgattttgctgatagtgatttcttcacttgttagttagcatgtgctcaagcttctactctatttacttcgtaagttggtaaggtatctagttgtggcaaggtcagtaacaaagtttgagtaagtaatgacctaaatggtagttcatgatgtattaggcgaccaagcgttcatcactgaacaaaccaacatggataatttacagtgtagtttattatgggagcttgttgctgatgtcctggtcttacagaatcaatgcaacttaagcaaaagaaaaaactagaagtgcctccacatatttttttcactaataagaatttctaccgtggttctttgtttgttttaacatgttagcag

SEQ ID NO: 61901 - DNA, 1597 bp, Oryza sativa
ataaataggtagaaccagaaacggtagaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgaggtggctttgcagtattgagactctgaacagaacctctctcaaagaaagaactaaaatacgtacttcaagagaactcgattgaatcatggcccaaggcccaaagcccagtcgacgcacataaaatccaatctctcccggttgacggaccgatccccagtggaaaaagtctttgactgcttccactatcgcccgagtatgatttatttcctccaaccacaaaaccggtatatcgacttctctaactattaaaaccggtgcaaacaatatccctcggtagttttggaggtgggtttggctgatgtggtggtattgactaagtctttctcctacgtggcgcttacgtggcattaaaataaaaacaaaaataaaaaatatgtgggatccatatgtcattaaaaaacaattataggacccactgatatgtgggacccacctgtcatcctccctcttcttccctcttcctgcccctctctcccttgtctctctctcctccccggcctttctctcctcgggaagacgacggtgtggagaggcggtggggagcggcggcgaacgagggcggcgcgggagaggaggtggacgaggaggtagtaggcgcggagggagtgggggatcgacgacgacggcgacgaggaggcggcccagtagaagaaggtgagcgcattcctagcaacgagctccggggaggaggaggagtggcggtgcttggcaagggagaggaggacgacgtcgacttggtcggcagtggggaaggcggtggagagcgcctcccatgtcgct

SEQ ID NO: 61902 - DNA, 5611 bp, Oryza sativa
  unsure (1)..(5611): unsure at all n locations
agagagtttgaataatanaatctcattcttgcatgcctgcagtctactcttatgatccccagacttagtgacttaccgattgtatttggagacgataccagccggcgttggggccactaggcacgggcgcaccttcaggcgttgggcggtgggcggccagccagttagggcaggcgtcaggctttggatggacaggtagggtgcacaacagtgggcaggcagaccataggcagaggtgcagacgggagacaccgcgatagaccgagagatgagagtcgcacgtttgatttttggaggaggaagcattgaaacggtgccgcccctagcgccttgattcctggtcaccgcccttcccccttcctgtcgcgcgcacctggctcaggaaacataagcgacttctcaaatcctcctatctgttgggcgttgtagagctgtagttttggaccagagacttggaggggacttcctcggtttgggttgggggaggtgcctatgtgttggagatatgggagtaacaagttatttagaattttgggccggttcttgggcaacccatcccgacccattgggctctgcccctgcatgcatgcatggtggtgccgtatgcgcgcttttcttaccgtgatcatccggatgcccttggataggccgatcatgtgcattgatccatacataatattcaatcgtgtacatgtttgtgttccataggcggatgcatcagccggcgataccgggagccgagaggacaaccaccgtgcttgttagcggatacacagtaaattatattttgaatgttatttttataagatgcaccactagaaaactcatttttccatggggccaaaacctatttctccatgtggttggatcgtcgtttgcccggaaaggtctgtgaaaatagcgatttttccatgcggttgacaatttttttttatttttagactttttttattttttttaattttagtaatagatctttcccaaaagtatttttgaaaaccgaacaccagcaccaatggcgtggcacgagactggcgtggaaggacagcactgccacgctagctgcgtgtggcgtgacaaagttatttggccacaacaggcgggctggcgtggccaaaaagttcaaatttagaaatacttttgggaaaggtgtgaaaattaaaaaaaaaagaggtttaaaaaataaaaaatttcgtgggtggcacatccacgcaaaaatccgatttcggcatgcggttgtttatgttgtccacacacaaaaataaaaataataaattaataaaatctcaaaaaataaaaaaatcagaaccctagcttctctatggtggcagcggcgcggatctggccgtcacggggccggcagcggccgattgggaggcctcgtcgtcattgttgtcgtcggcggttgcaccgttgaggtccctgagctggccgccgcctactcccactcggaggagaggaagagagagagaggagatgagaggaaaataatatgaggagaggaggtgagggaaaaagggagaggagattaggatggtcaaatttgaagtgttgggagggaaaagggagaggatgagaaaaaaaaatctgtggatgcgagggggtatttttgcatgcggaccggttaagaggtccaaatgtaaaaatagactcatttttgtatgtggcccggtaagatggctacatgcgaaaatagatttttgcatgccggcatcttaaagaaccatatgcgaaatatgcgaaagggaaaataagattttgcatgggggcatattaaagagccatatgcgaaaggaataagttcactttaggtccctcaatttgtagtacagtatgattttcgtgctcagttctgaaaaccggatatgtcagatcccccaacttataaaaccatgcaaatgaggtccctcggcagtactaaccccggttttagctgatgtgacacctacgtggcgcgtatgtggcttctttgactaggtcttcggcccacgtggcattgacgtggcgctttcgtggcaattcgatcccgaaaaataataacacccgtgggagccacatgttagttaaacaacaaaaaatggtgaggccatatggccccacatgtcatcccaccactccctcctctctatatgtggccagtgcagaggggcggcagcgggcggaggggcggtgccggagcagtcatctcctcgccggtctcgccggactcccttccttcaactgcctcgccccggtggacggcgggggaaaggagtggcgtgcggcggcgggggagaagaggagcggcggtgggtcatgggcggagcagaggggcggagtggcgatgggccgcaagtggagtggggcgggcggatgagaaggacgtcgctggggtcgtccgcctcgcaggggtgggagaggagatgcgagcggcagccgacgagagaggagcaacgtgtgggctccggttggctagaggagaggagccgcgggcgacagaggacacgcgagcggcaattggcgggaaaggagtcgcgagcagtggctagagcagcgcgcgggtgaggagtcacgtcggcggcccgagcggccctgggcgcctgctagcgggaggagaggatccgctgcggcccgttgatgctccgcccgtggccctccacctcctcgtgggcctcatccctccctcctcacagcgctcccctctaacccgcgtgacgccgccacggagtgcatccacgtaaaggctgcgggcgcagtggagcggatggtcgtcgtcaaccgttgcagcgctcgccggcaacctcttcctccgccgcccgcggcttgcctctgccggcatgctctggccgctgcactccgcccgccctgctctccagctgctactgctccatgtgagaggagtgttgtgacgatgatgtggggctacatgggccctaccgttttttattattttgtgtgtgaaattgacatgttggtttcatagggttttattattttttctagatcaaattatcacgtaagtgccacatcaatgccacaggggccgaagacttagtcaaaggagctacgtaggttccacgtaagccaaaaccgggggataatactgccgaaggacctcgtttgcacggttttgtaagttgcaggatgcattgtatccggttttatggtcaagggataaattttgaactcggtgataaattaaggccccgtttagttcctcaaaagtttttttccaaaaacatcacatcgaatctttggacgcatgcatggagcattaaatatagattaaaagaaaaataattgcacaattaaggaggaaatcgcgagacgaatcttttgagcctaattagtccatgattagccataagtgctacagtaaaccccttccaacatccagtcaaacatccgatgtgacacccaaaaattttcatttcgcgaactaaacaggccctgagtgatccaaagtgaacttattcctatgcgaaaataacggtctatttttacaggcacgaccagttacagtccgtctgtaacctataggattctcgtgcagaaaattcgtttatgtggtaatgattggaataaaaatattctagcacagagtttgataaaataagatttgccaagactctaaaacttttagcagtccacattgtcacattgataacttccattagttcaaaggttgagtgatcatcacacgattaggtctcacacattgcagacaaacaggtactgttgcgataattcactggtggagaaaccatctttcgtcggtcggccgaatttcacaatagtcccggatgcaataaaaaccggggctaaagatgatctttagtcccggttaaaaagggtaacgggcatatttgatctttagtcccggttggtaacaccaaccaggactaaagatcatcatctttagtcccggttcaaatgctgtcagggcctgtcaggccccccaggatctttagtcccggttggtaacaccaaccgggactaaagatcgtaactttaccaaccgggactaaagatctcggggatctttagccccggttggtgactaaattcccacccctatatatatgtcttcttcctcctccagctgcccgagcaagcttcaaaatttcttcaaaaaagaggggaggtcatacaaatcggaggtgcctaaaaggtttgcaacttcatcctccaatgttttttttgtcatattacatttgcagctatgttttgcacacttttttgtctccaaaatttagttgtaagttgatgaggtagaaaatttgtgtagggaagaaagaatatatagaaatttagttgatttgctaaagaaggttttataaaatagttgacaaggaaaactatagtcaaagttaatcttgaatactagaaaacaaactaaaatgaaaattaaaagatgtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtatgattttttttcgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattcttcatccaggactattcatttccacttgtttgagtaggggttcatgccaagctataattgttggacatcccatggagagcacggtgttaaaatggaagaagatgaagtgaaagacgacaatattccggactttgctcagtacgttggatttgaaggaaatcaaacgggcgaggagaaaagggatgttgatggtaacgacgttgcggatgatcttggtcagatgttgcaggacgccaaggaggactgcgaaagtgaaaagggagcccataaattggacaagatgttacaggaccacagaacttcgttgtacccaggttgcgagcaggggcacaaaaagttggataccactctgaagttcttgcaatagaaggcaaataatggagttagtgacaaggcatttggcgatttattgaaactcgtcaagaacattcttccagagggaaacaaattgcccgagacaacgtacgaggctaagaagatagtctgccagctaggactggaagttcagaagattcacgcatgtccgaatgattgtatcctatattgcgatgaggagtatgagaacctagaagcatgccctgtttgcaaagcactacgatacaagattagacgagacgatccaggagaagttgacgggcagctaacaatgaagagaattcctgctaaggtgatgtggtatttccctataataccacggataaggcgtttgttcaggaacaaggggaatgctagactgatgcgatggcacgctgaagagcgtcaacaggacgggatgctgagacaccccgccgatggttcgcagtggcgaaacatagacagaaaatttaatgaatttggataggacgcacgaaacaatacggttttga

SEQ ID NO: 61903 - DNA, 2114 bp, Oryza sativa
  unsure (1)..(2114): unsure at all n locations
atttaagactatcattttaaataagaaaaaaaagtgggtgggtttatctaatttaagatcatttaaaaaatgatattgaacattttcttaatcgactttgttgttcaattcctcttgttaaatatggacagcctgattgtaatgaataaatgggtcattttcggtttctctaccctcttcctggtattatccaggttagtgctagggttaaaaatagtatctgaaatgtaacaattaggaactaaacttagtccctgtcacattcgatgttgggacactaatttggagtattaaatatagaatacttacaaaactaattggataaataagagctaatctgcgagacaaatttttaagcctaattaatccataattagcacatgtttactgtagcatcacataggataatcatggattagttaggctcaatagattcgtctcgcgaattagtccaaggttatggaatgggttttgtcattagtctacgtttaatacttctaattatatggattagttagggataatcatggattagttatgctcagtagattcgtctcgcgaattagttagtccagggttatggaatgggttttgtcattagtctatgtttaatacttctaattagtgtgcaaacatccaatgtaatatgcactaaaactttgtagcctcatccaaacccttaagacaaatatacctaaatctaaatgcaaagaacgtggaggattggttgtctcatataaggaatgatcccataaaaatgagctattagaggattggttgtctcatataaggaatgatccataaagctattgatccaactatcacacatcagaagcgatttaaatatattgaagcagtagtgagaaaaaaaatagagcagagattatgaaagaaatgccagtacaaccaaagaagaaataaaatggacgatgaaccacaagtaacaccaaaggatgtagtgaacaaactaacaacaatgagctctggacaagtaagtaaagtaggtaagtagtaagctatatgagatttgatgagaaaaattggttgccaactgctgaacacaaccaatctatctggagatatacaaatatcaatagatgacataaaagataaataagagagaggcttgacttcaatacttcggcattgtgcaaatcatatgataatacattagtcggtcaacgaataaaccagagaagtactattccagaattttaaaatatattacatcatttaagaagagatgtttccaggggcattatccaatttttaagaggatatcatgtaattggagagctggaatatcgaagttgagggggtaaatgagagcttgactcagattccggatacgcttaattggtgagctagaacatcctagtttgaatgagcaaatgagctgaacatgtaatatctttgcgttctgtgtcatatgaacgagtagatgagattataagagaagatttcctgtaattnttttaggtttcttgttatcataatttgtaggttggatcgtgctttagttttgataagtaaatgtaattattagatggcaaatatgacccttttatttttgaanggaaaatacgttgtttactgggtcttttcagtgagccttttaggctaaatattcttgcaaaccacgtcatgatgatggtcagtgttgtatatcattcctaattggtccctgttatctcgtctacacttgactactcctgctagttttgattggtgctagctttgaaacttgcatactctctctgtctaaaaaaaagccaatctagtactaagatatgacacattctagtatcacaaatctggatataaagtatgtccagattcgccgtactaggatatgtcacattttaatactaggctaatttttttttggacggaaggagtatgatgagtagcattttttttctatcataacaggtaagtacatggtatattgtttatgcatgctccgtctcccaagaaatttacattacatattgatatttgtacctttgttatgttattgaacgaacaaatgttgctgctcttgctatacggtggttcttattagttactctctccgtcccgtaatataagagattttgaatggatgtgacata

SEQ ID NO: 61904 - DNA, 791 bp, Oryza sativa
ggtcagcaatgcaggacgacgcctcgtccagggaggagcgccgcgggttgaagtgctccagcgacgacgtgtcgtagacagtgttcacggtgcggtacacggagccggcggcggcggcggcgtcgtcgtccgcctgcccctgctgcggcgccgtcggccacctgaacgagctggtgcgcgggtgccggcacgacggccacggccacgacgacggcgccggcgggtagcagagctgatgccggccgtggcagtgcggggacgacgacgacgagggcgacgtcggcgtcggcggcgcgcgatggtgcacgtcgcggagcttgtacaggataccaacgagccccttcttggccatggcagcagccggctggcgtccgccgccggcggccacggcgcgcgcccgcttcctgagctttccaaagtggaggtggggagggttcaggggaggcattgcgccgccgtgtttgacggaggcggtggcgtggcgtggcgtttattttcgcttgtgttttatagagagggagaagagaaagaggaggttgcagcacatttacgagagggttggagagggtttcagtagaggaattgaataccgccattgaatggtctattggccaatgactagcacaagatttgatgtggtgtgtctttgggtgtgtttagttcacgttaaaattagaagtttagttgaaattaaaacgatgtgacagaaaagttaaaagtttgtgtgtgtagaaaagtttggatacgatgaaaaagttgaaagtttgaagaaaaattttggaactaaactt

SEQ ID NO: 61905 - DNA, 854 bp, Oryza sativa
ttttatctcattaaaatatgtttatagctagctaatagtccgccattgtacctgctctaagctagataatcattgcgggtgccctaggacaaaatgagatgcagacgtcgctgcgccgcgcgacaggagcagcagcaccgaagacagcggtcgcttcgacatgtccgatgatcaccaagattcccaaatcccaagacgctgcacaatctggaaacctaccgggttgccttgcctctctctttagacctcggctggctcggctggcctgcttggggaagatgtccgaactccgaaccgaccattagtgcaaataggtttcccggtcaaattcgatcagaggtacgaacgtagcgtaggcgtagcgcataatttttcaactgttattatcatcaaaagtaatatattcactccagcatatgcagaaatcaacggcaaaattttgccaacaaaaatgcttgtgatgctgttcagcactaagccactaaaccacatgggcacagtgttaaatcatatatttcttgcagacacaaggtaattatatccaccagaatacatattgatcattcacacaacaaaacaacaagtatgaaagttcatacaaacataagcaaacgtacattcctgaggcaaaaggttctctactgctaggagagatttactgctgcatcaagtcttcttctggtaggactctgaaaaacttgagggagcaggacatcgatcatctgctcggttcatgtaaagatgcatccctcttctgcttgaagaaaccagagatggctgcaaaggaaaatactaaagcatggtgagattatacattagttgcgaaggaagatgaaattcatccaatgtatttg

SEQ ID NO: 61906 - DNA, 28901 bp, Oryza sativa
tttcagtggcatataagagattctgcctagttgtatatagcagcgcggcagtattatctgttcagtaggcccgaactacaaaaaccacattgaatctagtcccatgaaagttttcatatttttttcaaaacttctcaagttgttgaattttccaggccccaaaaattttcaatacaacttttttctaaaaaagataatttctactacctccatattttaatgtatgacgccgttgactttttatctaatgtttgactattcgtcttatttaaaaaatttatgtaattattatttattttattatgatttgattcgtcatcaaatgttctttaagcatgacataaatattcatatttacacaaaatttttaaataaaacgaatggtcaaacattgatcgaaaagttaacggcttgatacattaaaaaatattgagggagtactatatctaaacggcgacgtggcagcgggtcgcgtgagcgtgaccaaagtgttttgttttaaaaataatttaatttttggaatgtttttcttaagaaaagttatcgatcgaagagttcgattttaaatcttaatggcataaaatttccaagatgttatcaccaatcatcccatggcataacggatctgaattaaggaatctactactaaaaaaaaaacttggccattagttaaccagtcgggtataaataggagcaagaaagcaaagagaagaggaaacagagcagagaagcagagcaaccatggccgcgcgcgtgctccccctcctcctcgtcgtcgtcgtcgccgcggccatggcgagagcccccacggcccacgcgtggggcaaggagggccactacatggtgtgcaagatcgccgaggtgagagatcgatcgatcgagatggattccacctcgtgctttgcgcttgcttgattggtggggaactttgggtttgcttctgcagggtttcctgacgaaggaggcggcgacggcggtgaaggagctcctccccgggtgggccggcggcgagctcgcggaaacgtgctcgtgggcggacaccgagcggttccggtaccggtggtcgagccccctccacttcgccgacacccccggcgactgccagttcaactacgcccgtataatctcctcctcctcccctgattagcattgcagtttcagtttcagtttcagatttccaagtagatcgattagctgtcgcagctgattagcagttggataggttgatagaaacctgacatgtgtctgatgacaagttgctgtcataatgagtatagtaagcaacctcgttggagcatcttgatgatgcttagtagcttcttggtccggttaacagccggccagttggagcccatcggttggcttattcgtgcagcatatttaataatttgtgaataaacttttatttatatgtttttagcgaacggaaaataatttgtgaataaaacttttatttacgtgttcctagcgatctaaaagagataaacttcgatgaaaaaaaccttaaaatcaactccgaatttaaggttgaaaatttaaattttggctcataagaataagtacaagcaaaaaaaatgagacggcagtttggactgccaaactcgacaggatgcgtctaagtataggttgcgtcttgcttgtttgattgggcaaagcaaaggcaagctcgttaggctcgtgtagccgtcgtccatatagatggcatgacattgtgctggacagaaaaaagggaactagtctgaactctgaagcctctgtttgttcctgggatcagtggtaaccgtttgcctgaattatctgttcatgcaatgattgataaaacgcttagaaccatcatgtatgggtatggctatggtagttgaactgttaaagtccataaaaggggtcaaacttagattaagaacaaaaacgaatcgaatgcaaactgtatcaaaaattcagggtgctgtcttactctcttatgcctagtgcgctgaattttgagaaaatgagtaaatgatgagacgcgtgattgtgccatttctgcgcaggggattgccacaacacaaacggtgagaaggacatgtgtgtggtcggagcgatcaacaactacaccaacgcgctcgaggactcatcaagtccatgtaagcatcactagtcacacttctgctcctgtctgtattttcagctgtaatgaagtaataaactgaacacatggcatctcacatgtttgcttgtgataactttcagatgatccaaccgagagcttgatgttcttggcacacttcgtcggcgacgttcaccagcctctccactgcggccacgtcaaagatcttggtggcaacaccatcatcgtccattggtacacaaggaagagcaaccttcatcacgtacgtagagcctaacacagatcgaattaatccattaataatttatccaattttgttctttgtgaacagctaacttaatcttagcattgtaaacttgtatcgtttcaggtgtgggatgtgaacgtcattgaaacggccttgaaggaattctacaacgaggacgtgagcacgatgataaaggccatcaagatgaacatcactgtgagcaagctcgacacttcactgccttgagctgcatttcagttttctcctcatctgtagactgtagtggttttgattggattttatgccgtgcaggatgagtggtccaccgaggagaagcagtgggagacttgccgtagccggacaaagacttgtgccgataagtaagctcatggcctgcatgaatgcatgattttggctgaatcgaactgaaatataaatattcagagattgacagctgaaagcaaatgcaggtacgccgaggagagtgcaaagctcgcgtgcaaagcgtacgagggtgttgagcaagaatccaccttagaaggcaagttcttcaaaacaccaaacttgctttcacacattcttaatgactgatttgtgatgccattaacattaagagcaatttgatgtgatgcttgttcttgaaaactgcagatgactatttcttcgctgccctgcctgttgttcagaagaggattgctcaaggtggcgtgaggcttgctgcaatactcaaccggatcttcagcgggaacaaggttcagagtagttgatccaatagagattaaacagatgaaagattaagaaaatagcccgcattctgaattacaataagattatcttgtttgaccatgttaacttcacggttacgattagatgtatcctcatttagccatttgtcaaagtagcttagatagctacagaacattgtaattcctgtaagcaagtggtgatttatcaatattgcactgtctttttgtatcattgatcatctttcaggctgaagttaagctacagccgaaacagtcaatctatatcgggtagatcagatgcatcgaatgcttgatgaaatgcaacttgaggattactattcattaatcatctcacgaggagaaaattgtgattttgctatcgcaaaaggatcgtttcgctagaatactatcccttcaaagtgattcattaaaatgctatcctaaactgagggtattcaccaaaatgctatttttggtcttttttttaatagaaatgattttgctctactttagtttttcgtctgaccaaaatacccttctctcagccgagaccaaatcgaagccattctctgccttctcttctcgggctctcggcagcggcgagcgccgtcgccctctgctcggctccggctccagcgccggcccccaccgctccctcacctgctcctccccttccccctcccctttctgctcgtgtcgctgccgcctgtctgctcacgccgtcgccctccgcatcggctccggcgccggcccccgacgatcccccacgtgctcccccctcctcccccttttttgctcgcgctgccgccgccccaatcattagcgccccctccacagccgccggcgccgccctctcgccctccccgccctccgcccgctccgccgcggcgcgccgccgccaccgaggagcaatcggcggtggattcgtcgtcgtcggtgacgaggttagtcccgcgccaccagcccaccacgcccgccccaccctcgccatgcctgccagccggccaccctcgcgctcccgacggcgtcctcgagagagaggaagaggacgcccaccaccgcctgcatcgccggcgacacgggctggggcttcatcaaccctgtcgccgctctcttcttcggggacgcggccgccggggagttggacgccgcggcggagcgaaggaggcggccgggcggggcgggcagagggcggcgagctgggagggggagagcagtggccggtggccggtggccggggaggcggagcgccggtggtcggaggagagcagtggccggcgctcccgagagagagaggaagagaaggaggagagagtggagagagtatgacaggtgggccctcaggggtattttggtccaggaaaatgttaaaattgaggaaaaacatttctatttacccaaaagagcgaaaatagcattttggtgaacacctctagtttaggatagcattttagtgaatcagtttggagggatagcattccagcgaaaccactcttttacgatagcaaaatcacaattttctctctcacgagtggacttattagttaaatcacatgagttgcctcagaaaattcagtatcaccgcacgcgttcacaacgaagagtactgaaaaaaaaaaagtaaactcgaccgattggcaattgttttaagagaaatccttgacaaactcaactctcgtgtttctatcaaagctttaatctattttagcaacatggggcaagggcaactctcgtgcttctatcaaaactttaatctattttagcaacatggggcaaaggtcgataagccatttctactctcgtgtttctatcaaagctttaatatattttagcaacatggagcaaaagtcgataagccatttctactctcgtgtttctatcaaagctttaatctattttagcaacatggggcaaaagtcaataagccatttctatcagttgtcagttgaattcgtccccatagcgacgatcaagtcttcttttttttaaaaaaaaaaaaaaaaactgaatcgacggtcaagtcttgtaagctcattcgtgcaaatatcatatgtcattgtaacaatcatcagttaagctgaaccggtcccaagaacctgacgcaggcttttcaaattattaaacggtgatttgaacaactttgccaatttcactctttcgttttctatgcacacgctttttaaactattacagtgtttttttttttttgcaaaaagtttctatagaaaagttgtttttaaaaaatcatactaatctattttttaagttttttttaagctaattctcaactaatcatacgcttataaggtatcccgttttccgtgcgaagggaattaattcccaatacaaggaaacgaacacaaccgaggctaagataagtaggaagtcttttacccttttgttatctaatatgttacagaaaaatttaagagttcagacgtccacagcaacaaatgcagagtggaaaactgaagaaagaaaaaaccattgctccgaagacagttcatacaagtaaaagtgaaattaagcctcttcactggtaaatactcgaacaacaagattgagtgagccgatgagtttcagggttcgttcttcagcagccaatgtggtttgtcaaatttaagcgtttgtcttcaaattcctatgtctgaggataccgagaacaagaatttatagaagcttcagaccaccggtgacatcatcgaccatgtcagctggccctgctcaattaaaacagtacgacaaatattagatagcacaaatcactgaaaactgtggtacacagtgatttgaatgtagcttaccaagaatagccatgactgttcttgaatctacaggaagcagagatgggaacataattaatccaacagcagatattaaacagatgctaaattgaataaagtaaagcctgaagaactcacttggtgcgatctgtgttcttccagcatcaatagttatgtgtgttgggatattcaaagactttgctcttccctgcaccaaaagaaattttaattaaacataacagaaaaaatgcaagcattaacaacgttttatactattatggaattgaaaggtaacatattagctatataaaagatctcgttgaatgcagaatataaatattatgatgcataagtgtcaagtgttgggtttcaagaagcgcggtgatttttcttttttcacagccaatgtttcagagtgagttttccaatcgaaatttcaagttgttttaaccaattgttcgttgatactactaatgctctagtccacttctaatgccatgagaatttcctttttatttattaatatgcacaatttgacaggtaaaaggggaatattttctgtttctgttcatctgcaggtattatactattccaactcacaaattacctttatagatgtagtaaaaataaaaataactttcaacaataatgagtcaacaggcaacagaaaagggtatttacttgtaaaacaagcatatcttcctcgctttcaattttcacgaccaccttaacttgaccacacctctcccacctagcaaagatagtaaattagtttccttcctgttgttatcatgcaatgacaatcgaattgcttacatatgaacatgaacatgtggaagaaacttcaaacataattggaaatgttaaaaaaaataccttcttaatgattttggagctctctgttggagttttttaaacagacccaacgttgcatggctgagatgacagaataagagataatcactgacatttgcaagataaaaagaaatatgcacaggagaaaagttataaagcatgacaacactccaatgctgaaggtaaagattaaatgcaggagctggacatgaagataagcaatttgtttgtgccaattcatttattccataacgacaagtgtatagtacaactgtataagaggcaaatttagttatggtaggatatataacaagttctctaaatcacaaggtcaacgtgccagtcccaaaaatatgagttctacctcttgtagcctcagataacaatatgatcacaaaatttcccccttcaaaaaatgggaaactctattcgaaaggattcttcctattttaacattggtttcaactttcacattcagacacacaatacactaatagcctatcactatgtgctaattagtgagctcagttcatcagtaaaataaactctactcaactgtcgaaacgaagatacagataaactgagaagtattcacctgcattgcgcggcaatcttccccttccccatcttcaaatcattcctcacaaccagcacctgccaccaccacagcaacagccaacggaatcagacatctcactctctgcgcacatcaaagaaacaaatccagcagaaaagtagaaggggattttgagccaaatttccagtaccatcttgaaatcctctataatctcagcgagattctcgacctccagggggctagccgcggtccgtgccttggccctctcggcctccttcgccgagtcggacttggtcaccacgttgcgcgcccagaacagcagccggagcccggcgcgcttgggcgcccgcttcgccgcccggctgcggccggagttttcgtcatcatcatcttcttccgaatcctcctcggaatcctcgtccgaggtctccccggaagcgggggaggcagcgacgacctggcgggggaagcggctgagggcgaggaagtagccgagggcgaagcagcccgcggcgccagctatagcggtggcggctcccgggatggcggccgccgtgggaagggagaggacggaggccgaggcgcccatcggaggatcgccggcgccggtggcggcggcggcggcggcgcaaggcggggaggggttggggttggggatgcgcgatactaccgcgtgggggtttcgggaggaggcggtgatttaggtggaggggatgattctgacaggtgggcccaacggctcagcgaatgaacggtacgtgcgtccctggaccgtccgatgggggattggcgtctgggatctcgcgaatcgaggcgcgacacgtggcaggtcgcgccgtgggccccactaagccacgtgtaccgcctgtacgggctacagcccggcctataaaggccagggattcgaactagcataacccggcggaataagttcactttgggtccctctatttgtcgccgagtccgattttcgtcccttgaccgtaaaaccgggtatgacccgtcccccaacttacaaaaaccggataaacgtggtccctcggcggttttgaaggcggttttggatgacgtggcgcatacgtggtttgtttgactaggtctccgtcgcacgtggcattgacgtggcgcttacgtggcaattatatctcggaaaaataataaaaagcgtggccccacatgtcagctgcatataaaaaattatttaaaaatggtggggcccatgtgggcccacatgtcagctacacaacaaaaaccccacgtgggccccacatgtcattccctatctcctctcggctctctctcatcttccccatcgtcgccacaacacgcgccaagatgtcgtcgccatccatcgccgccgcctccatcgccgcgcgcaaagaggagggagcggcgcggcggctgtggccacaagaggaagggacggcggagcggcgcgaagccggcggagagggaggcggaggcggagacggcggcacgcgaaggaggagtcggcggcggcgggtccgaagtcgtgcagctccggccgccgctccctcctctcccgtcggccgccacgggccgctcctctgccatcggccgccgcgccacgctttgcccgaggcccgccgcagctgcttcctcggatccaaggctgcctcattctgagcgtcctcgctgccgagatccaagggcgccgccactgcttccccggacgacctcgactcccgcgggctctccgccgccgctccgaccgccgtcgtgccgccgttgtcccgccagcttcgcgcgccgccgctccggccgccgtcgtgccgccgttgcccccgccggcttcgcgcgccgccgctccgaccgctgtcgtgccgccgctggccaccgctccgtccacgtggggaaaagagaagtaggatagggaagaggagggagagccgagagggagagggaatgtggggcccacgtgggccccaccatattttttttatagctaacatgtgggcccacgggggccaccattttaaaattattttttatgtgtagctgacatgtggacccacgatttttattatttttcaaagatataattgcgacgtaagcgccacgtcaatgccacgtgggacagagacctagtcaaacctgccacgtaggcgccacatcagccaaaaccgctatccaaaccgccttaggactttatgtgcccggttttcgtaagttgggggacgggttatacccggttttggggttcagggacgaaaatcggactgggcgacaaatagagggacctaagtgaacttgttcctaacccggcctataaacgtggcatgggcctacatttttgcgaattgcataggcccattcgccccgtgctcgcttcaagattcgtgcagcttacgttgcagcgccgatgcatactgctacctccgttcaaaattaattccatttcacctatcccacacgaaccaatacaaaatcaaaagtagaatactcaaaattagaatgatgtgactgaaaagttgtgtgtgacaggttgatatgatgaaaaagtactgaaatttggatctaaactttggatctaaacacagccattgttagtcaattaagaatcttgaagatcatgctgaaataaagaaaatgtttatattttaggatagaggaggtatttttttatatattaatttttttagaccgacggaattcgtgcagagacagctgcgacatcaaatccatcgatcggtacctacggtacgtaacgtgcccgtcccatcccatcccatccctcgatggatggacggatatactccctcggtcaacaaaaaaaaaaaagaccaacgtttgaccgtccgtcttatttgaaaaaattatgaaaaaaattaaaaagacaaataacgcacaaaattttaatcatgttttatcatctaacaacaatgaaaatatgaattataaaaaaaattatataagatggacagtcaaagttggacacggaaaccagggttcacctttttttagatggagggagcacggagtatgcaacgacgcaatcgcgcgcgagtccgtctgtttttctctagcggtacgtgcaatgtcgattcggacggttggtaatgtcgattacagtagccacgattaattaacccatgtcccatgtgcgcaggtgccggaagcccggaatccatcgagttctcgaaaggtccctgtactagctactccctctctccattaatacagaggattatgctccctaagtttatccagaaatttaagggattccgagataagaagtaaagcagcaatcagaaattgagtacccccatccattcccatcagaaaaggtatatagtgaaaagtacatgtagtactactctgcatgcagctcctttgaatcctatcttagttcatttctatgggccccttcgaatcgtaggacggagaaaacatacgaataggaaaaacgtaggattttaataggaatgtaaatgtataacagaggattgtaaaacgcaggaaaaacacaggaatgaccgtttgattgaaccaaggaaaaacttagaaattagatgagagagatagactcaaaggaaagttaccaagaggttgaagctcttgctaaatttcctccaaaatctctataggattgtccattctataggaatttcaaaggattggatataattcgatcttttgtttcaaagggcttcataggaaaatttcctataagattgaaatcctccaaaattcctatgtttttcctccaattcaaaggggccctaaatatgtattttatactacctctgttttttaatagatgacgccgttgattttttctcacatgtttgaccattcgtcttattcaaaaaatttacgtaattataatttattttgttatgagttgttttatcactcatagtactttaagtgtgatttatatcttatacatttgcataaaatttttgaataagacgaatggtgaaatatgtgagaaaaagtcaacggcgtcatctattaaaaaacggagggagaacgcttcattcagtttgctaataagttcattttcacactatcacatgctcctccatcccaaaaaagtatataggttgggttttttttttatagagggagtactctgtagcttagatttagcattccgtactcttccttaatttgaactatatttggcataatactctatattcctggacggagggtgtattagtatagaatattcatatcataaggttgtcttcgttctctcactttctcaacttctactatcttgtttccgtacgtatactttccaaaccgctaaatggagtgtttctttttaaattttctataggaaattgttttttaaaaatcatattaatctatttaaaagtttttttaagttaatacttaattaattatgtgctaataggttatctcattttttcatgcgtgagacatgaattaccaacgtccaggttcacccatcctatgtcgatttgatttttggtcaaaatcaaactactccaagtttaatcacgtttgagagaaaaatagtaacatattgaacacaagacaaatatatatactataaaatataatcaattatagatttaataaaattaatttggtgtagatagtagtattagtatatttatctattgtattgaataagagtatatttgtctatcaacttgaaatagtttaatggacgatggagtagctaggtggtagagctagcggtaactggttgatttgattggtacggatgttacgtgtacatgtactccgtacgcaggtatacgtatggactacgtacctgctgtcacgccctgaagttttccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaattttaatcccaggaaaatcctttcttctttttctttttcctttttcctcctttttcctcttcttgggccgtcggcccagtccacccgtcgcccgcgctcggcctccccttgtgggccggcccgttccctttccccctctctccgggacgctgacaggtggggcccacctgtcaggtcgtccccttcctccagccgaccgcgctcggccggcaaccgccgctcccacgccgccgcctcctccgctctttccgcgcccacgccgcgccgctcccgcgtcctccccacgtcgccgcctcttcccccgcatctcccggcccgcgcgcgcgctcgagagggcgggattcgagttcgaatcccacccctctttctctctctcctccccacgtcgccggctaaatcgggagggttcccggccacgtcctcccctccctcgcccattaaatcactctcccgagctccctctctcgtttcccccatttcccgtcccctcccgtgcctcctaccgagctcgcgccgcttgttgctagcgccgccgcttgccgtcgccttcggccgcgcgccactgccgctagggtcgccgccgcgccaacccgccaccgccgttagcttcgccgccgcgagagctacctcggccgccgctcggttgccgccaatcgtcgccgaaacgccgcttctctcgcacgccggtgagctctccatttccacccaactccggccggccgctctagtggccgtggtcatcctccccttcccctaacccggtcatcgcctttcccaggttgtgctcgaccccgtccgccgttgtcggaagcgccggccgccgctcgtctcttcccacgccggtcgccgccatcgcctcggtgaggaatcccctttcctccttcctttcctctcccccgtgagcgccgccgccctccgcgcgtgcgccgtcgtcttcggctgccgccgccgccttcgcgcctgacggagctcgtggctcctcaccgggagaccgcgcaggcccccctttgccggttcggccgggggcttagggtgagatctcaagctctctctgtatgtggaaagatcgcttgctcggaagaaacgcgagacacggcggcgatctatacaggttcgggccgctgctcagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcactgtactgcgttgcatgcagcgtgacacgcttgaccagactgcaattaatgctgttaggtgagcacagctgtgctcacttatcccatatatgtggcgcagacttccttaaagggtcggggtgcctcggccctcggggccggggcaagcgcaacccgaccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaacccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcaccgagaaaaggatttgctcccttcctttcgccattgttcctcttgccttcgccgcctgagctctaactctttctctgctacgccctactttcgccacacgcgctcgttctcaatcatctcttcctccaccgccatggcacggggctctgctctgcacgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggtgcgcctgggagtacactgggcctgaagactacatgcggacccaccagggagccagatgggattgggctcccgaggacttcaagatcgtggtccaaagggtgctgaatcttagctccgtggaggcgtctcgcattcctcaggtgatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagctttttcttactcattttgttcgtcttctggttttttcttctgcttcagtgatgtcccgtcgcattcctcccgccaccccaagtccggccagtccgaggccgaagatcctacggccgcggaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctaaggcaacagctgctgctggcgcgtcaactgggcccaccccttcgggcaaccctcaggcgacagcctccggggaggctcgcgacgaggccgcgggcacatcgcttgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcaacgcccaagtggaggccctgcgcgcggaacgagcggagctcgaggccgcatgggcacgtgttgaggaggggcggcgctcggtggacgccatggtggaggtgggccgtaaagctcaccgccgtcacgtctcggaggttgaagcccggaaggcggcgctgacggagatcgctcgtgaggtggaggaggagcgggcggccgccctcatctctaccaccgcgatggtcgaggcgcaagacaccctccgccttcagcatgcaagctgggaggcggagctgaagaaaaagctcgacgccgcccaaggggtccttgactccgccgctgcccgagagcggcgggtgacggagactgaagcggcgtctcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtccgcgctccgcctccgcgaggatgcactcgctgagcgggagcgagctctcgaggaggccgaggccacgacgcaacggctggcggacagcctgtccctccgcgaggcagcgcaggaggagcaggcgcgccgcaatctggaatgcgtccgcgccgagagagccgcactggagcagcgggctgccgacctcgaggcgcgggaaaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaagggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggctcgcgttcgcccccaactccgacgaggagggcaacaccagcagtgcagacgatggtggtgacgaggtcgtcgactcgggcgcgtcggaatgagcccccgagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgatttcagctgaccgaaccgaacccccgagggcaaggttgagtacgagtgaccttattttaagtcaagattcttcaaaaggaaagaacagcacagacacaacctttaggaaattgaaactgcttttattgaaatgttgaaaaaagagaaataagaatgtaatgcatgtgtggtagcccccggtcaaccctgcacacccgaggggggtgcggggttggcctgagccaaaacctgacacccgacccccccctcctcaggggtagaagcgacgaaggtgttcgatgttccatgggttaggcagctccgtgccgtcgcccgtggccagccgtaccgagcccggccggggaacaccgatcactcgatacggaccctcccacattggtgagagtttgctcaatccagcacgcgtttggacgcggcgtaggacgaggtcgtcgacgcagagtggtcgggcccggacgtggcgctgatggtagcgccgcaagctctgctggtagcgcgcggctcggagagccgcgcgccgccttcgctcttctaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaagatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctgagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgtgggtcagagctccggtactccttacagacctggttaacgactagctgggagtcacctaataccaagaggcggcggatccccagtccagctgccactctgagtccggcaaggagtccctcgtactctgccatattgttagtcgctcgaaagtcgagacggaccaagtatctgaggacgtcccctgtcggggaggtcaacgtgacccccgcaccggcaccctggagagacagagaaccgtcgaactgcatcacccagtgggtggtgcgaggcagctgaaaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgtgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcattcttcgtccaagtggcctctcggggcgcactcgccttctgtgccgatgtcctcggggtcggaggatgacaggagcggccttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgttaggtgcggccttcccgcagtggcctcggggccctcctgagggtcgggggcacccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgaggagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaagcacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggacgacttcacggatgaatccggcctccagaagtctcgccacctcctcgcggatgaaggcttgacgttccggggcctgccgccgcactttctgccggaccggccttgcgcccggccgcacggcaagacggtgctcaatcacctccctggggaccccgggcatatccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcacagcagcgaggtggtccgcacgctgctccatgcaagcgagcgcgactttaaggtcgccacggacagagatggggccaccggggcccgacatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcgaaagtgagggcaacctccgaccaccgcgcccggcgcgtcgcctcatgagtaggggccgcggccagaagctctcgcctcatggccttaaaactccggcgagaaacgtgagcacacgctcccccgtcgacagtggcaatggtggccccgggttcctggaaacctaggtcatcatcaccgtcatcaatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagatcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatactcctcggtgatggtgggccggaaccttgggggccaacggacattccgaagactcgccacaaaggctctacagccaacaccaccaaccgggggcacggagggctggtcctcacgtccatgtggaggtgacactctggacgaggaggcgccctccgttgtgtcacgccctgaagttttcccccgtttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataatttttaccaattaaaaatcaccaaagtgaaatttttaatcccaggaaaatcctttcttctttttcttttttctttttcctcctttttcctcttcttgggccgtcggcccagtccaccccgtctccccgcgctcggcctttcccttgtgggccggcccgttctccttcccctctctccgggacgctgacaggtggggcccacctgtcaggtcgtccccttcctccagccacccgcctccgacggcaaccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaataggatgggttcccggccacgtccgcctccccctccgcctataaatcgttccccgcgtcttcctctctcgttttttcgcactcgccgcgctctcccgtgccgtctaccgccctcgcgccgtcgcacccgagctccgccgctggccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctctttccacgccggtcgccgccatcgcctcggtgaggaatcccttttcctccttcctttcctctcccccgtgagcgccgccgccctccgcgcgtgcgccgtcatcttcggctgccgccgccgccttcgcgccggccgccgccgtctccccgcgccgccggtcaccgccggcggtcgtgcgccgtcgtcgcctcgccatggccggccggcttgagccgtgccgagcatgccgccgcccactccctcccccttgagccactgcccgtggggcccacatgccggcgcctccctctcctttccccttagtgccgctgaccagtggggcccacctgtcggcgcagccgccccctcccttccgctgacgtcagccctgggactattgcgcaataaatatattaaggcttttcttttatagaaataaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgtgatctcatcagtgcgagagcaaggcaagtcatacattgcaattgatcatattgtacccaatttacaaatgtcccgcatttctattaaatattgcattgttttacaatgtaatgtgggatgggtcctattcctcagccacatattggttaccttatgccattgataacttggggatcaaaatgactagatgttggcctaggaaatgcttagccatgcttagctcaactagcacacaaaaagggatcacattattacatagactttgtctattggcatagctttagattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacacgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgtcttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgtatcacccgcgaccggtgatgctgcggatttatcaaccctctcgagcgcctccccctgcttaggactttggtgtggaggaggtgggggagtacgagctcgacggcgtgggtttggctccccgtcgtcgccgctcacactcggagagaggtcgtgcacctttgcttgctcggccattaggctgatcaagaaaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagatcgcttgctcggaagaaacgcgagacacgtcggcgatctatacaggttcgggccgctgctcagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagacccccagccgccacctaacccgtgatctgaccggtctgtg

SEQ ID NO: 61907 - DNA, 3362 bp, Oryza sativa
accggcgtgtgatcgcctgatctagctcggtcaaaggcgtacgtggactacgagtgtgaagagaatatataaaacgcgatcgagtacgagttctttcttccttgcagctttcatggcgctgctagcttcctgattgcagtagcagactagctaggccgtttgatgacgacgcatgtacaggacggccggcaataattaatggacaaggccagggaccaaaaacgtttctccccatattttccagaatggtactatcaaattaagtcacactattcagagctcaggttttatttcggttcatggttaagggtgtactcttctgttttgtttttcaacttctactttctagttgttgtgcgcacgtacatttcccaaaccgttcaataacacgtttttttttttgcaaaaatgttactatataaaagttgtttagaaatagaccatggtacctttctgtttattctgcgtgccgagtagaaaagatttccaaccctcttaaaaaacacgaccttagttgtcagccatgtatccagattctagaatatagatatcaacataatgcatagtagtagtaattactccctccgtctcaaaataagtgcagttttgcactattcacgttcaacgtttgaccgttcgttttatttgaaaattttttatgattagtatttttattgctattagatgataaaacatgaatagtattttatgtgtgactaaatattttcaatattttcacaaaatttttaaataatacggacagtcaaacgttaggcacgaatatctacggctgcacttattttgggacggaggtagtaagtagtaacacgcaggttttgattggttcgtggttaaagtcgtcaggatctccacggcggcgtaggatagggtcaaacggtcggtgaccggcgttcgttcgctttgtcatcctgagctcagccctcgggactctgaatagattgggaaccgggcacgaaggctgcgagagcaggtacaatagatagccagctgcttttgtccaccgctaggcctcgtgccaaacctcaccgcacgagctagtggcagatcggcaatagccagcctgcggattgaccggttctacacgagagtccgggctaagctcgatcgatcggtcggggacgttatggttgccaatcaattcgatcaggaaccgtccgtgacgcacgcgacgcgctcgcgcgcgtttccgtttcctccctcgcttcccggcggttggatcacagtggttagttggttatacgtagtgattcagcgcgccgctcgaacgtcaggtcagcgcgagccttcgaggtcttggagagcagatagatagatgtgcaatggcgcaatgctcacgtacgtggatagcggagcgcggctgacctccggacaataaggccgtggcccgtggaaaattggggaatggctgtgctcatcatatcgtcctatcctatctccgaatgattgaggaagggtatatatgccattggccatcatgattaaaaaaaaaaaagaggctgcagaccatcagcctatagtgttgtggtctcttgtgcgccgttggattggatgagatgattcggatggatcatatactgccgcatctgttgcctaagagcatcttcaacagcctctccattctaattctcgaagctaaattttagctattttagctaaaaaaatattctccaacagcctctccaactggatggctaagccatatgtctggccaaaacattccctccactagccaaatttagctagccaaaagtgccgtttttttgacaaattgacccttttcaaaaacttaattcgaaactaacccctgccataaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgttgaggtgcccaacctcagcgccaagtaagttggcgctgaccttggctacttagagcccggccgaggccgccccagccagttcttcctccgttttttccccagccgcccgcctagggttcggtcgccaccgcattctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaagtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttttttttatcaataatgtgtagtatttgagtaatgtacttatttattggaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtatgcatggaagaaagatggtaggatagggaagaaagaacttatagaccttaatgaaagtccactcatagaatcacccattaactgtcacgaactgtcggagaggtgtagtaggaaggaagaattgattgaggaagacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaagaagatgttgaggatggtcgggaggtaggagatgatgt

SEQ ID NO: 61908 - DNA, 1468 bp, Oryza sativa
taaaatatacttcctcgatcccaaaataagcgcatcaatttttgtgtccaactttaatcgtccgtcttatttaattttttttatgattagtatttctattgtggttaaattataacacatgagtaatactttatgcgtgaattatgtttttagtttttttaaaaaaaattaaataagacaacgattaaaattagacacagaaattcatagttgcgcttattttggaactgagggagtagcaattttgcacacgattggacacattcaaataccatgaatatggataaggatgtatcctaagccgagtttagttccaaacttttttttcaaacttccaactttatcatcacatcaaaactttcttacacacaaactttcaacttttccgtcgcatcgttctaattttaaccaaactttcaattttagcgtaaactaaacacacccctagtatcatgaattagatagatatctattcatattcagatttatagtattataataagaccaattcagtactaagttgctttttttaagatggagtgagtatctcattagtcgcttgacgcatagttataaatgaacagttggtgtacttaatgcgaaatttgttaggaagcaagtgcaagctgattgcaatcagggagcaaagacatcgcgatgaaccattcagtaatactccgtccgtctcatcataatatagtgatttaagataagatgtgatattttatactacaataaattttgtcttaggttgctatatactatatccatctcaaaatatgtacatccgtggatatctgtgtccaacgtttgaccattcgtcttatttagaaaaataaaaaaaattagtcacacataaagtactattcatgtattatcatctaataacaataaaaatactaatcataaaaaatattaaataaaacaaatagtcaaacattgaatgaacaatgcaaaacattatttattttgggacggagggagtatattatgaaaagtaaccacgctagtgtgtatggtagccgcggaatgggctggccttcgggagttcgggatctttacggattggaataagtgcactttaggtctctctattcgtcgctcagtccgattttcgtccctgaactgtaaaaccgggtacaacccatcccccaacttacgaaaaccggacaaacgaggtccctcggcagtatggagggcagttttggccgacgtggcgtctatgtggctaatttgacttgatcttcatctgacgtgatattgacatggcgctgacgtggcaattcgatccagaaaaatattaaaccccgtggcacccacatgtcagtttgacacacaaattaataaaaaatagtggggcccacgtgagccccacatatcattctcacccttctcttcttcctcctccctccctctccctctccctctccctcccctctcgtggaggagttcagggccgcgcatgtgg

SEQ ID NO: 61909 - DNA, 8169 bp, Oryza sativa
atagccgagttccatgaggccacatccctcccgtcgcgcatccactcgaacacccgcagcgccgaatccaagaggccgcacttggcgtacatcccgacgagcgcattggccacgagcgtgctccggtcgaggccgctcttcaccgccagcccgtgcacctcgctcccgcacctcccgtccccctccgcgccgcacgccttgagcacggacgcgagcgtgcacccgtcgggcgccgcccccgccacgggctccgacgcccgcatcgcccggtagacgcccacggcctcgccggcgcccccggacgacaggcacgccccgatgagcgcgttccatgagaagacggtccgggcgggcatcccgtcgaacaggcggtgggcatccgggaggcgcccgcacttgccgtacatgaacagcagcttggtcgcgaggaaccccgcgtcatcatcgcccagggcgcccgtggccaccgcgtgcgcgtgcaactgcctgccctccgagacggccctcctgacggcgacgaggtcgaggacccagccatagtggtccgtgggaggaggggcgcgcccgcgcgccgagcgggcggcgagctggcggagggcctcccgcaggtcgccgtccttgcagagctgcctcagggaggcgccggcgctggcaggcgggagcttccggcgaggggttgggtggaaggggagcgcggcggtggtggccatggaggctcgtggtcgtgggagccgaacgctcatgtcagcgccatggcgaagcaggagaagaggaaaacggattgggatttgggggagaatggattcaggtcgcccgagcaggctgggaagtgggaatgggtagcccatttaagcctctctaaggcctcgtatggataggccacaatagcagcccaactacataggtggaccaagattttttactaaggaaaaaagtacaccgaatgtccatcaacttgtcatcgagataccaaatcgtcccccagccacaaaaccggatacaacacatccttcaacttataaaaccagtgcaaactaggtccctcagcagttttaaatccgattttgtccgacatgacggctgagtcagcgagggacccacgtgggccctacatgtcaggatgccacgtcggcagaccagcctccccctccaccggcgccgtcgacgagccatgccgctgcggaaacgcccaccgcctccggccaaggctccagaagccccatcagaaaccaagcccaagatctcgtagcccactagacccagcgccgcggcggtggcgccgcctccgccgatggttctcccggacagtgtcctcgccgccatgtcacaccatgaggggggatctacaaagctcgtgttcgcgggaggggacaagggcatgtcgcagatgaagttccggatcaagaccggatgctgatgagcaccctcaccaagcacctacgaggcctcacctccaagggtgtcctcaaggtggtcaacagagtccacaagcgtgccgagaagatctacatggacgcccgcatcgacccgtcgccggagatcactagggaacctggtaccgcaacggccagctcgactccgacgccgtcacctccgcacagcgtaggtgcctcgagcagatcgacaggcttggcgtcgccacgacagagtccatcttcgacggcatcagcagggattaccctagcctagcctactcaaccgagcaggtcagggacatcccacctcgtcgttgcctcctcgccggtgaagagtcgaaggaaatagaagtagagaggggagaggtggacgccgccctgctgcacgccgctgccctgccgctcctgctcgcccgtcgtcgtcctcgccgcgtcgtttccccatccgccacaccgcgccgcttccccgctgcgcagctccacccctcaagcccatctcctcaaccgctggccactgcccatctcctccccgtgcctctgccgccacccaactccaaggcttcccccaccggcgtcgcggccctcgcacggccgccgcggagctttgccaagctaccactgttgccagccgccatcgtggcgccaccctcctcctctcccgcctcgccccaccaaccggcctacaggcaaagagagagagaaagagagaggaggaaccgagggagagaaggagggagagatgattcagcctgacatgtgggtcccacgctgactcagttgccacgttggacaaaaccagggtcaaaaccaccaaagaaccaatgtgaccgattttgattagttaagagacatcagatatctggttttgcgattttgtggatgattttgtaactcgttaacaagttgagggacctttggtgtactttttccttttactaaatcccggcctatcgacgtctattggccgggaatgaggcccatcaaacaatgacaaacactctactactcccttcattccaaattatacagctaaatttcttatattttagttggatataacacatcttactactacgaatatttacaccagactaaaatttttatattttgggataagaggaatacgtaatattttgttcgtttcataaaatatgaaaatagtacgaaacgggacatcttccagtactataaatctgaattggtttgttttcatgaacggagggagtagatgattactatttgatcatgtagttttgagtggtttgctcacgtcgcgtggcgatttgccattgttgttatcgaactaatccattagttttctccttaatactgtttacgtggccatctttttggtcgcaacagatgacgccgacgagtatatgacttgccctttgacacgccgcctcctcccccttcattttctcgaagcgcttcccttcccttcgcttccccgcacaatctacaaacgcgccacccgtcgctcataaacccctctccctctctctctggccgacacatggaccccaccgtttccaactccggcgacgccaacggcggcgcggccgccgacgccaccgccccgtccaacaccaccgtcaccctcccgccgctcaccctccgagacgtgcccctgctcccgtcggcggcggcggcgaccgacacgatccccaacccgatctcccgccacccctacttccacccgccggccaccttctacatctccccgggtgacgtctccctccgccacgccttcttcgacctcgcctccgcgtcgccgtccccgctcgtcgcctaccgccgcgcggggccgcgcgcgggggtcgccgtggaccccgcccgcgcgcgcgccgcggtcgtcacctgcggggggctctgcccgggcctcaacaccgtcctcagggagctcgtcgtcggcctccgggagctctacggcgtccgcgacgtcttcggcgtcgccgccggctaccgcgggttctacggccccgacgccgaccacgcccgcctggacctggccgccgtcgacgactggcacaagaagggcggcaccgtgctcaagaccacccgtggtggctttgatctcaacaagatcgttgacggcatcgtcgcgcgcgggtatacgcaggtgagagcaaacccctaccgtttttagagttttcaggttttatgtatttttttggcaaatagctaaagtttaaactgatctcacaaatcatgtgcacgtggaaacccctaagcttctttttacgccaagctggcaaatgaaagctggccaattttgttaagattagaagcacaagaaacatgttacaggtatttgcaagtgtacaatgtgtcatctgaattggcaaggatactatcttggtgctacaaatttgctttagacattttagtatgttggtgtacaatcatgggggttgttctgaattgacatggagtagtacttattatgttaggtgtcattatggaagaattatctcaaagaatttgtctgtccagaatttttctttgtcagtagagtttctttttccaccgggctctttgtcggttagagtggtcaagtactcaagtggttgaagtcttactgatttgatcgatcagcgttgagtcgtcttgctagttcaacatgctaatttgtttcagttattgcttgtattttggcttattaaagtgtctgacctcaaacactttttatcatgactatatcttgctgaaggtttatgcaattggaggggatggaacaatgagaggagctgtggccatcttcaacgagtttaagcgccgtggtttgaacatttctattacagggatcccgaaaactgtggacaatgatatcggcatcatagacaggtcatttgggttccaaaccgcagtggagattgctcagcaggcaatcgacgcagcacatgtcgaggctgtgagcgccgtgaatggcattggacttgtcaaacttatgggcaggagcacaggccacattgctcttcatgccaccctgagcagccgcgatgttgactgctgtttgattcctgaggttgatttctatcttgaaggaaaggggggcctgtttgagttcttgtatgaaaggataaaacagaagggacatgctgttgtcgttgttgctgaaggtgctggtcaggaattgattccaaggactgacgatcaaaagcgggagcaggacgagtccggcaacattgtgttccttgatgtgggtccctggttaaaatctgagctgggtaaatggtggaagagagaacacccaagcgagttgttcactgtgaagtatatcgatcccacttacatgatacgagctgttccagcaaatgccactgacaatctgtactgtacattgttggcacattcggcgatccatgggatcatggctgggtacactggcttcgtccctggcccgattaatggaaactatagctacataccgctggaagatgttgctgtggcgaagaacccggtggatgtgaatgatcacaaatgggcatgggttagatcagtcacaaaccaaccagatttcatgaagccaaaatactaagaccaaaagtgctgttactggacatggttgtatgactttttctccctggagccttgacacgttaagcttgatttctttctatccagtttcttctcttgttatgccgatctatctataagatgttaggtattctgatctccctggtttgtgtttgtgtgcacttgaaatcgtgttagcaggtattgctgtaaatctgtagtacataaataaatgaagtggcaggaaatgttgttctccattggcgaatgagttatatgtcgtgtcatgtaaatattgcttatcttgaagacttaattggcgattctgcgctaatctctcgcttaaagaatcagaacattataacgtgaaatattatagcagacatatccaaataaattggcctattagctcagctggttagagcgtcgtgctaataacgcgaaggtcgcaggttcgagacctgcatgggccattattttttttttctttttccttgcaatcgtgattcttttttttttccctttttttgcctgaacaatgttatgttattgtgtgtacgtgccaagatcaaattgcgattcctgagtcctgaacaagtgataaaattgtgtttgtgtatgtgtgtctactgtcaagatcaaattcctgatgatcaaaattgcaatcctgagtcctgaacaatgtgatacaattttgtatgtgcgtatgtttttcaagatcaaatccccgaagatcaaaattgcagtcctcattcctgaacaatgcgatgctatgttccacataatcccaagttccgacaaactttatgccctatacaaattacacaggaatataggcgcaaaaaagaaaacacagcaacacgactgcaaaaactgaggattactccaccaaacatagaaaattttggtaaaaaataaacatagaaaattctggtaaaaaataaacatagaaaattctggtaaaaaataaacatcgaaaattttggtaaaaaaaacatagaaaaatcatattatgatctttctctttctttcttttttataccttttttctctttaacttatcctctccagtaaacctctcatactatgatctctctccccttccccttctcacgttgagctcgagcggcgggcatggcgggcggcggtgtcgcgcgggggtgtgcagatgatcctgcgggcgccgctagaggcgggaccgccgccggcgttgggccgggcgcaacggcgggagagtcgacgccgcggtggattggatacggggacgacggcgcggcgcggcttcggctggaattcggcctcgatcctgggcgaggttacgcgtggtggattcggggactgttatcccgtgaaatcgtctagcgatgtgaggggggggggggggggaactccactcttatggaataatgctgctgttcgtccggttttttccttcagtccagaaacactgaaactaagatttcccctgcaggaaaggattccttcagaaattcctccaatccaaacgggaccagccatctccgattgatagggattatccacgatcgaatttgtctgctccgaaattccctgagaagtagtgcagagtacagtccatacatgttcatgttcatgttcatattattaaaggataggagtactctttcaaagtttcaatgatttgtttttgaagatctttggcttcatccaaaatcttttcaatagcccaatagcccaattttcttcttttttttttcttctatagaatagcagatgaaagttgaaacagtggaggatgttacagggtgaagcaccgcaccaccaccaccgcaagcaatcggcatggacaaaatatatctacaccatgtacagcaaattacaatctcagcttggctcattgataggtactactagctaatgctcagtgcattcttcagttcttgaaatattttctctccttttttttgtttcactgactaatcctctcagtccgtcgttctcgcccgcatctccccctcgcttgcggggatgatttgatgaactcgctcaccgtggctgcaactgcaaacctgtcaggattcagagcaaagtggctcgatttctatgggcagacctctctggaactccacgtacgggtatgccatcggaatgtcatcgccatcgattctccatctgcacaggttttcaagaaacgaaagaaacgaagaacgatgatcagcctttctctggcatggatattcagtaagtacatgtagactctactctgaaacaaccgcataatttacataaatctgcctgttcttgtcagttgtcacgtatagattgttgctaatgaacctagttttttttttaaaaaaaagagtttgatcatatcgtggtagtatattttatcttgtatggcagccctcaactcaacttgcatagcctacctatcgaaaactccatgctgtcatgtttgttctgtgtgttgtcgtctgattctatgctctacagtgccacttatgaaaatgcacaagatagctgagttcagacttgcggtccttacagacaaaagcataaataatttgcctagttgctgtcatggccttcttgccattacttactagtggtctagtgtagtgtgtattatcagtatgagagtggtaactgcatcagtatgttttcctgttcatgtttgcctcaacagttttctatggcctatttaaacaccaactactctgcaccagcttcttaaatattacttctgaacgtattttgttcattgctgtttaagccagtcaactttgatccatgcatcttctactcgggtaggacaaatatacccttttgttttacctataattgagcacaaggtgatggaggaagaaagcagcctctacttttgcaagctctgatccagggcagagccgggggccaccgccgaacggcgtaaacttcttgcttgtcccttggcttgcaccctgttgcatcaatcagattaggaacacacatgaatcagaccattagcttcatcacagaaactaagaaaaggaagcaaagccaagaatgctggctttgaatgagaggaatcatggttaggaccatgcacaaaaggcattgcagccacagggagcttgtttggcatctgaagacaccagaatagttgcgagtaattatgtcatagttgggcgctcactaattaaaggtagcaattagttagagaacaccctttaaagaagattctttcaaggctccagataagctctcttgataggtg

SEQ ID NO: 61910 - DNA, 722 bp, Oryza sativa
tacagtagttcatcagctctttttctgaaaagggtgaaacctacaaatatccatgaattccaaccttagcatctagtgcttggatatttgtatccctgatatttcttaatcgctttttcttcagagcaaaccagttactgatggtttcaagcagtttcggataggagcctaggagggtgacacctcgccatcatcaatcagagaagaaagctagctagttgctcatcctaaagtggactgcgatatatattatgctgcagcaatgtggctagctagctaccttcatcatccatctatccaattaatttcaacacagagagcactttttatctattaggtgtcaggacaatgaatcatgcacaacatattcaactccattcctattcgatgagttccgatgaaacagcatgatagattctcctccaaatgaggacagcgcaaaaataggacagctggaccaatccattcagtcagtggtctccaatgtccacgcagatgtgctaaaaatcagggaaattgcagtccatttctctgaacttttgaagtgatgatattataatttcacaactgaagctggcagtaacttaaccctacctgcagtgtgttggcagtttgcatgcaagatcaacctatctcctcacaaatatcagtacagcaatctccatgtagatgcatgacagaatgagaatctgagttcatgagctggggaagattaatcattc

SEQ ID NO: 61911 - DNA, 1656 bp, Oryza sativa
tatactatatttttttaaaaaaaaatcatacaatacaaacgtatctcggcaaaagtcgagtcactctctaatattctccacgggtaaatcctcttgcgtgtggcgtccggactttccgatcatgcgtgcatcgatcgatcggttgcatggtcactagctctcgatcccgagaacccgggcgtttaattggtcagtcatcagtgtgtgttaggaacgtacgtagttgtccgagtactaattattactagctcgatcggagcttagctgctactgtacgatggagtgcgatgtgtggttccgatcgaataggctcgtgttgcttccttctctctcacctgcgcacacgtactgtacatatatacgccccggcccggcccctagctaatacctgcagctgtgtgtagtatatatagagccgtttgtgcgtagctcggtcgatcgtatccatcacgattcacaaggcagttaatttgatcttggtttttcgagctctaaaactgctgatcgattcaatactcagtagctagctagctatagccacctaattcatcgccacgtacaaacggacatctgctttctgaaactgtttctgttgatagccggtgatcataacagcgcagataaacgtacggcttccaaatgaaggtaagaaaaatcggtctccgatgaactccatctcctctgaacattctgacgcagagagatcaagtggtactgcagaagaagaaacgagaaatgatctcgtttaatttcttaatacatatatggtcgttctttgatttgtattgcgcagcaaaagatcgtgatcaaggtgtgcgcgccgtgcgaggggtgccgggcgaaagcgctggaggtggcggcgagggcggcggacggggtgatctcgctggcgatcaccggcgacgacagggacaagctggaggtcgtcggagtcggcgtcgacgtgacccgcctcgtcatctgcctgcgcaagaaggtgtgctacgccgagatcctgctggtggaggaggagaaggaggaggaggagaagaaggagccggaatgcaagccgtgctactggcctccctactggtgcccgccgccggaggatccgacttgcaagccgtgctaccctcgctacagctacgcgccgccgccgccggcggtcgtcgtctgcgacgagcccagcgcctgttccataatgtaaaaaaggaaaaagaaattaaagaaaaaaaaagagatttgaaggaagagacgtctcttcaagcacttttttaagaagaaattgtgaacgtgttaaggatattgaacacaagatattgagattgaaaccacacgacccttatattaccactgtactatcaagtgcacctctgttccatcacgtagattagtcactcaactaaaaccggcgaatatatataccttacatgcatcggttgaaaaactaatgctgcttaatttcatggtgctagaccaaaacctgtacacatgaggaatttagaatcggcactaacgggggttctttgctagtgcatcatgttgtgtaagcagagagacgttaacatacttgcgggtgcaatggggtggcacgaaataccttttacctatattggaaagaattttggtacaaataaccattaccacgtaaattattgaattttaaatattacagaa

SEQ ID NO: 61912 - DNA, 550 bp, Oryza sativa
acacatttccctcacgtggaaccatgtgccacataccaccatggtatatggtcggaagacctggacatagtttccaacccatcctagccatagacaagagtaccgacccaaccccacctacgggcggaacctccgggacaggtaggcaggactgagcccctagcagcaggacaccggccctgtgccatgacatctcgactaccgggccacagctcgtgtagccttcatttgccctaaacatgtccatcgacccccgacttcgtccatctccatccgtgtacttttgtttataaccagactgagccacaaactaagccttacccactaaacatgtggaagtacggtagtgctttgcaacaaaggcccgaagaccggtccttatatggccgaggtgctactatcaaaaccatgcaccccgagcccagcctaaaacccttttgaggattttgaatagagagggaggtgtgaatccaattccacaataatccaaccatttcacagtgtccaggtgatgagaatattcccaaagtctagagttgtaaaaccacct

SEQ ID NO: 61913 - DNA, 1943 bp, Oryza sativa
cgcggtgaatgcgattctagtcgtacccccgagtattgccgtaattattgtgtacacgatgtaaactattttggatgtattgattatccatataaatcaattgatgtatggcatatgttaattacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattataattgactagagaatttttcaaagtttcaaatcatgcatgtggcatttacatatgttaattagagtttttcacaatttaatttactatcattcatatgctaattatatatgactattcgaatttttaaaatttttaaattatgcatgtggcatttacatatgttaattagagtttttaacaattaatttaatataattcctatgctaagtatatatgatgattacaatttttattaattttaaatcatgccgtatgtatatacatatgttaattagagtttttatcaatttaataatatcattcatatgctaagtatatatgattattagaatttttattaattttaaatcatatatttgcttattacgttttatccacttaatttattacagacaacaataatttttcgaagaaattgtcattaatctttgtactttaaaaaattgtaatgcattatcttttattttagaaacacatatgtaatagaaaataatattcagtgcgcttatcagtagtcccggttcttaaccctaaccgggtttaaaaagaatttggaaatagcgggaaaagatctttagtcccggttgaggagaacaaccgggagtaaagatatctttactcccggttgttgagaacaatcgggagtaaagatcttttctttagtcctggttgttctcaacaaccgggagtaaagatatctttactcccggttgttctcatcaaccgggattaaagatctagggctatatatattcccgatgcgcgccctcgtcttctctactagcacttagaactttttgcccgatcgatctctctcggcttctccttcgccgccactgcctagggcatccccgcgccgacgctgccgccgtatctcgccgtcgtctcgcgctcgtcatcgtcaccgccgcctccgcctcctccgccgccgccgcatatctggggtgagagccgccgcgcgccgcctccctttcgatctctctctccgatctcgatctctctctctccctctcggatgacaccggccgccgagttttagacgccgacggcgaccttgtaacgacacgacgccgtgccatgacgacgccgggccacgagacgggacgactccgcatgccggcgtcgcgccacgccgatgctgcgcgcggagccacgccgtcgccgagccagcccgacggcgattcgctgacggcactccgacgttccgctgccgccacaccgagaacgtgaacgagcgaacgaatgtgaacgagaacaaggtgaatgagcgtgaacgagaacgagcgaacgaacgtgaacgagccaacgaacgtgaatgagaacgagcgaacgaacgtgaacgagaacaaggtgaatgaacgtgaacgagaacgagcgaacaaacgtgaacgagccaacgaacgtgaatgagaacgagcgaacgaacatgaacgagaacaaggtgaatgaacgtgaacgagaacgttgtcggacgaacgtgaacgagccaacgaacgtgaacgtgaaatgccattataccccggttaatgaacgtgaacgaacaaacgtaggtgaatgaaacgtgaccttaacgagaacgcgaacgtgaacgatatcgtgaacgaaacgtgaacgtcaaatgcaatatatggtacttcgcggttatcataatacatctttt

SEQ ID NO: 61914 - DNA, 1647 bp, Oryza sativa
gtcaaggagccctttacccttctgatgactcttcagtctgcagccaaaggcaaaaaaggctatagtattatgcatagccccagaaacaagcaggagccaagctttacaccagagaccaaaggaagccgaaacttttgcccaatccaagctattattaggagcattctgctttcagagaggagacgatctttgaacctttgatcattgcatttttaaagttatcctatcttctgcgtctaatatatataagataataagactccctgcttaatcataagaaaaatgggacatctgttaatgacagaatctaacaatggaactgttataaaaaatatatgactatacatatactcctctattttagtatttagatattacaaggcgattacagatttggacgagctagtagtatttatgagagcgcgtcagctgtgcatgcaagttcatgtgccgcccactcatcatcgtctttttcactagcgagcaaccccacaggaacagagaaagctagagagagagagagtgagaaaccttcttccattactactagtctactactctctcgctctttctcaagagggagggggagagagagagagagacagttactagctctatatattctcacacagctcacaggtgtaggagaagccatgaacatgaggaccatcatatccctcatcccagatacatgatctgtactgtctcctcctctctagcttctctcctctccctgctgtgccccttgctttgttgcttggtcaattagagctaagcagcaagctagcttcctggaagcaaggccggcgcctggctgggacaagaaccacaggaaccacagctgactgattgatcaatcaatcaatcttctgctgccctgctgcctcacagcctcagcaagacagtacgtacaggtagctctactattatacagctgtatgtatgtatgtgtgtattgctagctagctaaccactgtgtaatagcatatacaccactagtaatatgtagaagtagtactgatctaatactatatagatagctacctctctacaatcttcttctatctgtagcttttagtttaattggttcttgaactctacttctgttgcgtgttcagatcaattttggccctcttgaggctccggccggtcgccgactcgccgtcgtcgaaggtgctctccggccggcggagttaacattgagcttgatttcaagccgcgctccgatccgaccggcaaagcgccgaagctgccttccgtttgtttcactctggtctctgggggctcgccatcagccatccgtaccgagctgtaggtatgaacagaggagatatcctgttccctgtatatgcatactatttcgatacagtagttttctcgacatgagatttcatgcatgcagaatttcacgctcgaagttacctaattagaagtaatccatactctcgaaacaacctatttaagtagcactactatgtaggaacagaataactgacgtcgttgcccgggcgtgtcagttaacaaacgacaaagatgtgcaacgcacagcctgcaagttacataagcatccgctcgttcagttaagctggcagatcgaccacacactagctttgatttgcgctaacagtgtatcatatctaactagct

SEQ ID NO: 61915 - DNA, 16658 bp, Oryza sativa
ctcaaacttcaaaaaatggcatatcaaactgtccccaccagtttcaacgaatagaaaacaatgcaatattctcacatgagttgtaggtacaaagaaagggcacaataatgaccatttcaaactgtcagttatatttaccccaaagaacacaagaagtccatctcatcttccaaagaaggaaacgggccgttgttttgggtgccatttcgaccattacgaagattaattttggctgcttcaactgctccagccaatcaaccatgcacattacagtggtactaagagcaagtttaatagtatagtccactactagctccaaattatctatagccaatgtaatagtcaattcatacaatatttgcttactacactattaatacatggtcccacctgtcatacacacattatgtttgtccgtgctgcagctgactacagatctgtagcccgctgcttttctctcttttcttttatctgcttaaaatatgtttatatctggtttatagcatgctattgtacctactctaagtagtatactccattccaaaaaccaaaaaaatataaaatacattgcacagaaatccgctcaagaaggcatgtagtaccatcaccgtactcacattgatgtactctcaatatccatctggctgttcctgacaagataatctttgtaagcatatggtacggacttaaggatttcccaaaaaatatatatattcctctctatccgtgacctaacaataacacagcaagagacacctagctaaatccaagccctgaagcatccctcgattgctccatccagaccgccgagatggctacaaatttcgagagatttttttgaattttttcctcggatggaaaaaaccagccgaatcttccccgtttttgtacggcctcgcacgcgtatggaacggaattttgtcgtgaataaccgtgaggataaggtgaatgaacgggggtgtgcgatagaagggaagaagggtcgctttttttagatctcaagttgcattcatcgccgaccctgttctgtcctgaattattgtccacaaaagattttactaatttgcatgccaaggagactttctcttctatctgcccctatataagttttttttattttatgtatttttcatataaaaaaagtggatgctgctagcagctaggtgatgcttccgtcacctgcaaattgctcgttgaaaccggctttattcaagtgaattatttgcccattatgtgcaggggattagaataatgctaggggatggtagtacaacgcttggtcggctcttacctctttgagagcagcagggttcagtttgacacttgcaattttatatgtaaacccccaagaaaaaaaggtttagtggaacagatgggaaatagctgaactgaggcagctaggcctgcactggaacatccctgatgaactatttaatttcttttaaatccagcaactacacagatacaatcatgtcttgtagataatacttctatcgaacggtacgcaggtgccatttgggcgaaaataagatagtacttctagagccggccattgtaaattgaacaggaacaacaaatttagcgttagttcatattaaagccaaattttatcacatggatactttgtaagagcgagtttaatagtatagcccactattagctccaattcatctctggccaatctaatagtcaattcgtcatataataattgcttactatactattagtatatggctccacccatcatacatacattttgtcttagattccgtactgcagctgactacatatatgtagcccgtagctcttatctctcatattttattttattaaaatatgtttgtagctggataatagtctgctattatacctgctctaagtcttaaaatatttcgatttagtcttctacagatatgagtgtacgcgcgtgtttatatgggtaggtgtacgttcatactgtgtttgtaatttaatccaccatcgagatcagctagcttcgttcgtccgtgagccgcacgatccacatccatcggacggtccagcttgtaaaatgaatctcactactctactcactccaggcacaacacggacggttccccacggagttaaaaaaccacacacacactgtacacacccaaagcccgaaaacccgttatctctcccgtgatgcggcgtggggcccaccaccacacaccaccccaagtggctgacatccacagctccgtgggcccgggtcccacagcctccctttcccctccccctccaagagtcaaatctccacctcccccctacgcccacggcccaccgacacgtgggccccacgacccagccagccagagtcccagaagttaacgggggcacgcgaacagagaggggggccccgcgcggcgaggtggggcccagtgcgggtatgaagcggggaggcgctatatagagcgcacccatcctcctcccccttcctccctctcctctccactactaataccaccaccgccgcgccggaggtggaagacggacggggtagagttggggtctcgcggtgagccgattcctctctagtggtcgcgcctggtgtgttcgccgacgacgccggcgtcgcgtcagccatgggtgggctcgaggagatcaagaatgaggccgttgatctggtgagaaaatcactcgccgccaccagctacctactacttcttcttcctcgcttcctccctctcgcgtgttgggttgcttaggctttagctctagctttagttcttaccatttttgactggcgatagaaatagtctgagaattgaaaattaatgataccggctagctggagctgagtagatttctgatacgcttaataaatgaaaaggaaaattttccatgtaaagatgagcacggatcgttcgtcgtcggcggcggccttcacgtcacgctctctttctcaacgcggcttttcataacagaaggggccagttgtccatggccgcctgccatgttcttctcttattcttcttctctctcaccctgttcgctcctctgtactgttttgctgctgttcctctcaccatcatcaatttgttcatctgtctccggctcctccttttttttggttgaaatgaaactttttgaaagatcctgctcacatgcgtgtttaatctgtcatgtaggagtacactataccactatggtcacttctccaccaaactatagtataaaaaaaattgaatctcagatctacgcgtaattaaatgcccacctccagttattagtattactcttgcctctactttcctttttttttagttcttcatttatacaaagaagcagtgaacaaatatactcaaatagttcttcagcttcgcaagtactcctactccataaaactatttttcagcttcacacgtaaaattaaaattattcatgagcttcatacgaatttgcatgtacgtaaagtcaaaagtcacttgagcacgggcgcgagctaatcacgcagcggagattagtggctaaccaccataaaggcaagctaaacacacagtggaatccgtgcgtgcctagctgagctgcggccttttttttggtttgctttgttttttttttgttcttttttgttgaccaagcggacagcccaatccaagagcacaacgtataccagccgctgctcgctttatcttttttttaaaaaaaataaaaatagattaaaaatcagtttaattttgggctggttttgttcccttcggctcacgcgacgagaaaacgaaaccgcatcttcccggcacgcatctcaaggacgacacgaggggggccacgggaagtacgcgcgcctcctctgactgccgctgagccgtctgatctccatctgacggccgtactttctccaatcattggccgggcactgcaacccccctgttgccccttggactcttcctcctccgtgtgttcctagtagatcctgaccgcttggctggtaggcgctgacggcgtgggcccacacgcaccacctgggagatattttatctgtcaatgacaggtcgggcccatccaccaatagtaatagttttttgataaggctgtaaattgttcaacacgcgaatctaattataggtcgaataacgagatagtgataattaaggatttatcgctgtactcgcatatcatagacccgactgataaattcttaattgtcacgtcttactcgaataactgggtaacccgagttcttatttctcactctgttgttgctgactagtgtggttgtggcttttgttgttgttgcaggagaacataccgatcgaggaggtgttcgagcagctgaaatgtacgcgcgaggggctctcctccgaggaggggaaccggcgtatcgagatgttcggccccaacaagctcgaggagaagaaggtgcgtgctatgctttgtcaaagccttttgcattctcttgttgcgtgtggttttctttcatttctgacgcgaatcgctcatctttgttgcgtctttttgtttgtgtgcttgtgcaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgagctcaagaaacactggataggagtactaactaatgcactttgaactggaaaccgaccttaattattccgttgtaccacacaaggctttgatttttgtattgactagttgtcataatagtattatacagtagtggaaggaagaatctctatgtgcgtacttttcggacgggcactttcaattagagtgcctagaaactgagctctgaattgtccagtggatgggtgggcatatattccattattgcaagaaaataaagatagggacccacctcttggacagtactgttcatttggcgtaaataatagcctaggtgttctgcaattgcggctaatttggatattgttagcaaaacaacgtggtctaatttttctgctctggagctggaagtcaagtttctgtctttcatacgtatgatagattgataggtctatgatatcaggaagtatcctcttggacatgaattatttcaccatcacaattctttaactgctacggagctcatcctcagttagctagtcgtccctttcattgtatttttatttaataggataaggggagaaaaatgtggcagcgcacgcacgcacatcgttgtcacgtggaatttttcttttttcgtgcaacttgtcaactcaaatcagccgaaatgaaatgtgttaggtactaggatgtggtcatgtagcagttggcactttggaataagttgcaataatagtgaacactgattacgtaatcttgaatttttcttttaaccaaacttgtttgcttattccaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttgcccttcaacccagttgacaagaggactgctctaacatacatcgatgccgatggtaactggcaccgtgccagcaagggtgctcctgagcaggtgagaaagattgacccttgtttcacttttttttttttgctaatttctttacttataatacgtgactgacatttttttggttgaaatttggacagatcctgaccctgtgcaactgcaaggaggatgtaaagaggaaggtgcatgctgtgattgacaagtatgctgagcgtgggcttcgttctcttgctgttgcaagacaggtatgatggctgccttactgaatgatctatcacctttttagtgattagggaaccatattctcataccaatatgatgtcgcaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtatgtacaaatattataaaaacagaaagcagtataatagaattttgcaagagctaatggttggattttaatgtacatcaggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctggtatggcttggatcgatgcagacttacctgcttgtttgctttcaatgtttgcattcctcaatgtgtttcttgttatgcagagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccgtaagttcttcctttgcaaataacttgtgttctctgtaaaacatatgatcacatcgcattctaactttgtattattttgtctcgtgtacatcagatttatgcagtttccatcaccatccgtatagtggtaagtaccatttcgtacataaaagatggaatataagctcttttctcgattttccaaactctaatatcaattttattttccagcttggatttttgcttattgctctgatctggaaatacgacttctcacccttcatggtccttatcattgccatcctgaatgacggtatgcattcctattgcccagataaattactgataactattccctccatgtacattcctagtgtaaggatcagttctcacgcaatatttttgcaggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggtatgctctcaccttaccctatctgtagtctgtccactacacttctctctcattatgtatgcttttgcgtgaagttttgttctcactaaagtgcttttgttcaggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggtatgtacaagacagtaactactcaacaatcgagctacgtcataacaacgtcacggcaaatcatgcctaatcctaaccttactgtttctgtaggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaaggtacatatccagatctttcagttgtcagaaatgtacatatatggttgtctgctccattttttgtttcagctggctgatgatccgaaccttgtatttgcagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggtacattgctcacttccaacactgataaaatccatcaagtgcctaaccacttatgttaattaattaattactactacatcaatgagaaaatgttgctgaaaactaaaacacttgttctggatcataatctttcaggctgagagagctgaacactctcaagggccacgtcgaatcggtggtgaagctgaaggggctggacatcgacacgatccagcagaactacacagtgtgaggaaccccctcggcattcaacgagagatcgtcatcagcgctggagcgggaattgcaaacggcgctctggttaaaggaaattttcgatgaatgattggaagaacaaaaaacaaaaaaacatggctgatctgaacagccctagttgtaaagtgctaccaaatatatggtccggtttccctcttctagagaggttttacgttctagtggagtaccgtacgtacgtgttggagtacgacgacgtgttgtgatcgtttttggtctttttttactcttttccccctaactagcggtcttcttgcggaatgcaagatggagaaataatggatgaaaaattttctgccacgttaattctcactttggcaaatgggtctgcttcaattacttcttaattactctgcaatgccttcctctcgtgaatgaatactgactgatcaattggtgtgttgcgagtttgtgtattctacttccttcatacacaatcatattgtttttccgttgtttcacaatacaagatcgtgtattgtgttttatattttaagacggaagtaaaactaagattcgaatcctaaacctaatgtgtttcttgtggtgcatgctcactaactcaaaagaattagcctcctttggtttggaagttctaaagaaattttgcatgaattgaactaattcatgtgaaaatcctgtacaatcttacgttccaaaggaacctaatataacttatctctttccctattgttttctttttttttctctgtcctaaaaagaaacactattacaattctagcaacgaccttatgaaattagtactcctataaaattaattggttgctcggattacaagtactccccaccttactagtactatactctctataagctactccctccatcttataatatactacgtctagtaccagattgaatatattctagtattataaatttaaacatgagacatgtccaaatttgtaatataggctatccagattcatagtattaggatgtgtctcatccaaaactaggttgctattttatagggacggagggagtagcattgcactcggcatggcaaattttaatgctagaaatgcaattttttgtacacaaaggtagtatcgaatacacaaggaatttgaagaaaccctgtagcacagctccagctgagaacataatgtgaatatgaaaaatagtaaatagttaggtgttaatagaaaccgactaccctattgttaggcttatgcttataaaccaaaattattttttgaaatctaattttaaagttgatgttgtgattttttttatcatagtttattttgtagtacttatttttgaattgctaaggatacaaatataaaatttttatttataaattattttttatttattaataagccatacgaataagtataagtgaaataataggctctgaatagggggatattaactggctaggtgttatatgttcaagccacaaataaagcggcatccacatgggttgtaaaggagaagcttcattggtgtagtatacaataagcaaagatgccttgaggtgcatcaattatattggaggagattctacactccaagactcgtcaattatattgggaggattctgcactgcagactcggacaatacctactccgtagtcctaaccatgtggaggagatgaggcgaatacagtacgctggctataaaaatcggaaaaagaaatatgcctagcactcactggtcactactgctatatctttcctgtggaaaaaagggtagccgaccgaaccgtctgcagatgtagccaatacccaccacagatgagcataagccagagaacggaatctctatcgttttatcattatcatcatcgtgtactactccataaaagaagatatagtggaattcggttcgtacttcgcctacaattccccttcaaaaaaatcgccacccttttttcctttccacaacccaaagaaagatgctccatgttgttggcagtgcgtccgtacgccaagccggcgccggctgaggcctcaccatttcgtttacaaccaaattttaaattttaaatttaaagctgattttaagaggcttttaaagttttagcttttgattttaagtcgctaagaacaagtatatgaaagttttattcataaattatttttcgtttgtaaatataccactttgtttatttaggcaaataaacgaaacgatggttccgtgaaacgccgcatccacccacccatccgagcagaggatttagcgctgcaattcccagcaaaacaccgcggcgacgaggcggggtgcgtgtggcgcgtcccgtcacgttgccatcccgcccgcgacccatccaaccgacacgcattttgctccgcctccgcgccacccatagtgcgcgtcgccgcttgcccttgggtcccgtcccgatctccgccactgccacgagaaggagaaaaaaaagcggccgattctcgcgctgttcccgcatgcagccgcggacgtcccgtacgtcatccgctgctccaaatcaaaccggcggccgcacgcgcttgtctgatgtcccttcccttccccgtaaaaatcaccacgcatcacgcggaagatagatatatggattggcagcaagattgttccctttccttcgcgttttatgcagcgagccgagcgatcgctctccgtcgctcgccgctacggcagaaaacggcgaccggtgcttccatcgatcgatcggctctcccgtcactgcacgcacgcctaaatctcacagtatcaccgatcgactgactttacaggttcgcgtcgttttccgggggtcctggaacgtgtttagcagctacggtgacagttacggcgcccaagtgtcgtttgctcctggaacatccggtgaaattaaaatcaacaaacccaaacagtatcagcagtactagtaactgtgctactatagtgctaaaagtgatggtttaggaattgtttactggagctcgtgagccagccaaccagctcgaccgtgcaccttttctctgcaaaagcgtcgtcgttgttgttgttgtcatggacggcctaaatgcgtgatacgatttagcattattacgatccagactgatttggttggggtgttggcctctcgctagggatgcacgaagtgactggatgagcttaaaagaggcgacagcaagagcccggtccgtgcacaagataagattcagttcaattggcatctgttattctccttttttttttcttctctgcatgagcagccaaaagccctgaaagttgtgtggctctactaatcagtgtaggataggacggctaatttgcctaattcgctagctgctgattactaattccatggaaaaagttgtgtagtactagtgctactacagcatcagcaacgctgtcagattggttgattggtcccttcaccaaagtgcagggaaggaggacagggacatgtccagatcaggttgcgaagaacaaatgaattagaaccgctgactcagcatcggcgaacgttgggacggcgactttgttagttaaaaccggcaccagtttggacagtcactagtagtactactcggcacagagtttaccagagtaatttgcggttgaacttagtactcctactaattaagatggtttgattatcttcatgatcacagtttgaagccgtcggagataaacaaatcccgagacggtgaccacatcagaaaattttcgcctttcctttcattttcctccctccgtactgttcgactattttgtgttttttgggtccaaattcccttttttttcaggttatttaattttaaattttgattactatttttttacttttatttttttgcttactaaacgttttggttttcctgttttgatcaagtactttcatccttttgttttttttatgcctgtaccagtttttttccttttgatttgtcagttctccttttgattcttgaaaggagagtgagagcaaatatggaaatgaaaaacggggctagtaaggaggcctggggtcagattttcaacgtggccttataagccattgccaaagtttaaaattttaaatagttaatttggggtgtttttgctgtaatttattttttagcactgacaaatcgttaaggacatagatatgaaagtttgtcatatttttatttcttcgataagccttcagggcagcatgaaaatgttcctagttgcaactcaagcttcagggggaagaaaaagtctgcaataattctcagaattcatggtgggctggacatggacatcagacagcctactttcaggtgagcagttgaaatgggctactttgagttaggccaatatagcccaattacatcgcttcgcctctctgtagctcatcggcttgtaggctggatgggccgaaaaaggcaatggacacctcctgtcctgtatctcgattttttttttcatttttaaatttttattttttaatatttacaggaatataatactggcgaaaatatttacaaaaatagaccctggagggcggcagggtgatgtgtgtgaccaggcgctggaggccgttgagcggtcatgcaaattttgcatgcggcgaaaattgcatttcacccccttacggatctcagcacaaaatgcgcacacggcgccgtgtgctacgtcaccttgctgccctccacttgagcggtagggtctatttctgtaaatattttcgctggtataatatttctgtaaatattaaaaaataaaaatttaatatctcctcctctccagactccagagaaagaaaacgtctgcacatctttccctggctttgtacgcatgcatccatttcataccgttcgatgcagaaactgtaactccttttggagtctagcttgtacagacagttaaaagttgttagatgaaatcctcatcgacgttctcatctgccggctagtacgtagatcgatgatgatatcctccgaccgacgcaaggatgtttccaatcataaatgccgcagagacacatgtttgctgcagtgcattgccatgctgccatccaatgaactctggcatatatactgctcccttttgctgtggcaaagcaagcaggatatatcgatcagggtttcctctcataaatgggcaggagactagatccaagaaagaagctagctagcatgggcatcaaactattcatgggccggccaggagctgaagcccattattatatctatccagcttttcaccaagaactagcccacctctacagtctgcactatacatgcagacatgcagtttgtgtatactatcttctctctctcattggttatcactctaagacagttatgttacacagtgaacacaactagctaggtagatatattgatctgtttaattagtgtgggagatgtcggtgtcagctagcagtagaatatcacacaatccttctttttgttaatcgatcgtcacgtcatattcgatcttgtatacgtcaattaatagtatgatgtatatatgtgtgtatcctttcaaaaagaccaaaaaggttcgaggatctctgcgtgcaccatgcatgcaccttacgtaccacagctcttggaaacgaggttctatcagctacagattttattaaaaaaaaaacaagtctaggcacaatgattgagatcacttattggatggacaatatgtcaatatatacacatgaaaattgcctggaacaaacgaattaagataagccagcaagctagcatgccagcgatcccccatccaataaggttttagattctcgatcgaacagtgcgcatgtacttactctattatattgcaaaataagtttgagtttcagaatttaaaatttatttttaaattaattaatttctactctcttacctacgccctttatatatgaatcgagaagttttatcccttcaatatcccttaccttctaccaactaaatatactacttttgcattaattaaatgatatcctttttttctacaagatatcgtaacttcgcggctttagttgtagaacaccacaaaaagtgacttttggaaaatacactctcaaaatatgaaaatttactgttggacactgtactcatcaggatattcatttctggttcaacaggagaaagaaaccgcgtgaaagttctgaaataccccacttgacccacatgtcagatctccatcactttctctctcgatgcctcgatgatcgctagcagagccacctccatctgcgagctggagaagaaggctcaagacagctgacgaggagtagaggagagcggagaggtgggagcctgaaagctagcaggtgccagatccaagctccccacctagatccgcgctcatgcaagctcgccgattggatccgcggctgctagctgaggagcttgtcgactgggtctctacaccagcgtcaacctcgccgtgatgactagatctatctggggaccctgctgccaacaacgtcgtcctacccaacgtccttatcattgcctccctagaacatctatcgcaaaggccctggtgcttgcctgaagcgcaccaaatccccgtcttgctgcctgcgccacggatctgcgttgccttggcactcgttggcagagctacctccatttgcgatgtgtgctcattggccgaaaacgaaggagagctgagagaaagagagaaaggagatggagacctgacacgtaggtctagaggtattttagaactttcacatggtttctctcttctattattgaaccgaaaagaatattctaatgggtatggaatcctacagcgaattttcatgttttgatagtgtcttctcccaaaaagtcatgacgtgcagtgtcctatagctaaaaccataaagacacaatattttgtatcaaaatttgcctaattaataggcaaattttggtcagttctcctatctagctactatttttgtcttattaggattaattttgtgaatcattttttttaagaaaaaacacagtatgaatgcatgtaaatatattgacgtgcagacactgacccctctgaataatattttaggactgaagcagtgcacatcacacgcactgttgaacgatggtacggtaagcaagtatatccatgcttacagctagctagcacgagtgtccccgtcgtcctctgcagcaacgatcgaacatgcatgacaagctagatcgatcatttctgttataacaacgagtcgtccaaaatgctcatatacatgtcggccggcctagctagctccgcatagggcatgggcaaaggtcgccgtcgtagagctgagagctaggataatttcggctaggttttgttccgcgtacagcagcagccatacactaccggccttttcctagctactccctccgtcagagaatttggttagatgtgacatatcttattacaataaatttgatagagaattcttgtttagatttattgtattaaaatataacacattcaattaaaattttttatatttagggatggagtgagtagctcgctgatccatcgatcgttttcccgtcgtgggcatcgcgatcgatcgatcgatcggtcacacacgacgcgcgcggcgcgacacatcacatgcggggcatgcggcgccaacgcctgttgccaccgctcgctcggtcgcgcgacgtacgcttgcaaaatgtccagtgtttttacgg

SEQ ID NO: 61916 - DNA, 2897 bp, Oryza sativa
  unsure (1)..(2897): unsure at all n locations
ggccgccnntttgattgcatgccgtacccatacccgaagcgttgatacggggacgattcaaacatacgccattctatcgatgtcatgcacctagagaaaaatgtcttcgatagcaccattgggactatactgggcataccaactaagaccaaggataggctaaaatcacgtaaggacctcgtggatatgcaaataaggaaagagcttcatcctgtggatgaaggtaataatggaaaagtgtacctaccgcctgcttgctacaccttgacaagagacgagaaaatggcattgtgtaaatccctacatggggtgagagtgcctactggcttctccttaaacattaagcgactagtgtcgatgaaggatctgtcgctttcaggctacaattcccatgactgtcatgtaatgctcacagtattcctcgccattgcaattagaacaatcgagcagttcacgtaaagatggtcatcacaaagctctgttatttcttcaattccatatctcagaaaataattgatcctgaagagttaggtcctctccggactttcgctatacagacagtgtgcgagcttgagatgtgtttcccaccatcatttttcgatatgatgcaacacctcatagttcatatcgtgcctcagataattgcacttgggcccctgtacctgcattagatgtggcctttcgaacgatacatatccattctaaaaggctacgtacggaaccgcacccacccagaggaatccataatagagggatacacaaccgaggaggtcgttaagtgttgcattgattacctaaaagatgagaaagcaattggtttaccgatacctcgacatgaaggtagattatctaggaaaggaacaaaagggaagaaaagaatccacgacaatgactacaaaaaagtgaaagatgctcatttcactgcgctgcagcaactcgcaatagtggagccgtacatagagcaacacctgcatgaattacaagcaacaaatgcgggtcgatctaatagatggatcatgaagaaacacaagcatcactttactaaatggttcaagaacctcgatctactagatggcataccatagaagaaagaacaattaaaatgctagctgacgggccatcaagtgtgtatacctcatggcaagcatatgatctgaatggatacacgttttacacaaaagcgaaagacaaaaggagtgcatgccaaaacagtggcgttcgagtagaagcaatcgacacaactgggcaaaagagcacatattacggattcatagaagaaatctgcgaactagtctacgggccaaatatgcagattccactgttttggtgccaatgggtgaaacacccagccggcgtgtctgtggacaactttgggctgacaatagttgactttgaaaacgtaggccacaaggatgacccatgggtgcttgccgatcgggtcgctcaagttttctatgtgacagacccatctcatttgaagaaagacatagttatttcgggaaaacaaaggattttgggagttgatgatgtcgaagatgtcgaggcatacaatcaatatgagaacatgacactattaacagatttttgaaacaagatattatgcgtcgaagaatcaattggtgaatcgccgaagccatacatgagagatgaaggtgtagggaaaagtgttagatgctaattcattatatatgtatcatgttggacgtatcgatgaattttaatgtattataatgcgtgacaatgatggatgagatgaatttttgtatatggaatatggtgacatgataattgttggatcaagaaatagtttggtataaatttatttgtatgcatgcattaaaaaaatatcaggtgcaaacaataaaaaatcatattttattttttttcataaattaaccatatttgtgtaaaaataaataaaattattttttcagttgagaatgacatgtggggccaaagggttttcgctggcggccggctttgcccaccgctagcgaaaactgttttcgctagcggcccacataagctaccgccagcaaaaactattttcgcttgcggcccacataagcttgccgccagcgaaaacccttttcgctagcggcccatggaatcctccgccagcgaaaatgttttcgctcgcggttggcgcgttcctccgccagcgaagatgtcttcgcctataagttgctagcgcgcgtggctgaaaaatttcctaaagtccggggggcggccgaaccctataaatttgggccaccagggttgcccaaattttttattgcccgcctccagcgataacccctaattacccggcaaccggccggctgttttcctccttcattttggaccacaggttccttcatttggggcgcctccaccggccgccggcgggtttctttcttcttcttaaggccgtccctccacgcgctaatataattcaaattacggctttttttttgttgggcgggtctttaagaacaggtgtgctgtacatattttttggcggcccgagagtccacctaggtttctgctctacctccccaccttcgagaggagcctacctcctctccccaactcaaaagaggcgttgtatagtattctttatgcgatatctcccacctatcttttcttcctacgacttcaattggatagaatcctctcgccccgaggatctactcaacaaaaataatttctctcttcttttctggtcagacatcacaatactctctctctaatgtcgcttcacacccacatatacgaattctcgtcgtaatctctcatactctcgttcgtaggcatgttatactagctcaacctgtctgatatatcacaatcctctctctgtcacccngaactcaatcctatttgttcgtctatatcttcacagatactatcgctct

SEQ ID NO: 61917 - DNA, 753 bp, Oryza sativa
gccaccgccgccgccgctgtagttattcgactcgccggaggagatgttgccgccggtggtgccgctgtagctggacagcatggcgccgttcgacacggccccgccgtcgctcccgtcgcaggcggcgcccccgagctgattccgggagaaggcgagcgccgcgtcgaggaggccgtcgtcgtgcgcgccgccggcgccctcggcgacagacgcaaacacgtcccccgagcacagcaaccccaacgggtctccagccacggcgccaaatcccgaggtaccctgcagacacccgccgccgtcgccgccgccgacgccaccgtcgcactggagctgggcgccgaagcacgcgcccaggaacgcgtcgtccagctcgaacggccgcccgcaccccaccgagcgcggcaagtagatgtcgtcgtggtgcatcagctgcccgccgccggcccagccgaaggtctccatcgccgcgccgccgcaagaatcaccaaaccactggcttgtctgtctggctcacggattctcgacgtacgacgacgcgacaaaaccgcgcacactgcacgcagaaaacggaattgaagcgtgagcgctccagggaatcctcagccaaacgaatcacacgaccgatcaatcagacaccgatcaagacgagcaattaatctctctagataattacaagaagagcgcgcgcatgcgtgatcgatggaattacaaatccgtaatcagcatcaagaaacagtggcgctggtgagcggc

SEQ ID NO: 61918 - DNA, 5913 bp, Oryza sativa
catttcgaaacggagggagtatattatagtatacaaactgatatttgtttggttacttgttgcattccatcatatcatagtcatcaagatatgcttccgcttctgcgcacgcgacgacgtctattccacggcggtcaacaacgtcgtcaattcatcaggtcttctgcaccttttgctctctgtatctctttttgatatgttggtaggtcaagggtagcaagtctgatctactgttgttagtgttgttttcagttcaagaatggtaggctcgagacccaccattggatgctgctgcttccacctttctgaacctgtgcaacagtaaaaatgattcaaagccggggacattattgccaatcgtttcaaagcaaggaaaagagaaaaacagcagaagcagcgtcagtcgcacgacaaattgtctacttatcaatcatcgcaattgtttatccacgtaccaatgcaggcatttccttgaaaaaattcaaccgtggccgaggaattcctgacatcgttgagcatgatttccacaccaaatacatcatctacagttcagattaagaggcaaagatccatccacggtagtataatccttcaaatttgaccaagactactccctgtaccatcagggcttctgaaaatatcgatcctttttctttgtcacggcaaagttcctgaagaaaaacatttgggaaactagccaagcactagcacctagatgaggtcgacgcccatctttagcttccatttttaagatagatgtaagccaagccggcgaatgcatcatgaatgagcaatagttttgcattggttgcgccggcgacaatgtaagcgccatgtactcagcagatagctctacttgcgacacatcatgccattagcacattaatgtatatcctttgccacgatttttcaaatggagcacaagagatgagattacaatgccatttggagctggtagatgacaacggttgtttcacaaagtattcatgcttagctaagactcctgttcgtgtttggttgccatttgtttagtgctgagatcatgtggacttgtttgattaattacgatgagttggctcctgcattcagtgtagcagctttcagatatttcaggccttcctcaaggtgacaaggagatgcactctgaatcattatgctcgtacttacataatactcctacataatgctgtgacgttctgtacgagagttacctgttttctggactctctgcagaatacacaagagattgtttcttcagagcaagattgtttttgtacaactgaactcgcgttctaataggctgcagcttgcagaattcaggactacgattaaggcaatcaatcgtacactgaagatgatatgacaagatacactcctctgaatggaagaatttaaggaacacggatggattgtcaaaacgaagcaggctgcagtaatgccacaggtggcttattcaaactgcacgatcagaaagcaataaattttgatgctgccgtactgcatctatagcagccaatgattaattaggttcagagtcgatatgaattaacaaatcaaactcttgagctgtttatttcacattcacaaagtgaatgcctgcattaaccaatcttgatatcttctttttctgctcaaagacaaaaatatcggctagcacgatctcatcaaattgccgtactcgcacttgattcatgtcggctgatgacagatcgcattgtttctgaacagagatgatggtgtgcaatgcttttttattcacacctttggtttgtacctaatacttgacctggagttggaagttggaactttaacctttgggaattactttcctaatcccgagtcttatccagcaatatcatactatgcttaaattatccttgtgtcaaacatctccgacacgtaattagtaaaaaaagagacaggttcagacaacaacatatctagttaaattatctgtaataatgtatctagtcttcttagcccaagatcccactatattttttctctcccttttagctttaccataatataagattcccctttgctgctgctgcttgtacaacgaactcacgaggtgcccatgtggagctcaaattattatgtggctggcctgaagcatgagatgagatgatgaacatagctgttgtagttgtgtcagcctggcaggtcaaccctatcctagtattattgcatatgcatttgcaaattgcaatgatcttgcacagagacatttttgtttaggtactaatcattcttgtggcacttgctctgcaaatatgtgttttttttacacatagaggtgcatatatgtgaaattaatattgatctgtcgataaaagtgcatccgaagtcataccaaatatttagaatgtcaattatacttcaaagtacataaacaattgacaagtggagcctcttgcacatttagagctcatttcatctcatctacagtagtataaatatagaatagctcatagtatagtacataaaactgtttgtagagcagaaaaaactggattgtaactgtcgagtaccgaccgtaggaaatggacctttaggggaaggaagtactaataattgagattgttttaggacagatgggttaaattagctgtttgattggtccatagggcaactggacaagagagctatgttgaagtcaaaccagatataatgctcctgttttgaaaagcatatcatgattcctaatttataaatccccagttcggtgattaatctactatttacatcatgatgcactaaactagcttcttccccctttttttttgaaaaccagattgtcactctccaaaaaaaaagtttatactgcatacctttctatcaaaacccggaccattataagaatgatggatataataggaggagctctcatatcgaaatttattaagagaagctatgctcgaacctagaccagcaagccccaccttgtggtgctaattagaaaatccccataccttcgtccagccggatcattatgcagatataattatcttactttaaaaaaaactatctaaaaaacatgttgttaatgtaactatactttccattgtacctttttttaacgtctcctaccttctttaataaaaaagaaagaatggagataatctataataattgtagaggtaataagacatttttaacgtgaagtactacacgtgagactgtgatgtatacatcttttgaaatgatacttttacagcacaatataatcatgttgtacatatttcaaaatatgtaaacttaatataatcatctattaaacttatggttgtatgtcttatgacaaaagccggagatgtaatccatttctattatctaaaaatgttgtatatatttcagaacttattcttttaagatacaatatatttcatgactggacatgaatattttttttagataatggaatccattcatcaatcatgcagaacgaacactagtacgtacactactgtaaacacacagttttctgaagtctgaaccttcattgcattactagctcaaacacacgcatggtgttctacagcagcagcatccaaatgagtagtagcatctctactttcaaaagaaatgagtagcatcagagatcagactatcattgtggagtgacttttgttcgaatatatatcgtgggctaagctgttgcttattcctctgaaactgtatgcacttttttcccagctcgagactaaggactacgtagctgtaactgttgcttgtgcagactgccaaacccttgaacaaattctgtcatcctcacgcaagtcgccattgaagaagaaaaattaataattagtacgtacatgtcactgtcttacatggccgtaatccattggttagcccggataatcatcagagggtctactctgaaatatctaaccacagtttaattcaagtttttgcacgatttgatcccctaattggccatgtttggtacagatggaccatgaggggaaggatgatgctaacgaattggaattcagacaagagctaggaggtgtgtgtgtacggttgcaggatgtggacgattcgctgagatttctgttaatcagttaatggcgtgtctggactggacaaccacctaattagggggcatgttactctaacatggcacaccaaccaatccggcatcacagcagaaaaaaagggcaagaggaaaaatggtcctccaatcctacacatatatcctgaattgctcatgcaaaacaagctgcctgcagattgctgctgctgccatttcttccatccatacttgggtcacaatagctttactgttcttatgaaagtatcgaaaggtactgctccctccgtcccatcttaagtgcagctatggctttacgtgtctaactttgatcgtccatcttatttaattttttttaaaaaaataaaaatataagtcacgagtaaagtactattcatactttatcatcccataacaataaaaatactaattataaaaatttttcaaataagacagataattaaagttgggcgtggaaacttatggttgcacttaaaataggacggagggtgtatatttttaatataaaattcaatatctctccgtactatagcaagagatttttctgtaggctgtgtttagattcaaacttcagtccttttccatcagatcaatctatcatacacaaataacttttcagtcacatcatctacaatttcaaccaaaatccaaactttgagttgagctaaacacagccgtagctaaaaatatgcagctttctcatcagttacctggaagaacctgtagtaggatggatggatggatgagaatgggaatagttctagtcgagtgatttcataggcctcattgataggcattggaaagagcgaggagggcattaaatcattgcaagatttgagggacaaaagacgagatgctcgatccaggcaacttgcatgtggaccaaaccatcagagctccaagtgggtgtgtacgttgtgacatctgcatatggacatggcctatgaagaaaatggagccattgcatttgccttgcatttgccctagttgacccgggactacagtctcatcggctgcacacattacacgcaagaggagatcaggagcatcaaatagggccggtttagttcacgaaaagaaaatttttgttgtcacatcggatgtttgaccggatgtcagaaggggttttcggacacgaatgaaaaaactaatttcataactcgtttagaaaccgcgagacgaatcttttaaacctaattaatccgttattagcaaatgttggttaccgtaacatttatagctaattatgggctaattatgctcaaaagattcgtctcatgatttttcccctaactgtgtaattagttttttaatttatctatatttaatactccatgcatgtgtacaaagattcgatgtaatgtttttgggaaaaagtttatgggaactaaatggggagtagtactactagtctgcattggtgatggtattctaaacctgattgattagtacgtgtcttggggcctcccaatcccgtgaagttgcttgtgccaatgtattcaacactgagtattagtttttcttttctttctgaacttattgttaattaggtcacgagttgatttatttgctctcacaacttctgggagagttactctcagccgctaatcggaaaacgagtcaaccccgttgaaattcaggttgagatctgctcgattctgtgatcacgatagaactaaacaaaacctggttaagaaatggagtactcctaccatatcttaaggtgttttttgtagtgtctttttgtagcctcggctcgatgattaatggtggaacgaaatcaggttcggtcagccgaggtgttctctgaaactcccgatccttaattcgttcaaaatattcaaattggatga

SEQ ID NO: 61919 - DNA, 20381 bp, Oryza sativa
accgggtcctcgtcgtccacccccctccctgccacctccaagacgccgccgccgcgcagggactcgtcgtcgccgcctcatttcaccacggtgagcccacgccctccgcctcacctcttctgtcttctctctgcttaaccccatcttctcctcctcagccgcgccgggactcgtcatcgcgccggtgtaccttggagatgccgtcgaccaattcatactatggcacatgaatgatattgaactagggtcaacggatggaactgatcgtccaccaaggataccggtgtcaccgtcgcgtccaccagtcgtagccagtccgagggatagtcctattgcttcaccccctagaccagagccaccagttgcatcacctttaggaccagagccaccagttgcatcacctcgaggaccagagccaccagttgcatcacctccagtaccagagccaccagttacatcacctccagtaccggagcctcccgttgcatcacctcagacattaaaggatgcagaagaaccatcagagcctgtacaagcagagcctacaaagctagcggcgggtgaaattgaagcggtgcctgatcagccaatgcccgatcaaccagagcaatcacaaccagagccatcgcaaccagaggaacctaagggtgctgatgtgccagtgatggtaaggacgcacaagcacaaagcaaaaagtgagtccaagaaacattatatggtaacagattccgaggaagggacaaagatatcataaatgccgaatttgataacagaaaattaaaagggttcaaacagacattcgttgactatctcaattatatcaattccccagacgtgccacacgagtttgagaatggcaaaccattcatttacgactggcaactaagagaaggaccgtgacaactaagaaggtggcacgattggtacattagggcaagcaccatgaaaggcatcgattcattcacagttgccgtgggggagaacatcttctggagcgatccttgtctactccaagtccatttctccgatatgcattccctctaccgtaggaagcagctagactccaatttgattgccatctggtgtctgtaagtgctacacttgaacgtgttaatagatcactacacctatatgcgtagctcatttgatcatccattgttggcaggatgaattacgtggaagcggaagcgatgaaaaagcctgtcgcctacctaaacccgtgcaggataagtaagccgaaccacacatacacgctaaatgagaagaagctaccagaacaaaagagaggaaagcttacatagtacaaaagcatcttgaaaagatgctcgatgtcgctacgtacgtagctattgcgcttgaatctacgtaggacaaggagtgtgtttatgcccaatatgcctttgagtaagttgtaatatatatgcactaagagtatatacatataatcatggcttgactaacaattccgttcgcagcgaccattggatagtctttcttctctatccaaagtacaatgaagtcatcgtcttggattctctcgacaaagatggcaacacctatcaggaatttctaagaattatcaatctgtaagtaagatattagcatgatgtgttttaacctctgatgaacacaaattatttatgtccgcaaaacagtgcatttaaaaggtattaccagcgaggcggacaacgcaaaaactcaagagaacgcatatccgtccgcaataagtggccggtaagtacatatatatgtatgccacacagtactacttaattttcataaatgcttgtgtgtttccatgtaataacctattataccttataattattttgatgttgaaagtgtcacaagcaaccggtgagaacagtactatgcggatattactgttgtgagttactaagggttaatgggaaatattgtgcgaattacgacgaggtaagtaatacagactagttaaattagtcgctaacttgtattattgtgaatagttaatttccttaattctgtcatgatctgatgcagcttccaaaattccccaagtctgaaagagagctcaatgatacatccattcagaacattcaggcggacatgtgctacttcatccaccgtgagtgcgcacatcagcttgggcggtttttcgacaacaaaggagtcttagccctgctggagaacgaatccctatctaactggaccaggcgtataatatagctagggttttctaattcattcaaaatacttgtaaatgttatgtcattggtcgaatttaatttgtcaatgtacatatatatataggtgcttccgaatatttatatatacgtatattattctgcttcatatatactcaatgcgtggctctaaaatacgcgaaagagaacatactctgtcgatagctcgattagttatatcaaccacgtctgactctgaaatacgcgcacgacgaaaagaaaaaatagtatatataataatgttttaattttttttaaaaaaattgcatcttcactggcgggccacgtgtcagaactaggacagtccatatcttcgctgtcgggccacgtgtccatccacagaagccttacttcatttttcctagcgtgccacgtggcctaaaatactgagccgccagcaaagaattatcttcgctggcggccgacctaaggctaacgcaaatggagatacttctttgctggcggccgcattatgtccgtcgccagcaaagacatgtcttcgctggcggccgtcctaaggctaccgccagcgaagacatctctttgctggcgggcgttcctttctcggccgccagcgaagatgcattttggctggcggtaaataaccgctagcgaaaatcgacattttcactggcctttgctttctggcggttgcgatttccgccagcggaaatccaaaatggctgccacgaaagatggttttcgtagtagtgactggtccaaatgcatgtctttgcgagtaaaagctgtggatactaacattttagctagcaaagtggatagggggaaggaaccatcctcaccttatgaaatgaaattgagggtgtgtttagttcacgctaaaattagaagtttggttgaaattggaacgatatgatagaaaagttggaagtttatatgtgtagaaaatttttgatgtgatggaaaagttagaagtttgattgtttgaagaaaaagtttagaactaaacaaggcctgagaatgcatccattagacttcggcatttacaggagtgcaattgaacaaatatgagttgatacattagaaataagggctcgtggttcgttgagtgttttgtagtaaacgaggggtccacctggaagatttgtttagcaccaaaaagtgctgtaaattactagccgaaaaatttgagcgagcgggcacaaataaactgttccacacactgcccccttttgtaaggcaaaaaattccattgctattatcagagcctacgtaaagagcacaacatgcacaccaattttgtactgctagaaaaaaaaaacataatcaccatgccattgctctttttattcatattagaatccatctcgttacttgcatagtacaggtacccgctgccatgagcccatgattctgatgtcctgaataaacggacgagtatataataccgccgattatccaaattgagcaaatgtcacatcaactccaaattgcattgcaccagttcgattgatttcatggaaaaacacaagaggacagtaagagacctgtgtaccccatccacagcccagtaactttccatgcaataatcccaacacaactactatactgctactttgctctgactgaaccaccactacaccatcaatttcgccgatgtcattctcgttattatcacttttggatatgcaattcaaccatccactaaccaatcaatcaatcagtataggaaagaaatgaactgcagatagaaattaacatatcctgaagacctctccaaagtgacagtgctgccgatctcaccgatgttgctatcctgtgtgtgtctctaagacgagagggatgcacttgactccatgaccagcatggttcacgagccagtcgtatgaaagattgtggcattcctccgaagcaacgagagccctacaacagctagcactaactagtgatgaaactctatgccatatgccagccaaaccaagagtgcacattcctggtgccacccatacccaacctgtagggtgtacgggctggtgcattacacttgttgtgggatggatggcacatgctatttcttgcaaagctgagataagggaatctaccccctgccaacacaattaatacttgtgatttgtacaaagcaaagatgagcaagaacagttgagcagctgacgaccgggaaatagttctgaacatggccagctgagactgacgcatttaatgagcatgtgatcttagaaaattcatatcaactattcatgtttttggttttagagcaccgaaaattcatcatacattttcattgtttttctcaagtttccaatcatgtttgacgggtgccgactcagaccacataaattgacattctcgctttttttagttatttggttggtctgcctcaaattttccgcaactattttgtttgattggtgcataccacagttgcaatcctggcaacctcgcccataccttgaataccttgttgttggcccatcgcgtcaaggcccagcactgggcctaggcaggttgtgtgaccgcctgagagccacagccgtgaggggtccaacccggtatcccttgggtacaaagtagtgcagtggcgcagccaattgcaactagggtactaggcccagagatgattcgagttcgattgaacggctcatcggtgtggattgccgaactgactccaatcccaaactcctaatgatcgtttactcgattcgtcgtctcctcctctcgacctctcctcaccatgacagaccagggtcacggactcacggtcatagggcgtaggcagcggatggcgacagcctcgacaccaccgcagcctgcagcttgcaggccacaacacagtaggcagcagcggctcccagcatgcacaactgcacatgtaggctaccccctgacaatttttgctacctatgcggcctacctataagacatccactatgcatagttaaattcgtaaattctttagtagtgttgctatgcatgatcttgagcttcagtagttagatgtgaagataacatttttacatggagagcttgaggaggagatatacatgaaacacccagaagggttcatagtacctggtaaggaggattatgtttgtaagttgaaaagatccttatatggtttgaaacagtctcctcgtcaacggtataaaggtatgattcatttatgttgtcacatggctttaagaggtctgaatatgatagctgtgtatacattaaatttgttaatggatcacctatatactacttgttatatgttgattttatgctgattgctgccaagagcaaagacgaaatcattccattgaagaaccatttgagtagtgagtttaagatgaaggattttgatgttgttaagaaaattttaggtatggaaattattagaggccgacattctggtttgttatttcttaatcagcaaagttacattaagaagtttgttcagcgtttcaacatgcatggtgcaaagcccgttagtacttctattgcacctcattttaaattatcagctttacaatgtgctagtactgatgagggggtagaatacatatcaagggttccacattctagtgatgttggttcttttatgtatgccatggtttgctttcgtccggatttatctcatgctatgcggttggtcagaagatacatggctaatccaagtaaagaacactggaaggctgttcagtggattttcaggtacttcgaggcatggtagatgctttcttgaagtttgtcaagactaataagggacttgttggctttgtggattcagattttgctgctaatttcgataagcgaagatcactcacaggttacgtgtttactattggtagttgtgttgtgagttggaaggtaacattgcagcctgttgttgcccagtctatcactgaagcagaatacatggatattgctgaagcatgtaagtaatcattttggttgaaatgattgtctgctgagctttatggagttgattcttgcattagcctattttgtgagagtcaaagtgctatatacctcactaaagatcagatgttacaaatcacattgatatcaagtatcattatattcacgatgtagtcgcacaaggtaagctaaaggtatacaatataagcactgtcatgataatcctgctgatacgatgacaaagccagttcatgttgctaagtttgagttttactcaagcttagttggtgtagtggtttagcccaagaggctatttagcgctgaaagtatttttctttgttgtgttcaaggtgaaggattgattaatgctacaagaagaaatttatttcaaggtggagtttgttgagttgtgatccaaactccggatggagcgaagcggaggcccgtcgctagaggcttgggccggagtgaggcggattgatttattgtgatctaaattcatttgcacatgtagtgattgatctattgttttttatcgtttatttgcctatcatttcctaacaaaacacgaacagattgtatatacgaaacatctcgccaaacatcgatttggcaaaggagcgggctgacttgccagctttgttcagtgtagtggggtagcaggtggtgttaaggctggactctggagaggtggaggctggagagggtgctcccgatgtgaacgtgttcctccagcgtgcccgccgtgcaaagctcggcaaccatctttaacctatcgccgaagattcgtgcacgaggcagggtttcttctgtcaccgttgccgccatccctactaggcactgccatcatctactccacgggaggggagggattgactggatatgtggggtggcgatggtgtcagcaccactgctgtggataactagcaagagggaaagggagagagagaagaaaaagaagaaattggcgaagaagatggaaaacatgacagcgatgatatgtttttaattttatgcgtattcaaatggcatggatacaaatagacaaatttacctaaaataacacatttgtaatggcatgaatcaaattaacccatttacatatggatatggttggtctatttggcagtagttggctacttggccttggaaaggggaaagagagagattttatttttaattcaatgtatatattttactacttactagtcccaaaattaatggaacttgtagggcaggctccttaccctgtagtattttacagtaagtatctgatattttttaaaagtttatttctctttgtagttatttatttttctttagcttcattagcccctatgcacttacatttatttgacaacatttttaacggccaaacaatttattttggtattatataaatagaagggagcgtaagttggctgtaagaacatttgacattaatacaatttttactgtagttcttctactgaccagcacatgaaaatctgcatgtacaggaagaatagtgctagtagtcactatgatcagcgtcccttttcatgtatctggtcaagctaattaaaagggcaccacagccaccgctggtgcgagtatgcaaacaatgggggaaccgggtactcccaatgcctccatttcctcatgatcctctttgtttcattgagttattttttcccaatcctccgccatggttgtcaccgcaagattgtgaattcaattacgaggcatgagcagccggaccatgggatattcaggcactcctggtgtttcacattcctaatggcctctactgtagctgccatgtaatgctagtcactctggccactttcttgccattattttacgaaatatatatatatccactcgagtaatggtgacatgaaaaatactaataaactatccagagcagattgcttactcccgctctgctatcaaaagagcatacacaaatctaaagcctaaccaaatgatgagcacctagcagcgaacaccctaatttatccttgcctctttcacgttaccaaatatgtagaagcttactgtcagtctcaattaaccaaatatagtactagctgcaaacaaggaatatatatgtgtgtgcatgtgtacgtacgcaagtgattgaatcgaacaagcaattcacccaaaagtacagtagactagaaaatatctcctacagttttcgtttcaatatatatatatatatatatatatatatatatatatatatataagcagcaaaccaataatttcgtattatatacggattcggtttacaatagcagaaaatgaaccctagacgaactcttctatccgatcacttttagcatgaacagtgagaataggattcacttgagtatccagaagtaaaaccagagacgatcacctaatagctggcggcgttcaccagacatctgctaggtcttggctgcgcagcagctaacaaaatcaatcctaatccctcgttacatggcctatggcctgtttatatacatgcacattaattaatacttctccgtttcatattatataagccgtttgactttttacttagtcaaaacttttaggtttgaccaaatctctactattataaaaattaaaaatgtttttaccagtattttggtatgtcattcgtgtatgagtcggtttttaagttcgtttacttttagaaatacatatccgtatttgagtcggtttctaagatcgttcactttcggtaatacagaagtaatcatataagaaatctgtttaaaaaaactcgtatgttagcttaagatgatcggtctcttaactacaggtcatgattttctaaaaatatatatattgaagcgaactcccataatgaaattcatcttaactaaaccatataacaataataacattaaaatagacttcacccgttgtaacgcacgggtattttttctagtttaataaaaaatagtaatatctacgacaccaaattaatttcattaaatttaatattgaatatattttgataatatgtttatttgttctcttcatcctcgcagtcgcagctgctgtacatatccttagttcggagatcggcctcggatcgattcgccggtgttttcttccaactcgatctctaatgtcacccaccggctccttgtgccatcgatacccacacagccagactctctatgtgttaacaccttcaccgatgtaacggcgagccagtggctgtggatttccaaagatggcgatttgttcctcttctctgttcttcgatggcttgttttcatgttctgaacgtttttattcacacagtagtgggcacaaaattttttgatatggagtaatttgttacactgaaaattttgggttacaagaaactaaaggtatttgattacacttaataaaattatgagttataggaaattactccctccggattgatattacttgtcgttttggacaagggtatgatttaaaaaaacaactttgaccattattttttattataatatgtatataaatattaacaaatatatgattttattaaagtatttttaagactaatctatacatataggcaccatatttcaaacataaatattttagaaattatttatcaccatagattttaaagtttgaccaccctcttatccaaaacgataggtattattacctggagggagtacaggttatttttaatgagtgaaaaaaaatccagaggttccaacgttcaagcagacttcttgtgtgccgtctaactttcttgcgttgtgaactaattaattttcatatcctactgttgttgccatgtatcgtggccacagtctacacgtgcttttagcactaatctctaactaatttcttgtaacaaagatgaacgaagggaaaggaatatagagatctttcttgactgcgttctttcataatcatcggtaagtatacatgaaagcaaattactctgttatcatcaactgcataggtcgcaattattgatcaactacctagtgtgtttttggcaagaaactacaagcataatttcataattacgtttctttggaccaaacaaaatacaagcgtcacctaagtatatgtgatagaagtgtgatagatatcatgggcgctcacagtgtgtccctgatatttaccattcctcatgtacaccaagtagacctccatactccacaatgagtacttattgtgggtccaccgaaaccatctattttacttttcatctcctaatctctgtttatatctaatctgtttcttttctcacctaacctgtttcttttctcaccggggaatttttcatcttctaatctctctctcctctctttcttttctcaccagggaatctgaagtggtggccggcggggcggtccgagaagcgatggcgctaggcggcagggcggtgcccgagtgcctcccctcctcctctcccggccgccacgaattgaggggcggagtggtcggggagctacgaccggtgcggatcaggtggcagggtggcaatagtgctctggttggcgcagatcaaagggcagcgcggccggcagcgagctccgtctgttgtgaaggcaggggccgtgatgagccccgtggcggcgctgtcctatctcccagtcggtggtgccactacaatctccggcgaggtgagctcaggaatggatggtggtttccctcgccaatgcctgcgccgaagccacacccacgaggctctgcccaccacaacgcgacaactcgcctttttccctgcttcacaagtcgttcttcgttcgaagaatgagtgtccaagtttggctccgagaaccttattcggttctgagtactgccgatgtggcgcccgatatttggtttttgccatggagctgaacgccacatccttgcagtgtgaacaccctaattagactagtcttattgtctggcagcctgggtaggtaccaattctagaccattcatctagcacgattgaacgactaagatagactcagtaacgagcagtaccactgtttgattccatgcagtaccaccacctgaagggcatttttgtaattttcacatagcctctgttcagatcagatcggctcggccagcctcccgcccactctccatccaaggctcccagcttccttggggcagcatggacggcgttggtagtgggctgcagcattcagggcgacgacaggctacgggatctagggcggtagcaggctgcgggatctggtacagcgggctacgtgatccgggtcaacggggtgcatgaagccaatgatgacaggttgtgggatgcaaagcacggcagcggactatgggatctagtcgagggagtgcgagacctgacaggtgagctccattctagctcgttcgcatcttgcctctctagtttaaacgtctagatcagtactatgtagtactagtaccgcggggtaccaaatgttgaacagtaaaaaaacctctttgcagattgctcatcgcaatccacatgagaaaattgtttcattgttagtagcctattatagatttttcgctagtttaatttgttgttgcagttctacctttcagtgcggctgacaactattcaagtacacgttcatggtcgtgaatgattgtgtgcaacgactctctatacttcaaaaatcatgcttcggacacaagttttggacacatgtgcatgctgctacaatgtacaccacatggtaggaaagctctctttgaatgacgccatgcaagaaacataagaaattgtaagatcaaacctaacaacggcatgactgaattccccgtgcttcccatcccgatctggaatgtatatttcctatatgcgtgtccggcgttcatgatgaattggggataaagcaagacgatcgacaaggctagtggaatcctctaactgttccacaagtggaagaataaattggaatcaatatgcagcagaaaaaaagtctgttgctacagcttgcatttgattttgtggacgctgtggcattttttatcgaactggcaaaggcaacaagtacgtgctaccaagttgcttttgttataattggaatcgatgagatgttattctccactggactgaaaatcttccaccgtatgttattgtcctttgaagagatgatcgactccatctctgataccatcccagctctcatgtattcctgatgtttctcaagcctcagaaagatgccgctatttccaccaaatgtgtgtgcatatattctcgaccctgagtaagagtgtgagatcgaagaacgtaaactgcacacttcataacataacctactcacagagctgaacttatattgttgtgagcttggggtggttcatgatatgcaaaatgttggatcgaacacaagtaaccaagcatacttaaaggggttgatggtagaaacaacagaaagaaaacttttagtggacataaaagttaccatcgtagccgatagagatcgatctgcccggtgtgcttcctctagtctaagagtgtccttgttgccgctctgactagtgtagatatgtggtggtgcttcttacgttgggcgttgaagtgtgctgataggcaagtttcatttcaagcatatgtaatttttttagtggtaattcagtatagataaattttcttttaatttaatcatgcatgtcaatataacagtcttagttttctaaggaggatgagcaatgcgacactctgattttgggtagatccagagtggcatccaaaagtacaaaagatgttggagcagctttggcacttcctggaacgtgccaatccgcgtaggctgcgttctgagcgcaccccgttatgttgaaaaaacaaacgcgatatgtatttgtgttcgagtcttagtaagagtcggcatcatgtacgttatggttgtatgggcctgtagtctctgtccaggttgcatacgtatatatatgagtcggggttagtgtcagttaagaaattgagttttttaccgagtctatgttagagttatgcaattttaaaatatgtttctcttctgtgttccatggtgatagcgtccgctgttttcatctgatcgattctggtgaattccaacaagcttcaccagcaaatagaggcactgttgacattaaattgatatacggtgagcagtgaatgcactttcgcgtttggtgaaaattaggtaatttcagcagcactgaaatttacgaaattccatgattttcggcactattttggaccaaaactatttgaaaatttaataaattttgactgaatttgaataaaatttgaccaaattcaatagaaatttgagatgatgacttgccggagccgaaattaccgaaattttcagaaatttcgaactgaaattgctattactgacagtgacatcgatttcttcttttcacagatgcatggaccaattgaaggaattaagatgaatatgcgctgtccgtctctgtctccgctgttgcaatactgttgtgtagtgtttgggcactctggtgtctccctttcccaatggctactactgtagctagcatgtaaaattagctattgtggtcatgccccttcttctcagctgcttgaattttgagaaatatcagcttgggtgttgtctcggatgctcaattgcattggtatatatttctggatgtcatgacaactctgattggagttgggcttttcttttcttttctttttttcatttcatcgatatcaaatcttttctcttgagatattcataaccaagttggttatatgaaagcttttgcacacaccgactgatgcgatttacacaattaccagatgtattcaaagatgcaatttatcagtggtattattcgaactgtcagagtattgaacaaaatggtattgccacacataatttttctgaattggggtcttgatgtctgttgccacatgatacgcaaatgctactcaactatcactcgccatacacttatcagactcaccttgttttacttcaagcatgtacagaaacagaagcataaattaatagcctaaattgaacgatagactttgcaatacacatttactaaaaacatttgagatgtacctagtggcctcaatccttcagtctcttctgaatctgagactcgatgtgccgcttgtaccctgtcttggcaattataattatatgacattgcatccatttgcagcttcactggccagctccaagcagccttcttgccgggcttcactatcgtttgctggtgcattacagtactatcgccttccattagttcttgattatggcaaatttctggccgaactgctgacttgtgttaaagagtgtaaagtaattcatttttccctatggtggctacgaattcctcgtgctcaccgacctgcgacccgtctcaccgagctgctcagcgattaattttttgagatgatgaaatgcgagtttgataactatttatacgacattgcagaagtgtgagatgaaagtcgatcagatcggctacctctacgaacttcaaatttgagggtcttttattttcactaaaagatttttggtttttggtatttctaccatttcaccctctctggtagatttggttattgtgtcctattctacaccggtcgagtactcaatgctaaagtgtgcctatacaacagggtaagtacaaacatgtactgtagtatcaactctctgtgcaacagtgaagattaatttgcccatctgttcaggcccgcgactactgctgccctgcacggtcgtcttgatctacaattgcaaggagaaaaaatgtcggacgagcgacagctgagattctaggagatcctgacacctccatttcctattgaagcttaatcttgtcgtttacccggcatctatatccacatggatatgctatgcatatctacttgatctattcatctcggagttgtgaatggcataggtatatatatggagatgcttgcgtagtggtgtgtacgttgtcatctgttgaagtgtatcgatcggcctaccatatcaaagtgttaattcaacacccaaaagtacatgaagcatcaatttatatagatggcaaaaaaagttactggtagggcttgatacacagtactaaaaggcaagtattccttccgatcacaaatacttacatttcttaggagaataaccgatcgaaattagaatatttgactataaagtaattttaaaatacatagtttgaaaacataaaaatggtatgtgcaaatttataacgagaggtacttttataatctcataaatttattgtaaagtaaatttgaggtcagagtcataccttaattaaagagacccagaaaaaagacgacttcatgcttggttctcacgagcagggagcagaaatagatcttatctgcatatatgattgtatgattttcgtcttattgttaacacagccaattaggcaaactcgcagtccattcaagataaagcattgtaacatgtctatattgttaccatataacatcttctcttatctataaaggataaataatcctactgtagtttacccatggtactcatctaccgcttccacagctgttgtgtatgtaggatcgaatcataagaactaagccaaccagaggggggtgaatgattggtatacccaaaaaccgaaaacttttagcggaaataaaagttaccctcgaaatcgacggaagtcggtctgaccgagattgatctgccggtctgaccggtgttgaatctccggtctgaccgccgaagtcgcctgccgcgcctgtcgccaccgccggtctgaccgccgtgctcctgccggtttgaccgccgcaatgccgccggtttgaccgccggtgagttgccggttagaacgtcgaaacccggtaaacacaaatcgaaaaactcttaaagtggatgacgactttattgattctctctgggtttacaaagtgcaccaacagtactccttacaaaaatttcgactaaactcgaaaccctaactcaaaactcaactctattgctctctaaagcggtaccgggaagcctcacgctccccctctatttatacatgaggtaggcagcctaaagccacgaaccaaactcatactaggagtcctaaacactttagaaaacccattagtacaagaaagaaactttacataatcaatcgtaccaaatttggactccttccaaattcgactccacatcccatacgcacacaataactccatcgtatgccatatggaatctccatcaaccacgtgcatcaactctagcctaagtatcccgcatgatctctgactacaacggacgtcgtcttatccccaagccgactcccggtccatcaccgcaaatactctcccgagacatcgagtcacctacacatggaacaaacaaagaaaccatattccgagaccaagctatctccaacttgactcattagcagtaaacaatagtattacatatgtatagtatccatctagaagtcataatcatgaaataaactcggatatccaaataaacaacccgaaaccgaaaccgacacagtgtcagccagtcagaccatgggctggccagtccgaccgctcgatcatcgccggtctgaccggcaacacctgcccggtctgaccggtcacataaaatgataaacctgtgattcacctgtaaatccaatcatctccaaaaccacttcgtgaataaattccaaataataaaactaataatctccaatacccaattgttcatcacagaataataatcaaaaacacatttgattttacagtgtatgtccgatcgatcacatagacttactccctatgtcccaaaaaaacataactagagtttgaattctgtcattaaaaaaaaaccaacttctatcatcatactccctccgtcttataatataagagattttgagtttttgtttgtattgtttgaccactcgtcttatttaaatttttttgcaaatataaaaacaaaaagttgtgcttaaagtgctttggataataaaataactcaaaaaaataataataataattccaaaattttttgaataagacgagtggttaaatagtacaatcaaaaactcaaaatcccttatattatgagacagagggagtactttcagcacagaaaacaagaagttttattccttgaatgccctttacctacctaccaccattactatcttttttattaatgatagtcattttggtcacttttacttctaactaaatttaccttgggatactagaaatctttttttttttcggagggagcaatacatatgagaatgcaactgtcacatgattcgctggaatatagtgccatatccactactcagcgtccctcgcttgtcagtcaccgcgctgagacaatgggactttctagtatctcattccatgaaggcatcactcttgcttttcgtccattgtgggctgatggcgtgcaaagatcaattggaaaggaaggtagggtaggaattcctgatgcctccctctccaagctcacaatgcgagagtttcaaccgccagccatcatggataaagagtttccaagacaaaattcttatcttacgttttctgtttcagctagtttttattcttggattcaagatatgattatttcagtttcgtttacaatgcccattattggagaataaccccatacttagagtgttgtataaactattgtataaaaggactaaaatactcataagagggtgttgtatatatgtagccaattaagggcaaagatgtaatttcccgttacttacgaataaaaggagctctccaaaggcaatagggggatctctcccccattccactctttctcatcctctctcatccacttatattctcctcacgagatctagcttgagctccctccctttggagggaggcccttgccatgcatgttggattttgcaacaacacccataatagatcggtgcacaaagagaaatacttgctaactcctatttgccaccaagtaactatacatgtgtatgcacaactagtagtggatattgcaagagaaggacttgaaggcactccttcttaggcctgcaggaggcgcacttgcaggcccgtcaaccagaataatggcgcagaaaactttttattgttgtttgaaacatttataagtaacgctctaattatttatttcaaatatgagcattttgccaacgtcaattatagcatgtgaagattttttttttcgggcgggaaaaggatgtgcagagtagttactgctattctagcacgacaagggatcaccggtggagaaaccctttgtagtcccggttcgtaatctccctttagtcccgatttccaaaccgggactaccaatccggaactaaagatcgctatctttagtcccgggtgaaataaccgggactaaagatcgatgtttagtcccggttggtaacaccaatcgggactaaagatggctcagccgtctcggttggtgttaccaaccgggactaaagatcgagctgacctcttttttcttgcatggccctgttgctgcatggtttatatatatataaaccgtgcatatatatgtttcagtacatatatgcttatataatatatgcatatatatatattatattatatttatatatgtttcaatacatatgtacaggcataatatatatgtatttatacatatatatgttatgcaaatgcatatgtatatatatatatatatgaccaaaatatatttacattatagaaaatatgtacacatgcatatagaaacatatatagtcatgtattaattacaatccattatatgtcctagctagctacgatttcgacgtagtagtagtcgctagctcagaagctaagaacctatgaattgtgtttctgtcgtagtagaattcacccttgggattaaggatttgttcattgatgaatcccatgggttgttcttgaaccgccgcgataaatttcttgtgtgtggtcaggttatccctcatgcgaataaactatatgaatgtatgaaattgattagtaattaaacaagaaatcgatatgtaatgaaattttgaatttatttgtacgtacatcgagctctcttgtgatgatgatttagtcttcaaggcagtggcaatactcgcacacgtaatagccgcacaagttagttcccttcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgctgcggaccaaatgacggaaccgataccaagccctacatgcagtttaaagctatgattcgtagtagcaattaacataacaagattttcttaattaacagaggaacttatgacggtacctgtctataagttcgaaaaccttgtcaaacgtagactcttttttatccattgagtcatatacgttgatggtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtctgaacgtcttgtaatgctgcgccttcaagagatggacgagattgtcctctgtggcttgcggatattggtcgagcattgcgacgtttactttccgagggtcgatgaatccagtatcgaaaaccccccgccgtcgggccctttgaatctccattctacaacgataaaagggagtatattattttctatagtctacttatatacaaggacctaattaattaaaggaggcgtagtaagaaatctaactgaacgatatacttacaaaatctagcaactcataatagagacgtcgagggcgtccagctggtatagttcatagattcccttgaaattgatccagagaatgtcatctccttgcaagaagtccgtgtccctgatcctcgctccgatcatctctctaccggtggcgctcatctccatgtacagctgatggaacttgtatatttgtgtgggtagggactgcagcagcttaggcttgacaagcggtttaccgagttcgtacatgtatttcacttccgccttttcgattggtgcgactcctagcaattgatccatagttagaccagtgtcagtaataaattcttctatcgtcatttttttaccgatcaccaacggctcgccctcctgggttggttgctctccaagctgagggactggtttggactttccagaagatgctttcttcagcgttcgctcatagtccgatagcttaatg

SEQ ID NO: 61920 - DNA, 16714 bp, Oryza sativa
ttcctgcagccctttggagaattaagtagatcagcatatcttagaagtgcagtccgtaaggtgcaaggagaagggaaaggtggggccaaagaaccaccccctttacgaggtgatccatcttctgcgtctgcatggacggagaaaaatgtatctggggaaagatctagcagcttttcagcctgctccactgtctcgatagcattttctgaataaacaccaacatggtcaccagtttcatacctgatacaaagttcttagaaatataagttgttatcaataaaatacaaattgaaggatcatcgttgagtcatttgacttcacacataaatgtcaaaactacacgagaagacataaaaaatgtcagttttaggataccaaagaacttacacaagaccagtgcctgagatatcgaactccagatgaatgcaagagcgatctgaagctggcttatggagttcctttcgaacagcaacattagacctgggcaataatcaaatgatgaactagaatgcatatactgtattctaactgaacagaaggaaggtgtagctaaatcattttcttgacatatgaatacctgacaggatggtgaatatcaataacaccactgccattggcaagtgaccacgatttgtcttggaacgatacatctgatttatcaataaatacaattctgtattcaggtatagcagcagtgtaaggagtggatgcaccagttgtatcatcttcatcacggagcagttggtccaattctggccaaacttgttctttcctacaagtattagaattgccaaaatgcttttagataaaataccagtatacttagaaagtaataacataatctagacatcactttgtcaataaaattcaggcaaggagcaataaattgttttaacagaacatttgccaaggaataatcatttttggtggggtttcaacctatagaccagaatccaagttgatattgttagtatcaatttaatttagtcgcaaaaacaggatagatttaagaacaataaaggggagtattaaagaatctaactacaacaaatctaacttgctttagtaaaatatatttctgttgtaaaggaaggctcaatatatccaaaactatgcaggtacatgtggaagcctaagctctgccccataaatagttcaaaaaatataccatgcacacttatttgtatcaatgtttctgtgtactgaagaaaaaaaaatggtgcatgtggtatatttgttgaactagatatggggtatatcttctacatccattttccagaaagcggaaacattccacattcaccaaaaagacaagttgttgtttcacatatgacaaaagaggtttttattcagtatccaaatccaggaccaatcaaagagaaaacttggagttcaagcctagattttgcggatatagaatcaggcaaatcagatatccaacccacttttgtccctacacgacagatatttacatagaaaagagaacacaaagatctccataccatgctgtgaagtcatcctcaatgcactgatcatcatctccaaggccaactgggacaagacgcttgccacctatatgcagcataaattagaataattacacccaataaaggatcaggctgcaggaatatatgtcaggaaatatcactttgttacgtaatgcacgacataagaaaagttcaacatgattttactacattcaggaatgactaactgatgaatatatcaggcagcaagctcaaaggtttacatcagaacaagatgtaaaacagagtaaaacctatgatggaagcataataaggaacaaatataaacatgtattggaatggtcatactatatgccaaaattaaattgctcacaagataactaaattccacaatagacttgttacaaaagttagtaaactaattagaaactgctacaatggaagtgtgccccatgcctgtgcaacaagttgtttcaatatagcaatgcactcgccctattttcccaacttttctccaaatgaagtgtagagcaaagagtacttaccctgctcctctagcagttcgtccaccacctttgcaacctatattttcaatataaataacccagcatcagttaccagaacactagtcaacctttaccaatttatactagcatttcatagtcaataaatttaaccttattaaagtgctcatactgcctatttcccaggccaaaaacagcatacttaagatccttaagccagacttccttttccttcccctgcttcaatgccaaaaattaataaggagatcataaaataatgtagttagaatatgtcaacgaaatggagtcaaaatgactttacacacctcagtgaaccatttgtagaatcttgcagcattgtcggtaggctccccatccccatatctacactcgatgaaacataattagctacagaagtcattgacacgtagcaagtgaatatagccacaagagatacagtatgtgcaactcatgtaaaggcaaagattgattgttgttcataaattctagaatgaaaggaaattcacccccaagctagttaagttctttcaagatgccattcaatggcattagttcataacaatccggacaagaataattgagctagctcccccacaaaaagcccacgtgttcaactctcacccacaaaaaacccacttgttcaactcttactcagatagcaatgaatccctctaccattaggctcattaggctgctatataattcatctgaattgcgatgtttgctaatggcatagctgattgacggcatagcgatgttccctatgttatagacttagggtagcttttgtaactatagaatctcaacaatttttgtatgacatacatgtcacttgagctttacaacaaaggtaggtgaattatgtaacccccgctagcgacaaaaggcacaattcagcaatcgaccaatcaaaatagcaaggggactcacgttgctaggaagagcaacacgatagtttccttcctgagcttctcctcgtactcctcatcctcagctgcatagtcatcctacatatgtcccacacatatctcagattcctaacaccaaagctcagacaggcgatctagcatacacatacacacaaacacatgcagatcaagatcatcacaattaccagatccacaactttgaacaccgccttctcgtaccgcgccctcgcctcctctgccatcgcctgcagcaaagcaatacaaaccgaatcgaatcgaatcgagtaagtacacgaagattaaaaaggcaaaatcgcgcaaaaaaaagaacaaaggaggggaacttttggatcggaggcggatcggatcgaacagcgaccttagcgaagccctcggcggtgccggtctgcgtgccgaagaagacggtgacgcgcttccggccgtcgtcggcgtcggcgtcggcctcgatcttgaccggcggcgggcgcggcggcggcgcggcggccttgggcggcgcccctccaccggatcggaaccacacggcgaggatgaccaccccggcgacgagcgccgcggccgtggcggcgagggcggcgagcgggtcgccccccgccgcggcggcgagctccggcggcagcacggacgccgcccacgacctcgccgcctccagcgccagcgccatcgccgcgccgcgcgcgagggaagcgagggtttggttggggaggaggcgcacctacccccaacaacaactgctgctgctgccgctgccgctcgctggcctacgctgctggagaggggaggaagacgagttgttgcgggggctaaaagtctcgcctttttctgctgttttttataaagtcgctgtcttttgcaacggaggaggcgagcggcgtgatcttgacgtgctttgcgcttgttgttgcctttctcgcctgattaaaaactttttttttttgccccagcagaagaggagaaagctgcctttgtctgaaccctgcactgggatctcttttcagcatctgctgccgtcctggatgatccatcttgtgatgcaaaaattgctagatgaaaagactttttcgtttttttaaaataattataagcctactaaagaaagttgaaaacatgccattaatatttttgctattgctttcaatttcgtaccaacttaaacaaatatttttttcctgcgatgtgacagctacaagagctttagtacagcgtctatttttttctccgttccgaatataagaggtttttatggaagtaagaaagtatgtagagctgtgatgctctatttgataaatggaagtaagaaagtatctggcgatgcttgacagttgttcgggctatctagcagatctcgataataagaagatgttcattttttttttcaaacgcgtaaaaggattgtacgtcgcatcgaatccaaacagcttatgcccaaggggggagggagaaaaagaaaaataaaataacccgagctaggaactactatgacggctaaaaacacaactccaaacacgtgggagggggtagagccacgctacactcccaagaaatccctaaaaacagcaacaccggctaaagaacacagctggccctctgagcggatggactccagaaccaccaggaccgaagcgagcgcagagtcgaaaaccctggagtttcgttccttctacagctgccaggagactaggagaaccaaggagtcgaaaccgatgcggaggtgctcaggtaaacaggccctggaggatgaccactaatcctggagccagctaccacgagggggagagagggcaactcagccaggaggggacatcacacggaattagacctgtcgagcgaacacgcagttaatgaggatgtgattcgtcgtctaaaaaaaaaagatgttcgcttgcttttatacagtgttttaaagaaataataatgatagtaggcatctatatttgcctcgtgctggctctaataagttcttatacaagttaaccaaccgaaccgatcaatcgaatggtgaggagcggatatgctatgacactagtggttgacaatgctgtatagtcaagaagtacaagttagcattgttgtgtccactctatatcacatactctcacctttgatcctgcttctagggcggtagttagattagagaaacgacgagaagagttgatgtgatggcagaatttaaggcgaggaagccaaccaaatggcatgcaaaacgaacatataaatagcaagtagtgccgtggaagcaccacttgagaattatgttatgtacttccatataagaaagaatggttatgtgtgctttgcatgtctcatcaagggagatactatgtgctgtggttacggatgggaccagtccgttattgattagtgatcacttgcattaggttatagtaacaaccaaacatagaaaaagaggagttgcaaagtttcaggtgtaaattatctgaaccgactgaataaaaaggttgtttgttccctacaagaaaactctaattctttagccagtacttgcatagagtggattatttttttgccagtcttatatatgagcaaaagagagaaccaaattaaactgccggttgtcattttcttcataacaggttaccaattggtttcactgtcactgtgtacatgatcttcagaaaacacctgagttctgaacagagtgcttgcaagttgcagttgtaaactattcatcgtactatcgtgtcaacgcgatatgtatatatatacggagagaagatactgcgagtttccaaagctagatatatcgccggcactgacaacacccagatctcaaggaagagtacgtacaaacgcgaagggaacttcaggtgcaggttgttctcaaaaaaaacttcaggtgcaggtgctgagaagctactgattactgaatacaagcccagccgcccatgtggaaagaggtgaaaactgaacagcttagcctcatttggcagcaatacgactgtgagaagatcttacgagaattgtatactcagataatcacatatctaggatatgaatgttcaacgttgactgccattggttaattgatccagaagtaattaattaatcagagatgcagagcctcgatggagaactctgaactcattcaagatgaatttgaggagaaaataatatatcagacaacatgccaaaacactcaatcggtttgcacgaagaatttatggaaggatgatcatatccggaaactgaatttgaggcaacaaattaaggcgaccatggtctgcatctaaatcagcaaaaacgactgattcatcctgttgcgttccaggctttcagagttgacaagtgagtgagtgacaaatatatctagatcggtgcaaggcagatgcgtacgcgcatcccccgctgtctttctcaattctcgtgcgtcatgactccaccgagttccaaccctgaacgtcactgacggccactgaacagtactgactcgttcgtatgccttgagtttctttttcctctctgtcccggctaatttggttacaccaacgacggtacacatgactgaccctgaatgtctgcatgagcatgaccctgactgatcctatacagtttctgtctaatctgcatatgttctttcctggcttagatatcggcatatcgctaggtgcatcagaattaccctgaagaagatctgataaaaaaggggatccatccatgccatgcatggacgagcttgcatgccgtcaatgtcacatccatctgcagtaaccactagtcctccaatgtcgccgatccatctgcctgtttttatcacgaaaattcagtaattaatggagaccaagtacatatccacgtactccttacgtacgcaggcagtaatagaacgctgttcatgacagttatgcttctggacacagcggccatcccaatctcagtctcatccattgctatcgtcaactcgatcgaccaaactgttcttgtgcatacgcgtgtaaatcgatccaatctccaaattaacagaagcagacgcttaattgaaatcgacttttatagcatagtacgtagctgatgctacactgatagattcgatatcatcgagatcgacgagtactgatcgagctggttaactgacggctacttgtaactgcatctctgtatatatgtacctgcatatctgcacgttcggacaaagcgtcggtgttcaagaagctatcgagagactgatcgatcgatcgagcagttgagaaacacaagcaatcagtgaacacaagccctcactttcaaagcaagaacacacaagtcaatcgcagacgatgactcacgagagagacggacacggcacacgacgtactccacgtacacgcacagttaagcatgtacagcgaacaagatgtgacacgagcagcgatttgattaactaacctgtaatgaatcgattaattaaccttactaatttgcagatcaattcaaccgtacgtgcacattaccggtcacgattaaaacgggattataataactaactgaattttcttaacgacgttacaaactgatgacaaaaacacaaactatttcgatttcgaaaggaggaatactggatctagtagtagctagaggtttatgtggtttagttacaagcgagcagattaagattgaggcctcatccggctagatggcttcgccgggatgatccgaatcctcctcgccacacggacgaaatccctgacatggatgtattgcaggagaatcagatcagatgaacagcacacagaaatgcgtcaagaataattcagacaaagcacgagatgaacacgaagtgagattaacaagatgagtgtgaagctaattacttccagttgaggtcgccggcgaggaggaggtcgttctcgatgtcctcgtacgcgacgacgtgccctggaacggcattggacaggtcgaggccgccacggtcggcgtcgctgcagctgctcctgccagctgcctcgtcggcggcgccgacgtcgtcgtccgcgtcgacgaacatgcggcggagcgcggcggcgaggctgcggtagccggtgtgcttgctgaggtggacgcggtggcagatggagcggccgtccaggacgacggtgaccggcggcaccacgcccgcggtcacgtcgtcgccctgctgcaccgacagcctcagcatcttcccgcggtgctgcttctgccgcctctcctgctcggacgtcgtcggcgccggtagccgccgcttcgtgtcctgctgctgctgctgctcaccgccggcgccgcttatcatgggacgatggcggccggcgcgattgatcgaagagctcgccggcgcggcgctcgtggcgtgtgggcggcgcggttggttgtgcgtgtgtgtgtgaagagaggcacagacgcacagtgagagggggtgggttaaataggatgaagtggagtgattggagcaccgttctgtggaaggttaattgtgtctttgccgtgtgaagcgtgtgaccgttttgtaggagaagatggagtcatagaggctagagtggagctcactatttgtatgttatccaattgattaaaatttagcttgtataacttagaaaaataaattaaactatggctaactaacgtatacttacattcaaatttattttttcagttgtaacttgtagaagttaaatttgatattagtgatttatcatatattaatctatcttattaaatttttttataattatttagatgacatgtaaataacgaggagatatccctcgaaagttaagtttagaatagttttcgtggagtgtggagctaaggtatggttgcaaattaacgagatcactgtactgcatttaatacaataccagtattcttttcagtttttctttttgtcgtaatgaacttggtttcaattcaaaattatatattgagaattgctagtaattaactagggacgacaataattcatttcaattgaagaaagacagtcatgggtgcgctacagtgctagtacgtgcacggtgtgtgttatatatatatatatatatatatatatatatatatatatatatataacacacacaaacacacaagtaaattgccagcagggacgaccggtgggacgtcgatcgggttgcttgcaagtgagtaaaggggtcgagcagtagtgcagtgccagcaaccaaccaaacccgagacaggaattaaacaaaactagccttcttgccattttctttccccctggggatcgatcgatcgggttagccgcccggggcgtgcgcgcgcgtccgcatgcagcggcgtccggagagaaacgaagaaaaaacgggagtctgctcgtgcaatcccggaggtcgtggtggggggcgcgcgcaccgcacgagaccaccgcggataccgtgtgccgatcgatggaccttcgtatacgtgcgactcgcgcagctggccgctgcaggtcgcgcgggggcttctcgcatgcgcatgcagcatctcgatcggcgccgcccgcgcggcgaccgatctagctagctcgcgtacgtacgtttctccggtctttgcacccgtcgtggtagctggaaaaacgggcggccgcgcggccggggagacgttggattggagctaagctacggagtactatgcgcggttgatttggtgcgagaaacatgtgagttacagttactgctgcctctatcgttgtggttggttgaattgtgctcttaccaggtctgtgttagagcaagttcaatagtatagtcaactactagttccaatttatttatagttaatctaatagctcatttatacaatagttacatactacactattaatatctggtcccacctatcatacacacactgcgctttggagtttgtgctacaactggctacaaatctgtagcccgctgctcttaattacatgaatattgcgtctgtagtaaattaaaggtcataaataatgtccgtgtggattaaattcgtgatcgcgcgcacgtacggtcgtgtgcgtgcagatcgatcgatctgggtgtgatacagtgtacacctacagcgcgtaagttaacgtcctacgtccatggccgtgtggctgccggccggccggccatcgatagcagcatgcatgcacagcacgtcgcaagacaacgtgtgcgcgcgcgctataagctacaggaccacaaggatcgacgaattaatgctagcttcggctgtacggaaccccctgtttcgatcgatctacctagccgcccgcaatggttatatatagattctctagaagatatccatgtcagcatatttttctatttgaaaaagattaaatgaagagaaagagagtaaagctatctactaacttggagatagtctatagagaaaaacgaggcaatagatgagagagctatagatacccatgtagacatactattgaggtggtttactattaatctagtatattgctgagatgtacatgttttatagagagcaccttactttaccattgcgggtgctcttagtgcaatcccaaccctccacctagaatgatatttatggcattaaatacattgtcacgtaggacttttaacttatgtggcactatattaattaagaaagagagtgaagaaaggaagaaactggatctcatgcaagacacagcttcaacacaagaacctatgcactagacactatcaagttttgcattgggagagaataatgtcttcataatagatgaagaataaatatgattggtagagaagagaggtgacgtatttattaatgtcccactttaagaaaccatgggttgtagagtgtagtttctattgtgatgtcttattgacatggcaccatagacactgcttatggacactatgggttgggactgcccttaggccctgtttagtccgccaaaaactttcgcaaaaacatcacatcgaatctttggacatatgtatggagtattaaatatagataaaaagagaaactaattgcacagtttacatgtaaatcgcgagatgaatcttttgagtataattagttcataattagccataagtgttacattaacccacatgtgctaatgacggcttaattaggctcaacagattcgtctcgcggtttccaggcgagttataaaattagtttttttattcgtgtccgaaaacccttccgatattcggtcaaacgtccgatgtgacacccaaatatttttatttcaccaactaaacaggccctcatgccccgtttagatcccaaatttttttcccaaaaacgtcacatcgaatctttggacacatacatggagcattaaatatagataaaaacaaaaactaattacacagtttgtatggaaatcgcaagacgaatcttttgagcctaattagttcatgattagccataagtgctacagtaacccacatgtactaatgacggattatctagactcaaaagatttgtctcgcggttccaggcaaattatgaaattaggttttttattcgtgtccaaaaacctcttccgatatccggtcaaacgtccgatgtgccatctaaaaatttcttttcacgaactaaacaagccttacaacgatgcacatgaacatatatagctagatctatgtgtatactctacgtacgtagtacaattcaattctctgatctatatttattacgacctgtttgtgcatgtatctttgtgctatttgttacgacggcaattgacaggtcatgtatgtgtacgtgcccgcgtgcatctatgaacgatctctctctgctatagctcgtactatatgctctacatagttggcagtttggcaccaaaaactaaacaacgtcgtccgacggtacgtagcacaataaaataacgcacgtaacgcgagtacttgtacgacatatagatgtgtgatgcatggtgtgcatgtccgataacaatgaggactgaacgcatatatatagcttggacatgctctcgatcgatcgtctcgagaaagtgggtacatcccttctttctatataaagttaagactaaaagctcaaacctcatgctttcacgtcatcatcaaattatgaaccgttggatgaatgcaatagatcgtttctcagacgttggatggaatgtagcatagagcccaacccattagtcaccgggtgagtctcttcgcctcctcagtgtcaaatgtagctcacataaacacattggcccatctccacacacatctacatgtatctagcccgtcaatccgtataaaagagctttgtggctgaacgccccttcagttgacatgtgctacctaatttatctataaattttgaatatgactgctaaaaagaatttctccaagaaagctattagtttcttcttgagattgtaccttctatttaacaaattgatgtaaaccaaatcccgtggcaaacgcgcggggcatcctctagtactgtcaagagtttcagagcctcaacatcgatcaataaatggaattgaaagggacaattaaaacaggcaagaaacggaagaatgaattgcatgccttaattttcttgtccatcgcatatgcatggtaatctcatgcatctattgcgactatgcgcaaaaatgtactgcatatgctctttcttttatacaattaaccaacacgaaagtgtccattttacgtacgcagctcggcaggcattgcatacatccgatccaaacgtacatgcactgatgcacgccggccgcatgctttcctaggctgatcgatgtgctctactatgcagcacgcacatggatggtgagctaccaaagctagctaaagttatttctagctctgtccctaagtcaccctgttcccgcactacacatgataccagcagtactcaacactgtttacttgggtcatggttaaaaaaactaatccatgcatcgaaccggtccatgcgcgcattgcgtacgtgcgtgggctagctgttgcagctattgcgctgctggacatttttaggcagcgaattcaagtgctagtactactagaagtacgcgtacactagttacccactatccggcaagtactagcccgatcaaatttaagtcgaacaagacgaatgttctggcctgcatgcagcagtgcagtagtaggcagtagccaactggcaaaatgtgcgtacgctggcttcttcaattcggttcatccgcccgtccgccgcccaatcgccgatgcgtgtacgtgcgacgaggcggacgcgcgcgcgcacgcacgcacgcccgcccgaccggcgccgtcgcgcgtggctgggcgcgcggtgcattgcgtttgcgtcggtgtgtcgcgcgcgtgcatgcggtgctcgggatcggttgcgtcttgcgtggttgcctcgcaatgtcatcgagagcttcgatgcaagcgtggtttcttttctgaattccatgcacgcgatggtcgcactgctgcgcttgttgccacggctgttcgcctcagttgtaaaaagggagaaaaaaagggactatccgaaaaaccactacaagttttttaaggaagaactttcaactctaactacagtataattgtaatataattccactatagctaattataactataatactatctccgttttatattataagactttttacctttgtctacatttatatagatattaatgaatttagatataatatttatgtctagatatattaacatccctgtgaatgtgtgcaatgctagaaagtcttataatatgaaacaaatgaagtataagttatatataagtattaaaataatactacctccgttttttaatagatgatgctgttgactttttctcacatgtttgactattcgtcttattcaaaaattttatgcaaatgtataagatataaatcacacttaaagtactatgagtgataaaagaactcataacaaaataaattataattacgtaaactttttgaataagacgaatggtcaaacatgtgagaaaaagtcaacggcgtcatctattaaaaaatggagggagtatatgtacagtgcggttacactgtagttacaatgtaactacttcctccatttcataatgtaagtctttttagcattatccacattcatatagatgttaatgaatatagacatatattatgtgagcaatgctaaaaagagttttacattatgagtatagtataattatacaactatactatactatagttacttttgaaagtttttttcctaaaaaacttgcgagaaaaaaaagcaaccaggaaaaaaatatgactaaaatttttgtctatatgttattagtgctttaaaagttaaaaggctagaaaataggctacgataaaagaaaaatcctagagcaactaagtttcataattcagttacaggcttacagctttaatctaaaataatgtttcagaattcagttatggctgacaagccaacaagcagatgatatgagcctgcgcattggcaactgcccaggtcggttatttagatctaaggtatcttctgcatttgctagttcaatagatttcccattggcacaggatagcagcacaagtgcacaacacggcaattaagccccaaaaatgacagcaaccaaagcagaacaggagagaacgggccagggccacattaactgaattaattgaatgcaactatgcaaggagactttttacatgggcgacattgcattgcatttccttgtttctgtaatctgtatacattacaaccacccctcctcctagatgcccttcagatcttttgactattgcaacgtgcaataattgctgctgcagatcatggacaaactaaccgacaccacgtgattttcccggccgtgtcaacattctgccagctcctgccagcaggctgagctctgctacggaggagcaactcaccagaattaagattagtaaaggcttcaagggtatttggtacaataattacagtgtccgtggcatcaatcatcgcctgcaaaaaaattgggagtcaacacttaagatcacagcgtatatctgctcatatgccttccagagatcaaccatctaatatagccattggttgatttcaactacatgccaaatgctactactagtactatcaaaccatggcaagaacaatttcttacatatgaccaccacaaaacatgcatggagtaagctgtcaatgtcggagttcttctcttttcatgaaattaatgaagtttgattgtgacattgaaatgaagaaaaagtagtctgtaactctacttactggattgtggatcaacgtgaacgaagaaactggcggcaactattagataacacaagatcagcataagtcctttcaagtagttcgcaacaccatcctgtggaaacatagaaagagcgtgtgatcaactggtgatggttgagatatcagaacctatgccaggtaattcataagagagctatagcagatagtgtgaaaatgaaataacaagaaagcctgatcagcatattactattgaaggtttactgggctaatattacaagcgaggtgggacaagataattaaagccactactgaaggtaaaaagtattacataaagtaggtcagttctagttcctttaaagagtaagcatttgttcattggataatatgaacattacaacactaaccaatagcaaccaccgaccattatgcttgagaaagacttgactgtatacttaataatgttaaaacaatcgtttagtaccgctactccgctagaacatgtttactctggaggggttatatgtgccaaggcatacaaaaacaaacacagcttgacaaactcttcattaagcaggcatcccttatcaaaataattcttaatatttcacacaataacctacctgtagcataaatgccacgactagtactgttatgaagagcgttgctgtttcgaatagttggaaattcaagtccatcttttgccccatcatccaaccaatgacaacacaaaatggaatctgtatatggagaataacatatgtaaaaaataacaaagatgaaaataggatatgataaatgaacaaatgcaagatctggaatgaacacagtattctgtagaacgttcatgccagcatggtatttgatgaacaagtgcggaaatgcatactcagatcatagtgagataacaagtttgaccatgcattaccacaaacattgatatctgcgttgatgacccaattgcaacacccagtgttatgtcctgcagcagagaaacaatcatgtacacagacagttaggagacaacagaagaatcagaaagaaacatcaaaactgagcacatctaaatgcttacaagtttatctttcatggcaaacattattgcactagcatgttcagcagcgtttcccacaataggaagcaaaataacactgataaaagccacgggtaggttcagtgaatcagatgccccctgatagcaaatagcaaagagcaaagcagtgatcaatagtatacccatgcagaggtactcaggtgacctgtaagacaaacaatgtataacatggccagagcagttaaatctgtcctaaaatacagtattagagatgcaatattcatggactttcatcagaaagaggtaaacatctcttatcatatatcaaataatcatttccaaatttaaggtggacattttccctgatatgagtaacccaatataaacaaaatagagttaattgtcaagtttaacaggccaaaaaaaatcatttgtcagttgcacatattaagaacagctactttttttttgtgctgtcattctaaattagaagagaaggaatacctcaatggcattaaccaggtattcagaaagaatagacacccat

SEQ ID NO: 61921 - DNA, 716 bp, Oryza sativa
cgccgccgacctcacaactccggccatgatcgattgatgatgatgagctatatatcagcaatgtaaactttggagagagtatatatatatatatatatatatatatatgtagctagcttaattagcttgcttaatatggcgtatatttataggcatagctagagagatggattgatcgatgcatgggtcaatttaatatgtcggtgttgcatgtgatcgatcattgatatgcgtgatacacgagcgagtatataaacgcattatgcatgcagcatgtgttttgctctcagtggtccggttgctgatcgaatcaaactggcccatgcgcgtatgcatgctgccaaattagtcgtcattgattgtacatatatttcccatttcacgtgaagcacatacccggccgtacgtaactttttctgtttgggataacattatttatccatccctagcacacatccagaatgagaaattatttaatggaggggatcatcccccaaactattgctcctctccctctagcttgttcctcctcccatctttccttgtatcaatgacgattcagcaaggcagaaaagctctattcgctagcacccattgtcgcatccgtccctttatttagctagctatcctaccacgatcaagatgctcactagaacatggcgtgatttttttatatgtttgttgggtggtatccagcaagttgctgcgggtagggg

SEQ ID NO: 61922 - DNA, 2821 bp, Oryza sativa
tccgatagcttaatggcctccttggcaggtgcagacatacccttgaagaagttcatgacactcgaatctataggaatcttcttttctggacttcgaggcttgaattgtctcttgatttctgatgccacgtaagcgtcaagctcctcttgcgtgcaatcgtaccccaggtccttgttcttggcagcgtcaattttcgccttcttcgttgcccttctgtgggcaggcggtggagcttggggggcccttgactttgaaggtgccagaagaggagcttgcggaggagtcggtgtaggagaccgaggaggagtcggtgcaggagcctgaggagcagtcggtgcaggagcctgaggtggagacggtgctggagcatgaggaggagacagtgcaggatcctgaggaggagatggcggagccggaggagatggtgcacgagacgccgcttgtcgcccagggaggatgatgtactgcctgtgccatagaataatggcatggcttgtgtctcgtagatgcgtctcaccgtctcctccagggtaatctagctcgaggtcctcgtacgcgccttcgaccaactcaacttcgaccttggagtatcctgctggaatcggcctgcagtggtaagtacctgaagggtccgttgggatggccatgcccgatgccaccttcatgtggtgagaggttatttattagtaatcaacatatataagcagcaactagcggaatgggcaaatctaaaatatataaactacgagcttacctttattgataagttcttgaaaggaatatgcagctcacatggtgtccgctgagtgatgtcatcaacggggcaggtggattcgtcctgggtttgcatggcgtccatgctcagtgatcctacttgccccgttgaggcgcagttgctacggtttcctgacgggctcaccattgcaggaggaatggtcggctggggataattggactgatgtgcggccatgcgttcatcaaccttccttgccacctcctcttgcatgctgagctcatagctcgataccctgaactcaagatctgcaatcttcgcctcggtatctctcttgctcctcttccgactcctgtacgtgtggatgtcctccttgaacccaatcttccaaggaatcacctctttccctcgtgttcgtcctggatgctctggagtctgcagggcgagtgacagctcgtccctctctctgtccggtcggaacgtgccctgagaagaggcttccactgcgtctgttagtcgacgcgcagcctctcgtatctgatcgccgaagactagtgagccatcagctgggttgagcgtttcaccgtgagcatagtaccagaacttcgatcgttctggccaattagcggtggctggttcgatacccctctcaagcaagctagcctccatctcctcccacttcggcatcgcgacactatagccgcctgaccccaagtggtgatggtacttcttcttggcggcattttctttgtttcttttcatcatcgcctgcccttgttcacctatcttatatgcaacgaactcgtcccagtgatcccttagctttgggaatgtgtcgaagttcggtgtctgccccttcaggatatatttcttgtacagctctcccttgaagctctgaaactgttctgccattttctttagagtccaccttttcactttgtcctctgtacccgtgggaagggtgaatgtctcgagcattgtggtccacagcatctctttctccgaatttgggacaaagctctcatgatctccgcgtgcccttgttcttcgccagtacaccgtactgacaggcacgttataccgcacaacccaaccgctgtgacgtacatagttcttggcggcttctaccgaggcactaggtcgttcatcttcttccacttccgttatgatgtgccgaccctcaagcttcttcgcggcacctcgttgcctgcgtgccctcttctatccaacggagggttgacttccactagcctcctcctcctggttcccctccacatccctttccacgtgcccctcctggttcccctccgcatccctctccacgttcccttcctcgttcaaatactggtttggatcctcgttcccctcttctttgttccagtactggctgcttccctctgcgattgtatcgtacaatatctgttcctcatcgcgatcagccatctgttcatacaggaaacatctgctaagtcatgagacatttatgttttaacaatcttatattaaaactcaaataatcttatatgctaagactaaacgaacagtcatgtatgctaagtgtaactgtcgtatattagaaccgtacacaatcttagaagctaagtctaattacaaatctaataatcttatactaaaactcaaatagtgatgatatatgctaagactaggtgacgtatattataggaccctagctagtcaataattatatactaagtctaattacaaatataataatcttatattaaaactcaaataatcttatatgctaagacaaaaatagccatatatgctaagtgtaactgtcgtatattagaaccctacacaatcttagaagctaagtctaattacaaatctaataatcttatactaaaactcaaatagtgatgatatgtgctaagactaggtgacgtatattataggaccctagctagtcaataattatatactaagtctaattacaaatataataatcttatattaaaactctaataatattatatgctaagacaaaaatagccatgtatgctaagtgtaactgtcgtatattagaaccctacacaatcttacatgctaagtctaattacaaat

SEQ ID NO: 61923 - DNA, 24982 bp, Oryza sativa
tgaaaacacttcagtttcagctgaaggacaacttgagagagcaatgggatgggcttgtgctggtccaaatacttctggagcaggcagttcaaccacaaaggcttcaggaatcccatctgaatttcatgatcatctgttaaaaaggaggaaattgctttgggtcatccaagaacaggcatctgatcttgctaacatctgcacatctgttttggagtttgaaggatcgagagacggaatttaccttattcctgaggataaatcttccggacaatctactgacagaggcaggacatggcagcaaactttcttgaatctcctgacacgtctagatgcagcatatcgttctttcacatgtaagtgactactttttcgcacttctattgtatgtatgtttagatcaaggacccccaaacttgttcttgtgtcaaaactgcccaagatagcttgccaccatgagatgcaggcatatacaggcttcaatgaatcatcctactgcttttcttttttcggttactgttttcagtgttattctgtataagacatcagtaaatgagtgtaggccaccaaagtattgacagaatttggatgccgtgcacctgtcttagttcatcctgctttatgatacgattttctcgtgttattgtaacagttttatttctgcttgctgcaagcaggtgcagaacaagagtggaaactcagtcagttcaacatggaaagtgctgggaaaagcttgtattcagtaaccaatcagctctctgtagtctcttcgagagcaaaatctgctttaggtctgccatctactcatgactttgttgctttgtgtttcttttggttaaataaatattctttttgttcctcatagagtgttctgtctatattttcccagttaatctacaggatactcttgtgtccatgtatgaacgagcttctgaagtcactgcatcattatctgggttcaaacatgtttcacaggatcgcactgctttgacttctgaatgtggttcgttactagaggaggtacgtgattattaaatataacctttccacgcacaaaaatcttgttggaatctactgtgagtgcataggagttgctacttatgaagtcagccgtttgttttcagctgtgcaactttgtaaatgattgtgaacactttggtggttagactttagtttacgagctatatataatttagctattttacacataaatctgggaaattagatattttatctctggttttgtcaatttatgcacttatgtccctttttagttgttcatggtgatcaaatccaaatttttatctgtagttgttgatttctgggaattctttttgcaggttttggcaatagcagaggggttgcatgatgtatatatcgtgggaaaggaagctgctgttatgcacaattcaattatgtccaatctttcaaaggtttttttcactgttacgctttgttctattgcatttcctttcctagatcaatatgaacacttggtcccgcaatttgaatatttggtcctggatactcagtggcagcattggacctgcaccttttatgtgcatatgctgttcagacttccactgagaatcccattgtaatattaaggctggtatattgatatgtgttacttgtacattcccagatggccagaactgaggaatgcttgacaccattagtgtattcggattactagaaattgtttttttttcttctgaggaaaaacttttcttttgatgtttgacaggcaaacacaattttacttccactcgaagcctcattgtctgctgatttagctgttatgtctgaagcaatctcaaaggaaagagagaagaataataccagcatgcctcttattcatggaaaggcattataccaatcttacattattagaatacgggatgcttacaaaaatttagaacctctggtgcccccacttgctgacgatgcgaaggagttgcactccttgatgactaagcttggacgcctttctagtattcatgcagggagccttcataaggtacttaactaagacccagttactctgagttgccgttaattatttagagaaatcttttttaattatttgcatttcaatagcaatactccctccattccataatataaggcacaaccactttttttagatgttccgtaatataaggcatgcatgcatatagaccattaactatgacctcttctccattaaattattacttttttaaatcctccactctcatgttctctaattctattggatgtatgtattgtatttattaggatgatccaaactacaagatgataataattattttcttggtctttgggttaggggtgtgtcggtgacatgggaccgggagtattatgacttagagacttgaggcagacacgatcacccacgtggcctaaccccctcgggggggggggggggggcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgaagtgcagcgcgctcgtttatccggtctgtgatcagtcacagaccggtcagatcatgggttaggtggcgacaggcggtctgacgcacgcctcgccccatcccgtcaggacaagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacgacagccatacaaatctccgtccattaatgaagagaagggaagtaagaaagagagggagagatggtgcatgtggtatccccttgagatataaaaggaggaccttgcccacttagagaaggaggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagtgatcttctgagctctcgcactctttcgtgtgcgccaagctttttctgttcagcccaatggccgaacaagcaaaggcgcacaacctctctccgagcgttagcggtgacgatggggagccaaacccacgccgtcgagctcgtactccaccgccccctccacgccaaagtcctaggcgggaggaggcgctcgagagggtcgaaggatctgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcttccgccaccaagacctctggcgctgctaccaccggctccgtgtcgtcaaggcggagggcgcggcgagcggcggctgttgctcgccattcggccaccactccttcgtcagcgcctccgacccaggaagatctgcgtggggggccggatgcccgcatcgatatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgatgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacctgcatgcagtccagcgaagggatgatgagtcacttcgctcatacattcagcggttctgtcaagtccgcaacaccataccatgcatccctgcacacgcggtgatttacgcgttcagggggggggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaaggaggccgacgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccctggcggttccttccggcaatcggcgaagtgaggccaagcagaaggcccccgccgaggacattgatgacggcgatgatgacctaggtttccaagagcctggggccaccattgccactgtcgatgggggagcgtgtgctcacgtttctcgcaggagcctcaaggccatgaagcgagagcttctggccgcggcccctactcatgaggcgacacgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcgttgatggaggagcagccctcaacatcctttcccccgcagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcttggggaggcccgcgttggtgaagttcatggcggcggtccactacgcctacctccagatgaagatgccgggccccggtggccccatctctgtacatggcgacctcaaagtcgcgcttgcttgtatggagcagtgcgcggaccacctcgccgccgcgtccaagcccgagggtggcgacgagaggcttggcacatccgcccccgccgccccgaggcagcggatagtcacatgcgacgaggtcctggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgacttcaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactaaaccccgataagtgcgtgttcggtgtacctgcgggcaagcttctcgggtttttggtctctgcccgaggcatcgaggccaaccccgagaagatacaagctatagagcggatgcgcccccccagcaagcttagggatgtgcaatgcgtcactggttgcatggccgccctaagtcggttcatatcgaggctgggagagaaggcgctacccttatttaagctcctcaaacgctccgggccgtttacttggacggaggaagctgaacgtaccctcactcagttgaaggcgtatctcagctctcccccagttctggtcgccccggagccaaatgaacccttgctactctatttagcggcgaccccgcaagtggttagtgcggcattggttgtggagcgcgatgaggacaatcctcattccgcgcacccccaccctgtgctggcttggcccgggagagagcagggaggagaggcccccgagccgaacggtggcctaaggcccccgacgaccggagcaggccctctgcccgcttgtcagacggtgccaggtgtccccgacccccaggatggcccgagggccactgcgggaaggccgcacctatcgccctctgaccccgaggctaaccctgtgccggttcggccggggagagagcagggagaagaggcccccgagccgaacggtggcctaaggcccctgacgaccggagttggccctttgcccgcttgtccaacgacgccaggagcccccgacccccaggacggccccgaggccactgtgggaaggccgcccctgtcgtcctccgaccccgaggtcgtcggcacagaagacaagtacgccccgcgaggccgcttggatgaagagtgccccagggacgtggcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttacggtggttacgtcttaccccctcggccaaatcttgcataatcgagagggtactggacgggtggtgaaatgggcaatcgaactttctgagttcgatttacactttcaaccatgccacgctatcaagagccaggccctcgccgactttgtggcagagtggaccccggctcccgagcccgtctcagtccccgaagccagctcgggcccctcgcagctgcctcacaccgcccactgggtgatgcagttcgacggttccctgtctcttcagggcgccggtgcgggggtcacgttgacctcgccgagcggagacgtcctcagatatttggttcgccttgactttcgggcgaccaataatatggcagagtacgagggactccttgtgggactcagggtggcagctggactggggatccgccgcctcctggtgttaggcgactcccagctggtcgttaaccaagtctgtaaaggagtaccggtgctttgacccgcagatggacgcttacgtgcgccaagtacggcgtatggagcgtcattttgacgggatagagcttcggcacgtgcccagacgggataacacggttgccgacgaactcacggctcgcttcctcgcgagcccagaccccaccgggcgcctttgaagaaaggcttgcccagccgtcggcgcgacccgaccccttaggggagacgggcgcgcatgacaggcccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatcaaggcaaatgcggatcccactccgcctcacgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatatcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcacctcacctgcccaccccagaagcaacggccaagtggagcgcgccaatgcggaaatcctcagaggccttaaaaccaagaccttcaacatcctcaagaagaacgacgattcgtggatcgaggagttgccagcggtgctctgggcgaaccgaaccacgccaagccgagcaaccggggaaacgcctttcttcctcgtctacggcgcggaagtggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgtatattcttatttctcttatatctgtatttcaataaaagtattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagaccatcctcgtctcatacacaacaaatagaattgacacaaaaaatttttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgacgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgctccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctgcgcgccctcgcgtccagctccttctcccgcgcctcgagctcagcggcccgctggttcagcgcggccctctcggcgcgggcaccttccagattacagcgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcggcacaggcggcttcgtgcaccgctagtgtgacctcccgaatagcaacggcggcctcgcgatccgccaggtccctctccacggcgcaggcacactcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacagtggtggcgatgagggcagccccccgctcctcctccacctccttggcgatctcccccagcaccttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgtttgcgacggccaaggcctgcagaaggggttctgcgctcagtggaccagcggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgcgagctgcttcggaagtcgtcatcgcctcggcctggcgaagtctagcctcctcccgagcggcttcctcggtctggcgagcccgggcggcctcccgagcggcctcctcggcttcccgaaggtgatccgcggcttctcgctggtcagattcccgcctccgggcctctgcggtcgccgggtcctcggcctcggactggccggacttggaatggcgggagggacgcgacgggatctcgctgaaacagaagaaagatcagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggggccatttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccctgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgactccctggtgggtcctcatacagtcctcggacccggtgtactcccaggcgccccgggcgcgccgctggagtggcgcgatccggcgacgaagatagtcaccgaacaccatggcccctgtgagcccttgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacaccggctgtgcggtgaagaaccaccggaacagccgaagggatgggcgcaccccgatgaacatctcgcacaggtgcgcgaagatggccaatgtcattaccgcgttgggggtgaggtgcgccatctggagattgtaaaactccagaacatccatgaagaaagaagaaaatggcggaaccagccctgccatagcaaaagggaggaagaagacggaccgccccgagtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcaaaggtagggcacaggaaacaaggagttagggcacaagcggcgaagacaaggggaataatggcgagaggaaggaagcaaatctcttcctcggcgactttatacccttgccaacgctaagcccggctcctcgtttcttgcgcccactatctgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggcaaaacgaaccagctcgtcccgattcgcgtgttactcgagtaatgtggcagtcttgaagagactgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtattatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgaagtgcagcgcgctcgtttatccggtctgtgatcagtcacagaccggtcagatcatgggttaggtggcgacaggcggtctgacgcacgcctcgccccatcccgtcaggacaagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagggaagtaagaaagagagggagagatggtgcatgtggtatccccttgagatataaaaggaggaccttgcccacttagagaaggaggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggctgcgcggtctcccggtgaggagccccacgctccgtcagggtggttatgccttatattttggaatggagggagtaatatattttcagatgcttgatctgatttgagtattttagtcaattttcacatttctttgtgacaacagcaattaactttgtggatttacggagcttccttgcttggggacagagccttgaggatatgggtcatagtaccctttgaaatccttaccactttctggaatacatgtccacctgtaggatatttaatttggaaaagattgaaatttttataatactctaaacgaaataataacgataatttcgatgtaaaatatgattcaaataattcaaagatatattgattatcagattgaactgcatgatacttgagaatttcgtcaactcaagattcaaacactgttgctttttcttggctatgctgaactgctgcagaatcaaccatggaatgaattttatgtttttctattccctccatcccaaaatatgattttcgcggggattaaggtgagggatgacagtaaatgggggatggttgtgattggttgagatgaggaagtagctggagaaattaaatgagagatgattgtgatcggttaaatgagggagtatgtagagaagttgctatattctgagacaaaatttgaacgatacaaggtgctatattttgggacagagggagtacttgattctttgtttaggattaaaattccaatttaacaaaatgtctccagaagttcattcatcttctcttttccgcaggctctagaagttcttggtgaaagtgaaactgtgaagtcacaggatatgccttcaacacatgcagatattttgcagagtgattcatcaattgagaaggataaaggttcttctgggagcagggaaggtggatctcaggatttagtaacgaccactgatctttctttacaagatgaatgctggatttctcctcccgaacactcatatacaagcagttctggatataccacagagttaacccagattacttcttctgagaacatagagaatatggatcccttattggttgacaggcctgtgatagaagctcctggtgctaatgatcaggaaagaggggctgattcggaatcagattcaagtagcaataagcagttgttcataaacaatgttacattgacgaatgttaatagtgttgatgaggttgaaatctcattgtcaaaggagaggaaatctgaaaatgagaatacaaatttgccattcaaacagattagaggacaagaatgtgataacagtgatcctaaatcctatccagattctgtgactcgattgacaagaggtaaaatgaacaatagtaggtagttagatatatggtgctagatgttgctatttatttttctaaattattttgtacttcatagtaggctgccgtaaaacttcctttaagtaatatatcatgtttcaaacacttcctttgagatttacagcattgccgttttgatctaattgtgtctgtcagcaccatgttaacaccgtacagattatcctccaagaagggagaattgcatatactgcagaacttgattatcaatcttttttgcctagtatgtaatctaagtatctattagattttcatgagaagatcaatgcaagaaattaatttaatgtttcacactaaaatcttcacaaattgaaactgaatattgtaatcattttaagactatgttttcatagtgctttgtctctgaacctctcgtgaagtgttaggattccgaagccaagacaaactttgtagctaatgctcgcttgttctttttgatggccacaggtaaaaatccttttgctttgtccatactgaagcaagtggagcataagttacatggatgggatatagatggcaccaggtgggcaattaagcatcttagtaatcacccaaaaatgtcctcgtgttctccagtttattgatctactgttccttctaggtccttgaaggtttctgagcaagttgaccatcttctcaagcaagcgacaagcattgacaatttgtgcaatatgtatgaggggtggacaccttggatatgattcaaagatacatgtgaacatgtctttctacgatttgttttttccaggtatcaactgaaaatataagatccccctataggtttgtttagtaccttgtgatagaaggggttgtccaaacagtaattaattttcagatggaacatattgctgtggtcatcattatttggcatttcttaaaacctagataagtcagtgccagctaactggccaaaaagaatgtcatttaaaagggaactgcttaactgccagtatattagcatattcaactacattcatttacaaaaattatgtaccagactaacggttcatacttgtagaagagtgaaacacgctggaggtccctaaacatgtgccattgtcttacttaggtcactatacttttggtatgatgttagccttttcatactccatagtatattaccgtcatgaattcagatcaatgatttagttagtcaaaacaagagagaaaagaattccaacagcttctcattgtttgcagggcaagctgaagttgagatctgaatgggcataagttattacaatatccaccttttatttgcctagttaagtgtataatacctttcctctgagttgatatctccaattcctacgttagttcagtgacaattttaacacatgtataactttctgtcagtatactagtcaactttctgccaaccattttcctggatcactgtcaatagtctggtacgtctccccacgtttatacatattactgctttccctgctttgggacttttttttttaattcgacattattgattttaagtttttgtgatataactttgatcgctacttttatatacttataacaatactctctcttttacttgacattttgacttctcgtagtcaccactcaccaatatacagctgtaatcattctcttttgcaatttttaatttttaatgtatatatttcatacatctattctgtacattttttgctatcttgatgatcaacatttggaaagtttgatggcatgtattctattctaggtgacaagtaaaaaggaacagatggagtaagtacttttagaaaaatctagtagagtagtttccatattatccaatatgggtattatagtttccattaataccacctccatttttaaacatatgacactgttggcttttggacatacgaccatccatcttatcaaaaggatatgtatcacttatttttttgtgacttgtttttatcattaaagatactttaagcatgactacatttttgcataaaattttttaataagacaaatggtcaaatgtatgtccaaaaatcaatagcttcgtatatttaaaaatggagagtattaatggtcaagtttttactacatggacatgaaattttaaaaaaaaaggaaggaaatgctcattttgtttgtttttttacacgtgcatatgtggatacatgcactatcaccaacgtaatgatgcacgtttaaattcaaatcttctgttcattatcatgtcgtgcacaaatcatgaagcacgttggactgataggatagtgcatatgcagagattcatttctctttcacataactataaccttctgttaatacaaatcagtttattccttttaatattttcgttttttttttgttgcaagctttaatgaccatttgtcgatcttcattttctaacgtacttagaagtaacagtaaagcataagtgatttacccaaaaaatttctgtttcatttccagagtttggacaagacaatccatagtgaaaacaagattgccacagcacgtcgagcaaaagcaggcttactgccacaaagaggtttggtttgcacctgctctttactttttcttcaaaacaaggctgaggctagctgtttaaacatttcaaataagagtgttcatatttggtctagctttacagggtcaccattcactccatatcctagcagcaagatatgaactgttaagtatgggtagctatggatggatccagacacagcaaggatctgaagtactttcagcgttttcatgtacaatgttctcagctatacagcaatgtattgcagaattcaggcatcgatattttgggatatggactggttttagcaatggtatgaacaaaaataccctagctaagagtttgcagttcacgtggacagccatggctttgcactcccagtggactgaagacttcatgatctttaacagtaagccgtcttaagaacatgaagagttttagcaagcacgttttaaaagcacaaccaagaaatctggttcgagtatagtgtacataatattttgcatgtacttgtgattttagaagattcctaccatgaccatgttgcattgatgtaaagataggtgttcgacatgcaattctggaagtgggattctaattctaaagtgggcaagtatcacagtatttttttcctctatgcacacctcaaatatagctatattttcgcgtgaaaaagggtctggcgatattcaaaagcaaaattggaaatttatagcttgtagaatacatgaactcttgctttctttccttgtgttttattcagatacagattggtctgaaatcttcaagtatatatatagccttacagcgtgacacgttgatgatgtgccccgtgctgttaacattgtaattttttttataaaaaagaaaatcttatcatcgttcataattcctcccgttttattgctattatttgagatggagattgatcactttatctgaactcgagtacgaactggtgggcagtgtttgtgctgttgctgactagtggtcatggaaaagatagggctcgggtggcctctgtgcacgctggcagggcagcaataccctggccgcgtcctctccataaaacattcagataaactcaactcctttttccccagctgttattttcaccatgtttaatttttacctttgcattttgtatggcccaagaggccaagaagcctgtgccttaggtaaatctccagtaaatgtagcgtagtttttttaatagacaaaaatgcaccttctcatgtggataatatatttttgacccccaaaaattgtaccaatgagcatacttttattcctgttatttctttaattttcttgggagaaatgtgagatgtcgctttcggagattaggtgattttttttatatacacttgctcccagtgttaggtgatggatgacaaagcgtttgtgacttgtgatctgtaagttgagtggtcaagccgctgtttcctttgcgatttggtaccctgcgtcctgattagtggtagctaatcgcagcaattatataagcaaaccatatctctaagcgcacaggatcattgtttggttcgatacattttctccagtgaagaatcttgcctgcttttgggttggtggcgatcttgaaagctaacacgcacgtaaaataaactatgctaaatggcagggcacccggttaattatttcttttcctgcctctgggaccaacatccccggatactttcagccatttgatctagtgtcattagatatgggaatataatctcgttatgcgaattttctcccttattttgctgaaacctattttgcttaaattgcaccacccattgcaatttacacaattaaaatcaagatattctttttatccgaatgtaaccgcatccataaaaaaaaaaggtactctgctatccaaaagaaaacgttgtgttgcaaaagaatagaaaaaacagaagcagaaaaaaaaacataaaaataagtaatgctagtggcaaataagaagaacgcgaaaacaaacgaccaatttacatgtctaaaatctcaaaaaaaaattggttaaagattttttaaaaaataaaccaagggttggaattttttttctttttatttaaaaaaagaagaaaataaaaataaaaggaaaaggaaaagattaagcagaggttggtgatgctgatgcgtccggtgtggtgggtgctggggctgatcactgcagataaaaacgccacgcgaatccactacctcccaaaccccgagacccccccgcctccaccaccacccgccgctcgccgctcgcccaccatggccatggcgacggcgctccgcaagctctcctccgacgccctccgccgccagccgctctcccgcatcaccccgctctactacatggttccgctcttcttcctccattttttctttaatttttttttgtttatatcgttgccctcttgagaaatggtgcttaatccgttccatggattggtttgggttcgtgcgctctcgcaggcgtccctgccggcgacggaggagagatccggagtcaccgtacgtgctctctctctctctctctctcttgactatgtgttccgttgctcgttggtgtctgtggtttgttcattcgttttttttttattattattttgtttgtgtgttggatgcagtggccgaagcagctgaacgcgccgctggaggaggtggatcccgagatcgccgacatcatcgagcacgagaaggcccgccaatggaaggtaaccagcaaccaccaaaaaaaaagtgcgtggattgttcagtgtttggtccaccgacgcattgctgaattgtggcaatctgtttggtgcagggtctggagctcatcccgtcggagaacttcacctcggtgtcagtgatgcaggcggtgggatccgtcatgaccaacaagtacagcgaggggtaccccggcgcgagatactacggtggaaacgagtacggttgattgcgttctatcggttgcctttgttcagattatttgggtgttaaaaatgtttaatctgaaagagaaatcagtgcctgatgggagtgaatgatgtgaatttctggtggctctgggttttccttgcgtgcagatacattgatatggccgagtcattgtgccagaaacgtgctttggaggccttccgcttggacccagcgaaatggggaggtaaatcattttcactctttatcttgccttgtcatgtttttatatgaactccagctttcatgcgcatcaatagcctttagtcctcttttgtttcctgctttgggcgatgtaaatgaaaaaaaaaaaggataggggcaaaaaggttcctttggataagacacagtttttatggttccatagttcacaaaaaaaaaaaaagggattttgatcagaaaatttcttctaggttcttaatttacttagcttcctcactagtacaatgaaaagattacatcgtttataaaccactcggttcttcagtaacctgaatacaaatggtacacgagtggtcctattcatttatatttttcgaattgtttgctttcattattaaccgctttgtacttaaatttatctagaatacttattctcaaaattttagttttctttctccaaaaaggtggcattctaacttgacaaccaatttctacctctgcagtgaatgtgcaacctctatcagggtcacctgccaacttccatgtttacactgccctattgaaaccacatgagagaatcatggctttggatcttcctcatggtggacatctttctcacggctaccaggtacatgggtctggacttcttcattgcctccttactactagttgtttcagttggcatgcaagcataatgcttccttccttgttgtctttctttgtcctcacaagtttttcaattctctcatcgttactatataccaatgagtttcttccccctcaattcttagttatgttcagatataatgctcttggtactctcatcctcccatggcttagttgttcaacttcttgatggttgcagactgatactaagaagatttcagcagtttcgatattctttgagacaatgccctacagattggatgaaagcactggcttgattgattatgatcaggtgcaatgtcctccttatctgttttgttttaatgccatttaacttattgaattctctatcattcttttataggtatgagttttcattggacaaaacgtgttctttttgcatctagcagattccacagctgaaaatatggtttcaagtagcattatctaggatatttttcattgcctcatatctctttcaattgtgaaattatttcaagatgaatttctgctgacatgcttgatttgctacttctgcacagatggagaaaagtgccgttctttttaggccaaagttgatcgttgcgggtgcaagtgcatatgcgcgtctttatgactatgaccgcatgcggaaggtgaattttactgctcaatagtgcatgctgaatcttcaccttctgtaatcagtcaaataattcacttgttatgcaatctgcaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggtatatacttgagcagaacaatagcaagatagtagcgtagggtgttggtactgtttcttctccatcctgtgactctgtgagcttcaaaaaaataaaaatgcctaatgaccctctaccgtctaggttatgtatgactttgaggacaagatcaatgctgctgtcttcccaggtctgcaaggtggaccacataatcataccattactggcttagctgttgcgcttaagcaggtctgtagcacttctgatccctgatgttttatattttatagatcacattgtttgcctttgtcttggactctaaaaggactttctaacttccaggcaactactccggagtacagagcttatcaagagcaagttatgagtaactgtgcaaaatttgcacaggtatgtgttcaaattttgctaggtttttttttttatctacaatatggcttgatctttctttatttcacaacacttaataatgattttgttcttcacttagttcacctcagcatgttacgaattgcaaattattggtttttcaacatgatgaattgtgctttaacatttgaaccacttccttatctggtggcaatttatcacttccagagcttgacagcaaaaggctacgaacttgtctctggtgggactgacaaccatttagtgttggtaaatctcaagagcaaggtaagacaaacatgtgggacgctttgggtgttttgagatattttagttctatctttcagtttctcttatgagtgctcaccaataaactttcagctgcttccttttaaaaaatatcgattgatgtctatttaacctcaagcttgctgtttctgtatataaatgatagctaaatgtgctttgcagataaacttgtttttttttttcaaatttttatgccatatggggacaattatcatcctcttcaaatttcatgtttagggcatagatggttcaagagtggagaaggttttagaaaacgtgcacattgcagcaaacaagaacacagttcctggtgatgtttcagctatggtaccaggaggcatcaggatgggtaaaatctgcccctatgtggttttttttttaatttacttaaaatagatttgcaaaatctcaatatcagctccatgatcatgcaggaaccccagcactgacctcaagaggatttgttgaggaggactttgctaaggttgctgatttcttcgatgcagcagtgaacttggctttgaaggttaaggctgcagcaggtctgtcaaattcctagttttttttttgtttgaaaatgttgagaatacaaaacaattgttgcatgcattgaggtgccctcatatgatacttcaccctaggatcatcgtattcatcattttgtttttcccctt

SEQ ID NO: 61924 - DNA, 930 bp, Oryza sativa
cgactactagggtggcactcaccgcgtggggggtcgcagccaagtaaagcagcaatggttcctccgtccctggggctaccaagatgggaggggaggtcaggtaagctttcagctgattgagagcttgctccgcctcctctgtccacacaaacggcccggggcgcttgaggagtttgaataggggcagcgccctctctcccagcctcgatatgaatcgacttagcgcggccatgcatccagtgacgcactgcacatcaataagcttgctgggggggcgcatcctctctatcgcgcgtattttctcaggattagcttctatgcctcgggaggagactagaaaaccgaggagtttgaccgctggcacgccgaacacacacttttcggggttcagtttcatgcgcgtggacctaagactgtcgaaatgccacaccctaaaaatcctaaatatataaattgttgtttaattggaattattagaatttattttaaaagcctagaagagaagatctaattttaattaataaattccaatataaaatggggccagataaaatttcattaaatactttgcttaactctataattcctagatttttctgggatttatttgagccaaggaggtatttttaataaatggaattgcatttcatgagtaatttaaattggaaaaggttttaaaagtctcttttggctttgggcctaaagtcggcccaaaaccttctctctcttctggcccagtccggcccgaagatgagcccgccgctcgcgcgcgcgcgttcgcccgctgataggtggggcccacctgtcagggccgtcgtatttctcgcgccgtgggccgcccgaaccctagcgccgcgttgccgtcgtctcctttcaaatacagacgccccttttcatttccggggaaatcaatagaggggaaatgatctt

SEQ ID NO: 61925 - DNA, 920 bp, Oryza sativa
ttacaggggcggacctacccattgggcagggttgggcgaccggcccagctacggcccacgttgccccactcccctggatgccatatccatcagtccatcaaggaatagcccacaagtcagcccatcaagcaaacaagccaatgttagcccgttaggcatctgttaacgaccaaatttggtaagatatgaaccaggttcggcattggaatcgaagtggattcggcaaagacatagatttgaagaatagagtatgcatcggctgcgaaggcatcggctggattctgaatcggctgagatggcttcgaggctgcttctagaatcgatggacgtgcttcatgaggattgccacgatggagataaagctctcagataggtaattgtatctattaattaggatatcttatttaatttccttagagatatgtttgggtaaaagtctgccgcaaagacttatggtatcttagagtttgttagagataagagtcgtgtccggcaaggacatattttgtatctcgggtataaatatgacctgaacccatgtaatcaattaacacatgttcaataacactttcggcgcatcgccacccttttattttatttcgacgagttcttgctttcgggttgagctgcatcgattcgatcttcaactagaggtaaacttgtcatggcggtttgcgttctcgggaatagtgcttccatctttatgacactctaatcttgtctatgtaattcgttgagttatcatatatactttataatctctgttagttacgctatataacttgtcatcggctgtttcttttgttaggaagttgccgatagagttagatctcgttattaatctagattatatcgtgtatctaccatctcttagaggttttcatcatcttgtatagatctcacagttatctttatgctta

SEQ ID NO: 61926 - DNA, 7808 bp, Oryza sativa
cccgatcggctatcgtttatggatttaaccgcggcttctcttgtctttattcttgttgattgtaggatcaaatcaactggcacgctcatgaacctaaaggcgagattttggacctgtacaggatttaagcagatcttccaggctagtgtgtgttttttcacatcaacacgcttttggcacgtccggtgggatcgagttgtgacaactttttctcatggcagaaaaacaatcaccgtcatcaggagtcaagcctccaaaccccccgagggccaagcttccaaaccctccggggaccaagcatccaaatcctccggggaccaagcaatcatcatatgaagttgggactgataacattgttccagtcactatagacaaattatcaccagaacaaaagctggagtttgtgcaaataatgaagagcgctcaggagaaattcatgaactcattcaaggaaacccgccaaggaacagtcattcaaaagtacaagctgaaggtggttgctgccgatgaacctggaacaagctcatctcaagatggtagaaccaagggagctaaaggtggtgtggatggttcaggtgacaaaggtgcggaacctagagatggtgaggttgaggacattggagaagaggatgctgaggagcaagagcctccaaggtgcaataatttccaagaccaagttgactatgctgtgcaacatgctttgaccaaccaatcaggagtgcttgttaacactttaacaaatatgattaagtctgtggttgatggtacgataactgagcatcaaaacacggggccagtcttcctaccaaatggcgtgttcccacagtacaagaatttggtgataggcaaccaacagcataccgccaatgcaccaccggtccagccgatggcagcagtttcagctctagcaacaggtgcaccgtcgtcggcacaaaggcaggtggttaatcctcatgtcttgaccagagagcaaccacaacatgttggacagaacatcaatcggctgactcaggagcagattgctgcaatgttcgcgccaactcagccgactgtcgagccagtacagtcgacaccaatcaggcagcaggttatccagccgattaggcagcagacggtgcaacagataccaacaggacagagaacacctattgctcagaaaatccacctgtcggagcccagtttgtgcctgaacagcagatgtataatgttcaacaaacccctcaaaactatcttggtggtaatttcaatctccagtatccacctcggtcacctcaaattcaatatcaaacaggaggatcacctcagcctcagtttctaccccaactcaatcaattcgatccaatacagcagcagatgcaaggagtgccccagcagaagccttgggcaggcatgattgcagatgtgatgagggagcagtttgggcttaagccaaaagacactggaaatttgtatcggcacccctatcctgagtggtttgaaagagttttgctgcccaaccgatacaaggttccggacttctcgaagttttcaggacaagacaatatttcaacctatgagcatgtcagccgattcttagctcagtgtggagaggcattggctgttgatgctttgagggttcgattgtttcctttgtctttgtctggatcggcattcacatggttttcttcgctaccttataattctgtcaatagttgggccgatttagagaaacaatttcacagctacttctacagtgggattcatgagatgaagctttctgatttgacagcaattagacagaggcatgatgaaactgtacaggactatattcagagattcagagagatgaggaataggtgttacagtttggctttgaccgattctcggttagctaatctggctttttagagtttgatcgctccgatcaaggagaagttttcgtcccaagacttcgagagcttgtcccatcttgcactaaaggtgaccttgcatgagcaaaggtttgtagaggctaagaagaatttcaagaaggtcaatcatgtgtatccttatatgtatgactctgaagaagaagatgactccaaggtagcagcagccgaatgggccagaagcaaaaagattatagcgtgcccatgggtgaagagttctgggaaggaagaaagatatgatttcgatatcaccaaggctgataagattttcgatttgctacttcgggagaggcagattcaacttcctgctagtcatgtgattccatcggctgaggagttggggaaaaggaaatattgcaagtggcataactctagttctcatgctaccaatgattgcaaagttttcagacaacagatccagctggctatcgagggaggcaaaattaagtttgttgactccaaaaagccgatgaaggtcaatggtaatccttttcctatcaacatggtgcatatatctgggagaacagccgatgagggcaaacatcggagttcacagctgaattcagttagaattatcaacaaatatcaaaggaggcatgacaagcagcaggagaggtattttgaagagaaagatgacggttttgatccacattgagattgtgagtttttcagattttgctagaacgaggggatgcggttgccatcaattgaagattgccctggatgcagagacaatgcggggagttcaagccgatcctacaatagaggcaatcggctgggtcagaaaagagtcctgttcatcagaggttgggcctagtgcatcatgatcgtgatcaagatgaagatgagggtagaaaaacgcaatggtgtccttctggtattttcaccaaaaatcagaagaaaagggttcaaaggatgaggaacagagagcgttttctggaggtacaacaggagatcaatcatcggctgaagaagaccaagcaggaatggcgcgtcaaaagtaaagttacaacagccgatgaatttgaagccgacaaggcgaagagattgaccaagagcaaagctgttgcatccacgtcggtaaacatggtttttatgttacctgcagaattcgaagctaaacaagccaatgttgatgatgtagaagaggcctctgctaggttgattttgtcgccagagcaagcaatctttgagaagccagaagggacagagaatcggcaccttaagccattatatgtcaatgggtttgtcaatgggaagccgatgtccaagatgatggtcgatggtggggctgttgtgaatttgatgccatacgctacattcgggaagctgggcaagaatatagatgatctcatcaagacaaacctgattctcaaggattttggtggtaatccatcggagaccaagggagttttaaatgtggagttgacaatcggcagcaaaactgttcctacaacgttttttgtcatcgatgggaagggatcctacagcctgttgcttggaagggattggattcatgcgaattgttgtattccttcaaccatgcaccagtgcttgattcaatggcaaggtgacaagattgagatcggctcgaagataaatgatacgtcatcggcaactagccgatcggctatcatttatggatttaaccacggtttctcttgtctttattcttgttgattgtaggatcaaatcaactggcacgctcacgaagctaaaggcgagattttggacctgcacaggagttaatcagatctccaggccagtgtgtgttttttcacatcaacagcatcacgcgcacacgccgcagccgcacacgaaacagacttgacttctcgtcttgattgttttctcgtcttccgatcggcgatgctgcccgacgccgattgacaccgacccattgtggcgcactgcctctgccgtcgtacgcgcgactgcgccgacgcatccaccgcccacgccgggtgctgctgccatgccaggctgctgcctgctgcagtccgctagggcctagggctagctagcggcatggcattgcaggcagcgggcctgcggtagccggcagccggcagccagcaaaggtctgaagtggcgaaagccgctgtccgtttccaggcagcccggttggaaaaggtatcatcagcaagaagtccaaaatgaaatcaaggtatcgtagatgtagtggagttttcaatataattgactgatgagcaacaagctagtgaccggatttttctcctcttagaattttgaccttgtggatatagacatttcttttaaagaaagtgctagcatgtgttttccaatagtctctactctagaaagggctaatttattagcaggacatcttcttatatattaaacgatttttaaagacaatgaccagttaactatcaccaatgttttataaattacctggtttttgcaaattgatatgatgaattatatataacataaagattattgttttgttttaaaatgaaacgcaccatccagaataaaagtattatcttgaatgttcttattcgtcttaatttattgattgtattgaactttttatgtgattaaaatatataaatataatgcgtgccgtgtttggttgtacttatcgagcgaacatctccaccccatcttttttataaagctgcgtccgccactgatttcttaacgacattactagaaatataatttctagcaatgatgtagaaatattcatggtatattcatagttacagatatgatccgtaagcgcacggatataccattataatttcacccggaagtatttcaaggtatcgtatttatttaatccaagggaagatatgataagagagaattatactgataatttatatattacttgtatatatcaaggtctatggaggggttaagtaattcaaaaggtaggataaatgtgacacacagaagaaagagctaatatattctcactaaaatataatctaaactaagtggaggaagaataagaaaagaattcattcctatactgggatcctctagagtcgatatgcaggcatgcatactttacactgctagtatacagtcatgcaaacaatagccctaatagtgccctcctagtgtttcgagagaccacccctgattgccgagttaattacgacagcctgtcatggccatccaaccagggctaaatacagaagagtatcctccccaggaaagtgtctcaggaatatacactaacgtagaggaacacctgtactgagctgtcaccatcagcagcccacctttactgtcccgcagcatatatggccagataatgatactccctccgtttcacaatgtaggtcattctagtatttcccacattcatattgatgctaatgaatctagacatatatatctatccagattcattaacatcaatatgaatgtgggaaatgctagaataacttacattgtgaaacggaggaagtacttaataatctaagcaccatgcttgcattattaaatactacaccacatccatgcatccaacatagagcaaccgaatattcggacattaaacccataccaatgcacctcttcggtaagctagctacacaactatatcgatacacgtagaaaataaagtcggtactcagataataaaaagcgaataaaataccaaagatgtataaagaagaatattctattaatttaatgtcttacaaaagaagagagaaaagctgctagagccatacccgaaatctcctgaagactcgaggactaagaaaactattctatttcctactccactagcactagaccactactaaacttgagagagctctttgatcttcttcttgagtgtgtggagaatggagtgagaggaggggtatttatacgctatgaggtgccttgggagtgtggaaatgctcaaagcatccaatgagcatattccctcttgcttcacctctttgtgccaagtgtccatgacggttgcttcaggtagaaacggtcacaactgccatgggatgtcgataactaccggcctgtggaatttctgggccatctgggctgttttgggttcgatagaaccctagactggcccatttagcccacaaatcgacagatgaactcctcgttgattcctcagctcagaagtgcattagttgggcccaattgatattattttaatgggtttagaggcccatccacccgtaaatctacctctcgacggattttgattaattgttcagttatgtttcgtcgattctcctccatttatgaatgcttctcctgcatatatgttagtagcatagcacatagtggaagtagatattttatttggaaattatgcattgcaagcatagctagtcttcattaattgggtaatattgacggtcgaaattagtcgataacgaccgtcaacaatcccctcaagcttgaatctttgctcgtctcgagtaaaggatgaaaggaaacaaagacttggttattgatcaggagctgttgcaatgctgtatatctagaatgtacaaaatgcatagtatgggtacccttaccagaatcaagtcagccagcacggtggcttaaccatacgcctaaactgtgaggcatcatgcttcaccttgtcttgggtgtttgagagacagaacggttagtaaagcactactcacccattccttgtctaacttttattcaggagattttctcaaatgatttgtgcaaataaaaaaaacaagttgctcaaatgattctctcagtccctcagcggtatataattgtattcctcaccaaggtattgcattggtccctattctaaggtcatatatgtggagtttggtagggatcaagtgagtcatacttctattcacatttattacttctgatcaagatcatgcaagatgtgtgtgtggaatatatggtggtaccaagacctatttagtggataaatataaaactaaactttactcctttttgatatacctcctccttctttatttttgcaagctttaagaagtatggctagctctttgtcgaaactagatttcggcaatactaaagggggtagcgaacaagctgtaaaaatggatgggttatgagacaaaggatttatactggttcaggccctctcgatgagaagtaataccctactcctgtccggggaaatattctgctgattgtgttattgatttgacaatctgaagggtggttataccctcaaggagccccccgacctctccttatataggtagaggagtcgtgattacaagatagaaaccttatcccttacgatctaagttctatagatattttacaattgtcaccgagtaaaactacaagatatttccttgatatacaagttaacataatacctgagtccttatctttacatattctattactatgtgttacccccaataaccagtcggataacacaaccctgtgagtatatggtatagcccctgagacattcacagacgacgagataatcctttcccaagtgatttaataaaaaggtcgagtaattcaattatcctccgctgcaaccctcgagtacttcaatcatctcaagctgtgaagggctaaaaaaacaaaaattaaggtgcatcaactagatgcacctaattaggtgtagccctcgactatgtaattagttgagcaaactaaacatatagtcaaggataaaataaataaccaaccaagcggtatggaatgattacggtcatcaaaatgactaaacaaaatataaagccgattaatcgccgattcgccgtcccgtcctccatccgccgcgcgccgtctccgcctacgcaccgcgcgccgactccttcaccaccacacagcctcgccaaccgctttcatcgttctcccacgtcgccatcaccatcctatctgctgccggcgctctccagtggtcctgcctaccgccggcaccacccc

SEQ ID NO: 61927 - DNA, 1383 bp, Oryza sativa
ttcccaccttacccatactttgctcctgtgggctatgagggggagagagcgctggcccagtgcctgttcgccctcgcttagatgggcgccaccgctaaccactcactcgccgtccccaagatcgggtgcaccaccgaccccccgctctcccttgccaagatcgatgccgccgcacctattgaaggttgctgctgcgttgaaaggggaataattttcagacttaaacttactgaatccactcgatccactccaccgccatcgcctcgatccactcccatgtccttttggcgcctgctgcatccattccgccacggctgcatccactccacgtctccaccacagctccatcgctgcactcgatcttctagcggtaacggcgccgtctctgcctgggccgtggtgcgaaagcgtcgtcgccaagctggtcagctagccccgatcagtctccaagtttggttgattggtgataacgaataacgtacaatcctgactgtggtagtatggtagaatagcgctcctgtgctccagctaatagtttgtttgacagacgcttgattggctttttatgtgaccattttataatttatattttgtcatatatctgtgctccacagagtagaaaaggtgttgaaggaaacaattgaagacaaaatatcggtagtactccaagttgctatcagggaagcacttacaaagtgtttgtggaaatgcctctcaacaatatatccacacgtgatctttaatcttcatgcatttttttgttggaatttttttccttgatatagtaggtgggactggatttttcacattttggtccttttgaaaaacttatttcgcaaatagacccttgaaaaaacttatcccagaaatggtcctttttggggcgctagagtggctggcgccgtcgcgccagcctctctggcgccgtccccctgccgacgtggcggggcgatgctgaggtggctagggggagcgcgccagagtggctggcgccctcccccccaatttttttttcttttatttgtttgatattttttttcacatttagggacacacaaaaagcaaccatagaaaaaatgaactcaaatggacataatatgtggcatgtagaatttttcctctcctctcctctctctccgaactagtgcagaggagagagatgtgcaacttttttatttttattttatttttctaatatttttttcacgtttaggaactcaaaagaaccaaccataaaaaaaataaactcaaacggacaaaatatgtggcatgtggaattttccaaagctctaccgaaaaatttctctcctcgaaaacacaatcttgcaagcggaatttggaggttttaatatcgctgaacccggcgaagcagggaagaatcgg

SEQ ID NO: 61928 - DNA, 1342 bp, Oryza sativa
tgcttaattttcatgggaaactgcacttatgctgattaacctagctcttttggtgataagaattaatatagtttacaaaagcgttattgtgcattagactaaatgaatatatgtgaagtcgttaaattatgtatacgatgagtgcaagctatagtcgctgaataaaatctcactgattcattgtagttgtaactaaagaaaaaagagactatgctcaacaccttcgccgcctcccaccttgatggcatgctggggtcctcctcaagcccgcttccaaagccaggatcctcatccatatctgctacccgggcccgtggcattaccgactcccaagttggcgcatctgcgacaatgggttatgtggacaccccgagtattataccatccagtgtccaacgcgaccaccacatactattggagaagtgggatccatacatgcacaaatagccactcgtcctcaatatgtccatgatcgcggttgacaaccttctgttataataaccgaaatgtcgagtagtgagcgcaagacataaccgtaagatagcttgccagtccactctgtcataagcccatcaaccactcgaaggtggtgactgaaagcataccccagtgactcgatccaaagcgctatccccgattatctcaagcgatcaaaactcgttactcatgcttggctagtccccaggaatgcgactagcctcacactttcatcgcaagcaattaataaacatagcaagtcccataatagggttaaagtgcagcaaggtacatgacacataatatggtccaaggtcccaacatacaacacataaatatagcagcggaagtctcaattagagttcataagcaaaagataaaaccggtggtgccacaaccccactagggcaaaccaaccgggcaagagccaagctgcaatagatcacttattgccctcgccgcccttggcaaagcaatgaccacacaagaaacataactcataaccggaatcctctcctgaaattgcagacaccgggttaagtacaagattgtactcgcaagtcttacccaaaattataaatacataagggagagagaagtatgcaagctttctagcctatagtgggtctctaggttcaacatttgcataaagctaattttattgagcaattaatgagtaaaataagcaaggacaagtaaatctagcatcattttaatttatggacagcaagtatataattctgaaatgtataagcaaatgagcccaaacggcgctctcatcatcagccatggactaccaaagtccatgccaacatggcacaacatgccaacaccaccatctaacataatcccatccataataatc

SEQ ID NO: 61929 - DNA, 547 bp, Oryza sativa
  unsure (1)..(547): unsure at all n locations
tgtcggcaattcttccttttgcatacatacatattatctgtcccatgcatttgtttcttcaacttgctttccaattcatttttttggtcaaaagcccatggtagttctttttcggctatgcgtgatttgagctcaacgcatgcagacagcgagtccgttccatgcggcacgagccagactttccgaacgtctctgttatgtttttaggatggctgtcacaaccgaacatattttcatttcaccaagaacgagaagacaaccagtacaactgtgcagtttcgatagccacataaattttcattttaattttatttaattttccctttttttgggcccccaaaaggggggccccccaatttttaaatttttgaacaggcaacatgcatggcttcttcaagacaattaatggnggaanngnnnnnannnattnnnnnnnnnnnnctnnnnnnnnnnaaatgaagnnnngnnatggnatctggatctgngggcncnctggcgggtaataaccnnnnncncttnccnnccggcnntggtcgctgttgtgaaa

SEQ ID NO: 61930 - DNA, 12162 bp, Oryza sativa
aaaatttcgagtcaagattagagtctcgtcacatcgacagtagtggagtgtaggtccaatcgacggagttgtcttagaaaagttatacgtagtacttaacaaatttcttgacatagaaacattgtattttttttttgagaaacattgtatttaacaaattaactttttaaattgaatttgaacctataatattttcatgtacttcctctgtttaacaatgtaagtcattctagcatttcccacatttatattgatgttgtctatctagattcattaacatcaatataaatataagaaatgctagaatgacttgcatttgaaacggagggagtataaacctttgatagaattttttttcaaacgagctggtacttagaaagtctgaagtttcatgaaatatagggcccgttaagtagatcagcaactgcggcatgcagctaggatgcgtgcgtgtggtactgttggttttggctgcggcacagtcgtgaaatcaactgtcgaacaggcccaaagcatgaaaaaattacaagaatataaccttaaaagattacataatcagaaaaagaaaaacaaaacatcaccactatgcacactttactgaggaaggactagcatcgaacctgctgctattaagctttgaccggtcatcgctaaaccaacaataagctttaattgtactctccatccttaaaaaagatataggatgcagcacattctagcacaacaaatctagacatatatacgtacagatttattgcactattttttttttgcggagaacagatttattgcactataatatgtcacaactaggaatagattgattttttaaggaacggatggagtatctccaaagtcgggactccaaacaaccgaggaagatgtttggacgagtatgtcgcgtgagttcgtggcgcacaaattgttcgcggatttgccatttcgctagcaggctgctccactagctggctcgaataaacggagaagcgatacgcgtatatacatacttgtgggcgtaacgtaaccgacggaatccaataatacgcacttagtaagtctaattttgggacagcaacgtggtctacatatttggggcaagcaaaccgccaccttttcttccccagcccttgcccttttcagggtgacgtggcatccttcctctcttcaaccctttcttcacggggccccacgtcgttgcttgtggagctcgtcaacgtatatacgcacgtcccgtgccttgtcgcccatgacttgtcagtccaaaaacgagacagagtcacggttgaaatcttgcttcaactgcactaaatttcgtccaatttggaccaagcaggacacgatctttggctgtgttcagttcatgtgccaaaaattttttaagtatatggacacatattgaagtattaaacatagactaataacaacacaaattacagattctatcttaaactacgagatgaatctattaagcctaattaatccgtcattagtaaatgtttaatatagcatcatattgtcaaatcatggcgtaattaggcttaaaagattcgtctcacgatttacatgcaaactgtgcgatcagttttttttccacatttaatgctctgtgcgtgtgtctaaatatttgatgtgatggaaaagttaaaagttcaaaaaaaaaattttaactctaaacacggcctttgatcaaatcgataaatttttgtacgaggactaatcgtggtaattgattactagtagcagtagactaccgtggcaggtcgaataatggggggtacagttggcgagattatgaaattggataaagccaaatttaaatacgtaaagagatgatgatggggctcaatttgcggtcgagatttacaaatatttaaatccgtcacaatattcacatgcgccgtttgctgtacacatacgactaccactagtaccctttcttccccaaaccccctcccgatttctcgtttttgctctccaatttctcgcgagaagccgaagaggaagagagcgagagagagagagagagagagagagagaggagaggaggagttggttgagatggatctgttggagaagaagaacattaagaaggggggagaagtggaggaggaggtggcgcgcaagggagaggagaggaaggaggaagaggtggtggtggaggagaagagccatcagcagcagcagcagcaaggggaggaggagctcgtcggcctctcgctcgccggcggcaggtagttttccggctccgccttctcctctcgcaagtcgagtcctattcagctttgggttgatcgattgggtcgcgggagagagagtatttggttggttgttcgggaaatgcatctcgcgcgggattctagccgcttttcagttcatagtatcgccccttctccgagaactcgccgccggggagccgcttcctgctgggagccgagcggcgccgcagccgcctccgaagtggtttaccggaggggatggattttctccggtactggactcctggtgtttgaatttttgggtggaaccggagactctttttttggtcgggtgaaattccttggaccgaccaaaaaaatctcgaatccactcggagtttcctccgttccagatggagctcttgcgttgaaaattttcctaaaaatagagtcaaaatgtttcgacttcgagttaagagtccaccctacaccgagttgcaactttcccttttttacgagttggtgtaatcatggaagagcccttagctttgctgcagtggatcaaattggtgggggttcttgcctaggtcatgtgaagattcttctgattagtggtagtctcatgcttctcctcggcctgcaatccaaatcccctttattcctttcccgctctcttgcgcttggcgtcagctgttcttaaccttgaacaaattagggtgtcattctagttgcacgtgttcttatccagatgttgggagtgcggtgaactgctgatattctactaaaccgatatcaattatatggatgttcaatttggttcacgtcactaggtaaatgatttcccaccttagaccaaacttaacggataggaaagaacttttggcaagtggcagatccaggtagtttttttccttccctttttctgtaattggcagttacttgttctccaaatacttggaactgctgtgaaaagtttccaattgagccttggaatcaggagcaatggggaactcttctaagttacttgcatttcttctttaaagactcagaaataataagcaagaaacacacatagatctggtgaaacttgagttagcgtgcagtttttaacacctccatgtaccaaggggattcaatggtaaaggcctcatccccttgtcttatctttacttcaagactaaatctgtagctggggaccaagtaccatagtttcgcaactcttatataatccactaggctgctgtgaaaacaatagatgcagtgtttgttttgaagtaagtaaggtgaaagtaaaaatacctggtaatggctaatatgaatcgtggctattattaaatgtttcagcattttctgaataggtaaaccacatatatgtaactatgtaagatgtttttaaatctagatgttctattgagcctgtaacctggtcttttagactagattatgctgagactttgaagaaaaaaatttcagtacattccgtccatcttggacaacctttggacagattattaactctgaatcagtcccatcatgctgcacatgttggatatttcagagtggaccataaagttgcaggcctagtttgctatttttagattttagatcttgtgagttttaatcttgatcatgctattagactcagaatgtgtgtaccaaaaacattgataatggtatctatcctgacttgggtataacttgtgttactggcagctgtgggagggctatgttggcgtagcgtactgaccaagagataatcctctcatcaagtagaatatagagagtagaataattatttatgaaggagatgggcctttatctggctgcagacaaggtgcatagtaaagctcattaaacctctaaaaaaggctggaaatacggcctacggtgtaattgcacattatacatcagttagctaggttggcctccaattttatatggcactttacccttggatgcccatcttatgtattgccatgtactcatgtatgcaattagtcaagaacggcccacttatgccaatatctgtgtaactatgcaatctgttattaccttcttgcacatttactaatttcgctttgtcataatcaggcccaaagtatttccaatgtcgagccctccacctaatccttcgcaacttacaattttctatggtggatcagtatgtgtttatgactcagtgccgccagagaaggtcatattcaccccacttatcttcgttatatcctccgactaactgttgaaagtttatgctaattcgttatctgcaacattgtcatcaacaggctcaagcaatcatgcttattgccgcagcagctgctgcagcggcgtctgccaccaaaagcaatgctgccattgctgttaagccccctgtgatgcctgcagccaatgctacccaagcagcagtctctcctgtgctcacaagatcgctctcattgcagagcacttctgtagcaactggacaacctcaagttgccgctgaccctagctcaatttgcaagctccaggctggtaagactacaagatctttttgtgaatctaaaatggggctgttttaatccctcgtcatatgatgtactaagtgattgaagatgctacaaatttattctttatttgctgtgcagatctccccattgccaggaggcactcccttcagcgcttcctagagaaacgccgtgacaggttggcatgaatgaatgtagaaatagcattctatatttgtctgatgcatttccttaggtttagtggtccattagaacatgctaaaagaatgtggatagctggaaactgacttgtaggggataaaacatttgctttagcttgacttggatacgaaccaagtatatgtgcaaggactgttttcagtttcattaccatagcccatgttttcatgatacataacaaagtagccagtagttatagaaacacagctttctgcaaatttgagaaatccttagcttcaactgattaagccaaatgaccatgttaagcaggttggtgagcaaagctccatatcccacaaaatcctccgagggcatggaagcatcagggatggaagtaactgctgagggcaaggcccagtaactgtcaacttcgaatggtggaggctgacgtttggagggggaaggaaggaaaggcgtcgcgttcattgtttagatggtgtcgcaccctagaaccttactaataatcgaacctatgcccttattatcgttgtactgttccttatgtgctagtctattctgtcatgaatttgtttactcgaacagcaaactgctatgatagtagtatatcattgtacatcatgcatatcattgcctgacaatgttatcgtgttcgtctagtaatgatatcatccaggttaattgttactagtaaatttcagtttcagcagctatgatagtagtatatcattgtacatcatgcatatcattgcctgacaatgttattgtgttcgtctagtaatgatatcatccaggttaattgttaaggtggtgtttacatccagggacttaactttagtccctgtctttagacactaatttagagttttaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgagttttattaatagtctacgtttaatatttataattaattttcaaacatccgatgtgatagggacttaaaagttttagtcccatctaaacagggcctaatttcagtttcggcactggggttttacagtgccagatgcatgaaagttgaggatggttttcttgtatctggcattccggctgttcctccattttacaaacagcatttgttccagatcttacgaagcttacaattttgcagtgatggattcctatactagcatttttttcgctgcctctgctcgactgccgctccggtaccatgctgacagtgtcaaccggcgaattagcccaacgcggcagtctgaccggccgccggagacgacttgccacctgttgctgccggccgcattgagtattatagtagtactgcacaacataaggtgtgtttagttcacaccaaaattagaaatttggttaaaattggaacgatgtgacgaaaaagttagaaatttatgtgtgtaagaaagttttgatgtagtggaaaagttggaagtttgaaaaaaaagtttggaactaaacacggccatatttcccatatacaaccatgccactgtacatgctgccaaggagtaccgatgttcaatcaaaattcaagacagattcaccaaaccttttattttttccatctagcatctcacatgcttaaccataggccatattgtaccagaaaaggagtgaactacgcccacaacacaggtacatgatcaagaaggagaatgtcacacagttgctgcagattctaaaacacaaaaacggaagggaaacatgaggcttaggtagggagttgcatatagtgattgccacggctactgtcagtttgtcatgcatgagtgctgcgcaagatcccatggatgtaaccaccgaccatgaccaaggagacgagggaaacgacaccagctgggaatatcttcccggacttcttgaagcgagatcccatgaccgacaagagggcagcagatatacctagaatgcaaagcgagacaacatcagggaaagactccatgttgaagtaattccatgccaaggataataaggaccacaaggtccacaacataggtggctcagaaaatgattttgcatacctaaaccaatagatgatgcaaagacaggtctcactgggagttgagtgtggacgaagtacaggaccagggctgatatgcctcctgcggctaaggatttctggcttccactcttcatgtaccccatcgctccaccggctacagaatttggaatcacaatagtcaatttctaacaaaaatgaagctctcttttgatggcaacaaccaatgcttcaatataatctatcctcagatgcaccttgaaggctagaacaggctgtcaggctctgatgtagaacctcacacaggatggtaacaccacacagtcattcactccagtagatcataacgctattattgaaccgatgatgcagctaaaattataacaggactatcatctgctagtttcacagacataatcacaatggagaaaaaataattcaaaattttaggatgatcactcttgtgttaattttcttctttttttttttaggatgttcatttttaggtggttgtttagctgtactccatttcattcttcctaagagaaaatttgtgcacattgtgcttgcctgtaggccaaaatttgtgcacatcctgtgaccagtgatatacagagtgctaatgcaccatttgtgtttgtgtctacaaaaagcacatgctggtagttgtatcatcattgttctgatacaagctggacttgagaaaccaaaactcaaaaagcaggctgctgaatctgaatgttgcataggtgttctggttttctacagttggaaattatcaagtacccagtcaagtccaacaattattgatctcatcaaattagtaataattcgacctgactaataaggatttaattttattcacgagaataacctgacaagtatgtgtgttctaacttattgggaactagttggtgaaccagaagttgaaatgcacacaattaccccaatggctaatcactttgataaagaaatgcagtagctctcattctccaaaatcaaactactcgaatccaaggcgtttgcacactacagtagatcagtaggagtactaaaaatgaactggtcgtggcattactgcatttttacctccgacgagagcggcgtaggcgagggtgatcttctgcgacatggagagcccctgccccatcttctcctcctccccttccccctcctcgtcgcccccaccaccccgcggcttctcgctgtccccgccgccgccgctcccagagccgtcgcctgcgcctccgcctcccgatccgccgagctcgggctccctggccgcgacggcgacgaggaggcgcgcggaggggcggagcgagagggcggccggggcgcgggggcgcagcaggaggagcgagcactgggagatcggggaggatggcggcgcgagggcgagtggcgcgagtggtaaggtcgtcgtcgcgatggccatggatgagctcgagttccaacttcgagtgctcgagatggaggtgatgtgatggggattttttacggggaggttggtggtgtgagactgtgggtgggcccccggttttctttttcttttcttttcttttcttttcttttcttttatttccttttctttcttttctttttctttttggaattcctttttttttccttttctgttgctggatttttgggttgggttgcatctagaaggacgattcgtttcttgtggagcgcgtgggacgcatgactgcatgtgcaccccctgcatcatacgcatgttgcccaataaagaatttcaccacatttctgaattatgattttaaaattaagtttaattttttttccctggttacacggagcacacatacgcacacaccgtcgtacacgtataccagtgaagaatataaaaaccttcaagagtttaggtaaacacgtaccacgcttgcaaacctgcgtactccttccgtttcatattgtaagactttctaacattattcatatttatataaatgttaattaattaaaacacacacacatatatatatatatatatgtctagattcattaacatatatataaatatggacaatgctagaaagtcttataatatgaaacggaggtagtaatatattttgacttacatatttatagaataatttagggaattcttttgatctaacaaactatagagcatcgtgagcacgccttttaagcttctaaacaatacgattgtggtgtaacttgcattatcaatattttttaaacacttttctaaaccaaccttttcaaactttataatactagttgattaattcatttatttgtatcttaaataattaccataagagctatattctaccgtgctactagttgtacagccgcagctgtcagacaaccattgctaccgaacatccctataagctaaggccgtgtttagttcggagtattaaatatagaaaaaaaaataattatatagattatgtgtaaattacgagacaaatcttttaagtctaattgcgccatgatttaataatgtggtgctgcagtaaatatttgctaatgacgaattaattagacttaaaaaatttgtctcgcagtttacatgcagaatatgtaatttgttttattattagactacgtttaatactttaaatatgtgtccgtatattcgatgtgacacgcacaaactttaaatagggcctaagtttcatttacaatactatccccttggaccaaacctttgtaatattcattataacaaacctttggtaatgttcattattggattatgatgcttcacacggctaaacaaaaaagctttcaactttatacatacctagtccaagattgtgactctgaccagtaacaccggcacacttgcaatctttacaaaccggagaaaacgacttgcaatctttacaaaccggagaaaacgaccgtgtttctcacccaacctcaatatcaaaatctctctttttttagtttacttccagtatatacaaaaagcttcaaaatttatagcaacccaaaactgacgaactcgatcgcttcactttccaccaagacttcacctgaccttgccttgccggccagcgtggactcagaaaacagtagccaagtctcggcaaagaggaggaaattgcccaaccaaaacacccacaaagaagaagaggaggagtcgccaagacgtcgtaggcaacacctcccttcccccctacccttgaaccgaggccgagtcgtggtcgccgcgagtggaaggcaacaactctccaaggcaggcacaggcagcagcagcaggaggagaggaggcaggcgcgggcggcgtgagcagcagcggcagcgccgcattacagccttgggagtaggaggaggaggaggcagcggatgatgatccctagggaaggggcggtgccggagcccgcggcggcgtcctgatccccgaccgacgatcgcggctgctgctgttgctattttttcaggttggttttggtgctattcgattcggtttggttattcacgagttcttggatttggggtagtttggatttaggattagtgggtgtagtgcttgctttggttaggtgcggcgtggatctgggaggtcgatttagtatgctctagtttggtatatgtgaattattcagcgcgatttgagaatattgaagctgatttatgaacttgagcatatcatagagaaaggaagggagcgaatttgtggagaaagttgcttctttttcacacttagaatagttttatatacttttaatcaactgattagacttcctgtggtggtggttatagaggatggagaatcctcagattgagatgggggccttcaaggcgaacggtccgcaattgcagaatggtgggctacgttccagcatggttcagtcctggaacctgcagagattcgttgagagcgcgctgcggagcatcaggattgtcatattcacttctaagctcaatctgctcttgccgtttgggcctgcgtcgatcattctacactatactaccagcagacatgtaagtcctgttcacagcaactgaactctattcgaccgcattttgtttatatttatcattgttcgtaggctagaaaccagagtaccctatcgagatgaactaataattgggctcactgctctttagtaacattactagttttgtattttttgttaatgtttcatcaattgaagactatctgatttagtcaataggtttttcttatgatgatctcttattgctactcagtacttgtaactgatttctactttaccaaaattgcagggattggtcttcctattcagcatgctaggaataacacctttagctgagcgcttgggttatgcaactgagtgagttagtgaactctagacctatttttttctgaccttatttcgtttaacctaaactactgttctacaggcagctcgcaatatacactggtccaacaggtatgcatttttatttttatgatttataacctattacaaaatggagaaccagtgaacaataacagacattttcttttaataccgattgcagttggggggcttctaaatgctacgttcggaaatgcaactgaaatgatcatagcaatatatgctttgaaaaatggaatgatccgagtagttcaacaatcattgcttggttccatattatcaaatatgttgttggttatgggctgtgctttctttgctggcggtattgttcatcggaacaaggaccaagtcttcagcaaggtaattttgatgcaacatgttgtgcgtcctttccactcaaaagttcctgatatgaaatcaatttttatttactacaggcaactgcagttgttaactcaggtttactgttgatggctgtcatgggactaatgtttcctgctgtccttcacttcacgcattcagaagtgaggcaaggagcatcagaggtttctctttcaaggttcagcagttgtattatgcttgtggcatatgcaagctatctctatttccaactaagtggacggaataatgcttatagtccaattggcagtgtaagtgtatacctcaatttaattcttcattgatggtgacaaatatgatatgcttgcactttgaattggaacaacaagcaatgaactaatctccttgataacagtcagttacattccctaaaaataaaaatgtaatatccatgttccatcgcc

SEQ ID NO: 61931 - DNA, 1194 bp, Oryza sativa
  unsure (1)..(1194): unsure at all n locations
ctgacatccattcactcggacacccagcgctatgcccagaaccggttgttgccggtcagaccgctcggggtcgccggtcagaccggcggcatgcggccggtcggaccgcccctggtcactcgcacgtttgatttttggaggaggaagcattgaaacggtgccgcccctagcgccttgattcctggtcaccgcccttcccccttcctgtcgcgcgcacctggctcaggaaacataagcgacttctcaaatcctcctatctgttgggcgttgtagagctgtagttttggaccagagacttggaggggacttcctcggtttgggttgggggaggtgcctatgtgttggagatatgggagtaacaagttatttagaattttgggccggttcttgggcaacccatcccgacccattgggctctgcccctgcatgcatgcatggcggtgccgtatgcgcgcttttcttaccgggatcatccggatgcccttggataggccgatcatgtgcattgatccatacataatattcaatcgtgtacatgtttgtgttccataagcggatgcatcaaccggcgataccgggagccgagaggacaacacccggcttggtagcggatacacagtaaatcatattttggaatgctattttgattagatgcaccactagaaaaacttattttttcttgggggccaaaacctattttttcatggggttggaaccgtcctcttgcccgaaagggtctgcaaaatagcgactttctccattccgttgacactttcttttatattttacgactattttattttccttaaattaaagcaataaacctcccacaaaataatttttcaaaaccgcacaccggaaaattcgcctgtcctctttatttgcggaaatgtcattctctcgcccttcactttttctgtgtttaccacgaatttaggccatacatcacactgccgggttgctcctgaatgttttatacttgtattctcttcttatatgggtcttatatcacactattccgatcaggacactaaataattctacgtctgccctcccctttataaccctccgtttcgttttgtgctattctccttcctccaaccgtctctcttatcttngctctactcatcctcctccaagctcgctattccatctcgtttactctctattccggatcaatctgcctctccccct

SEQ ID NO: 61932 - DNA, 4361 bp, Oryza sativa
  unsure (1)..(4361): unsure at all n locations
attgaattgatatcctactcgnacccatttcgctgccattcttgcgtttgggccatgtgtccttcgaggttgtgctagatttctcccgcctgcaactccagtgcgtccattctcctagtgagctctcccaaatatgtatactctccttcaacttcatacataaagccccatttttttttttgcaaatcaaattaacatgtaatctccaatattacctgatctcaattgatgggctgcgcaggtcctacatttgcacattgtgctccatgtggctagccgcagaggatagtgtggagtccgccggtgatggaggttgattgctatttttcttttgctcgtcatctctattgacaagaacaagaatgtttttttgcatttttttcgtccttgctagatgatggatggctgctaccacgcaacgtcgagctcatctctataccacatcgctacatccttccatgattccattgtcgactactgctcgcgccatgatcataagcactatataaataatcggaatcttgttaagagaatttttctttaattactcttaattacacaagtagacgtgtaattacattactcttaattacacaagtagacgtgtaattacgtcatgtacacaacttgtaatatactaccatacagtgaagagatttttaagccaattaaaatattcactataagtagaaaattttacatgcaaatattataaatgcagttttgctataaatctgtcgtcaaattttttacttagaatttgacatttttcaacctaccgattagcacctgattagggcaaggcactgatcgtttttagctttgccactgtatagaacgaaagtgattgaacgataatactactttaacacgggtgagagatctcccatgatgtatatttcgcaacagtgttttaaaagttgcaagttatagtataatttgtagttatatgtaagttgcaatgtaattactatataattgtactatgttcctttaaaatataaagttacagtcctatataactaaaattatatttataaattcagttgatatgacatgtaagtatattgtaactttgataaaaatgttatgtaaataaatatgtattcgttattttctttaaaatataaaattatagtcctatataactaaaattatatttgtaaattcaattgatatgacatgtaagtgcactgtaactttgataaaaataatgtgtaagtaaatatgtatttgtcattttcttttgtagtctgttggatgtaaatctaaaggtataaaaaatctgggtgatttttttttgttaaaaatcactcgacaaatggataggcagttccttataaatgatgagtggcatacgtaggggtggcaacagggaggggcgggcccaggttgggacatgaatgtccccccctgctacctagggatgggaacggggcgggttgggctacaacggccctgcccccgaacctctgcacctggccctggccccgagtggagatgcggggccaaattagctgagggccccgcaacccaaccgggtccccgtattgggtagccactccatccgatcagcacgaaaaaaaaaactttccatgatcgcaaatactttcacacatacatatttccatgatccatcattccatccatgaactaaatgcatggatgaccaaaaatactttcacacatcaactcattcaactacagcaattcaccaagataataaaatcatagtctcacaacaattcaaccaccatactaaagtcaccgtctcgcccgtgccgctctgctcgttgtccctgcgagtcgcccgctcgctttatctgcgcgccgcaactgcgactgtgcgccgtcgctgcgcctttgcaccgcccactcgccgtgctgcacgtcacccatgcgcatccccgccgcgttgagaccagaggcagagggctgtgcgaccagaggggagaggggacagggaaacatgaggggagaggacgacggcgagaagtggagagcggtgagagagagacgagatccgaagcggcgagagagagcggcatgggggctcggtcactcgggggaggataaggtagggtaggtttttctgctttattatatacctcagattcccactatgtttagatgggcttcttgggcctataatgggctatattttgaggggtaatatacccctgggccccatgggccacggggcacccgcgggttgaatgtctcccccggcccctcacccgcccaaatgcggggccctggccccgactctccgcggggcagaaatggcacccgtcttcgtccccgtaggggcgggtccccgtaggggaaattgctatccctactactacctgctacccgctacccgcattctgccccggctcctattaacggttgttaagtaccaatttcgaccgccaactagcacaatgaataaaaagaaaattagcatttcttacacgtataacaataataaatgtagttgtattagacttggagaattaacatggatgcatagattatacatcaaagtgttggagaaatgaagctgacatgcaaagaaatacactttcggcgaatcacgtgcgagtacacggattgaggggcccacaagttagctcaaaccgattcaaagtggggccaaccacccggccgggaaccgactaagtgccccacctggcggtgaagagaggcggtgccaagggttcggctgaactgacattgcggtgcctcatctccacccattggctcctaataacagttgtggatgcttaatcaccattgaaccttcataagctgcctatttaaaagctcacttcctcactttcagcgcacacctcaaggagaaattctctctatttcatattgtattctctatattttagtagaaataaagcatatgagttttggcgctatagttttctctgagagtcgggtatgtctttagtactatactcttcttgtaagactatagttgaattaaatgaattatcttacttatttgattatgctcatagtctatgtatttctttattgaatatatgttctatgagtagtatatactttgtgatgaaggcgatgcaatgagtggcaaggagacatcgcgatgacgagcgatgagatggcgctaagtggtgatgagtggctttacggcgcagaggagcaacaatagccgccgtctttgccatgaacggccgctgtgcgcctgggatagggtgtgggagattagggaatctgggtttactatatacatgatctgcttacttaactcaatgggctagttgggcctatattattgtaatgtactatttttagggaggtaactaccaccccaaggccccgacgggtctcccacatggtgaaattctcccccattcctaaccccatattgacggttccccggtcccaatggagaaattaccacccctaggcatccgaatgtagttgtccttaataagagtatgttttctggtagaggtggatactacttgtaatttcatgcataccatatactaataaatttagagctaacatgtattagattgtctctaacacacaatctccaataactctaacactctcacatttttattggagtttgtgtatgggttaccccttgcatgaggggtggctctttctgtctctccattcttctctcctccaccttaccatttagtcatatttgtcatcttgaggtttgtgtttagatgcccatagcacttgctctaatatctaatatttaagcaacatattggatcaattgtgcatgtactaattattgagcattcccgggaattccatgttaattaaaaaccttgccgccggttagttggatcaataagcacaaacatagatcgcattatgaatctttcttaagggcccctttgaatcgcatgaatggaaaaatagaggaataggaaaaacacgtgattctaacatgaatgcatgtgtaaaacagaggattgaaaaatacagaaaaaaacatagggatgactatttgattagcccatatgaaaaacgtagaaatcggatgagagagatagactcaagggaatttttcaatgaggttggacctcttgctaactttctccaaaatctctatggggattatccattccataggaattttaaagcatatgatatgattcaatcatttacttcgaaggcccccataggaattattttttataagattaaaattctacaaagtttccccccttttcatagaaaccacccggggccttaaatccaaatgggctattgaaaaaaccccagattctttagtttctactccagttagtgttcgggtgtcgtaaaattanagattcttnagggcnagcgaacgcattcaaaanncggcccca

SEQ ID NO: 61933 - DNA, 31414 bp, Oryza sativa
agatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaacattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcagcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgtgaagtagcagcaatagagtttgctggttccgaagataataaagatgaagtcgctccaccatgatgacaaagttgtgttgccgtgatgaagtgaaccggtagtgaagacgcagttgtgaagataaaagcaccggtcggcggcggcataacacgagtcggcggcggaagacgatgatgtccatcagtagtggtagctgtataaaccagatgtagaggcgagggcactagtcagcagcagacgagatgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcgaggacatcggtcggcggcgacaaaggcaagccggtcggtgaagacgtagacgcccaacaacggcggcataaaggccagccgtgcaggcgaggacatcggtcggcggcgacgaaggcaagccggtcggtgaagacgtagacgtccaacaacggcggcataaaggccagccgtgcaggcgaggacatcggtcggcggcgacgaaggcaagccggtcggtgaagacgtaggcgcccaacaacggcggcataataggccagccgtgcaggcggaagcaccagtcggcggcggacgaaggcaagccggtcggtgaagacgtagacgcccaacaacggcggcataataggccagccgtgcaggcggaaacaccagtcagcggcggtcgaggcgagccggtggtgatgttctgactgatccattcctggagcgtaagaggtaagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacgaatcagaatttactactcgggtacttttgcaattattaagagcagaaaatgaatttatcttatctctatgcttttgatttattccgaataatacttagcaccttgcgttactcggtccatccaacgagcccccgggtgctaggaatcggcccaaaggcagccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagttgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcaacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataagaaactcgacgcaacccctacctggcgcgccaactgtcgaaacatgatttcggcaataataaaagggggtagcgcacgagaactaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacaagatagaaaccttaaccaatacggtatcggtttcctaaatctggactttaggctgttccgtaatatacaaggaaacgtaacacccaagccatgatctgttacatattacatagatataagttatcccctataactagtcggataaccatgccgtgtgggtatggggtacccataatctccacagtggtcatgacgttggcgacttggcgtacagtcaaggacgcgcactacacatgattaagcatttaagctgatataaaactagccgccgtgggaacaattgccttagttaattctacatggacaacgatcgaatcagtcatccttcgattggtttagatatatatgaaaaccgatcgatcaacctatctctaatacacgtaacgcatatattgttgtcgaaaaagaagaagaagaagataacgtagtgtatccattctgaaccataaaaaaactaaatcctaaagataaatctagacacattatctagatacattaatagaatttggttttttatggagagagagagagagcacatagggttggaaattccggaacgaaatttccgcggtcatttcagacccctccgatactatattattttggttgaaatttttatttttttttaattttttccgtgaattttggtgatatttattcaagttcaactaaattttattcaaaattttggaaatttctaaaattttggcattccggtgagtccgatcaaatcggctaaaccgaaaggtttaaccctgcctgcggcgcacctacatgctacaggtgcaacacagcgatttcgtactctctccgtcctaaaatatagatagcaatgtactagatgtgacacatcttagtacaacgaatctggacagggtagaatgtatcacatctagtatatagttgttatattatgtatatagttgttatattttgagacggagggagtagttcgcaccactcgatggaagacatttcaaccggccagttccgctgttccgtgtcagtgaagataagctagtatagccagctagctagctctctccaaccctataattaccacccgaacgatctcgccaacaagcggccggcagctcgatcgatatatcacagccaacaagcggcagctcgatcgatcgatatatcacaatggttaggctcgccgtggacgccggccttggccgaggcttcgccggcggcggcggcggcggctccgtgcccgacatgagcaggagtgttgtcggcattgcgctggtcttcgtggcgaccgtagcgatcgtggcgttcgtcgtgtttaactgcgccgatggcatggatagctccggtggacggaagcggctcaccaatccaggaggcggtactgttggcgttggcgccgtctgtggaggtagtgcttgcggtggccccgcctgtggaggtggtggaggtggcggtggcggtggcggtggttgcggcggcggcggtggaggtggctgttaataaaggaacagagcatatggaggagagagatagcggtgtaggtgatggaatttcatgtcctttgatctacacaccagtttgattttgctttgcagtgtttttcatttacatcagtcgtgaaataacaaaccctttggtaattctgcttatgtatcattatgggcctattcactttgataccactttcaaccttactaaattttggtattgtcaaaattttgtgataattaccaaaatttgacagaaaactaaatgtagatattttttttggtaactttaccaaaatttgataatgttaaaaatgacatcaaagtgaatagacctcctatatatatataaacatcgtcttacgtgtttatatgtattatattaccaacaaacacccataaattcttttgaaacggtggcttccaaagaaggcgtattatttttaggtcagaatgggagtttagtgtaggtccggcctataattattgggccgaaacgggactcctatctacgtggtgctcatacaagttgggccagaatggattcccttccacttgtaggcttgcagcccatctttttgggctgggatggaattccgatcttcgtgcagcctagtagttaggccggcgtgcaggccattcttcttgggccagggcgtaacgaggagaactatcagaaaaggatgggccaggccgaccatctcatccttttcagcccatgttaaaaataatggtacagaacttcgtttcggccttgtttacggagataaatctgctctttcagcctgtaactgatctcagtaaacagtacaagcataactcgtgatgagtactgaatcttttacttcatttaaagtactgaatgcaatactagcttatgaagctggctactacacttaaaaatttctgatagttcctgcattacattacattgtatacttgtggagagcaacttcttgagtaaacaggggccactactaaaagcgatcaggaaggttagtcgtcgttccactatattgactaacttttgtaacacgagatactctgactaccttcatagtcaaataagggtccctttgattcgcaggataggaaaaacgcaggattagaaaaaacacaagatttgaagtggtaggattttgaaatcctcaggaagagaaaacagagaaaaacgtaagaagatccctttgatagaggcatagggaaaacaaaggaatctgcgcctagaagaattccaagaggtctgacctctttttttaagttacctttggaatccactcataggaatgcaatcatatggaatttatacttgcctttcctatgaatcaaagaggcttgaaggaaaaaattctttggaatctcattcctccaaaaatcctttgtcattccttaatactaattgtagttttacattgttaatgtttaacatttggttttcgttttatttgatttttttatgattagtatttttattgttattagatgataaaacatgtacacttttttaaatttttttaaataagacgaacggttaaacgttgaatatgaatatccacggctatatttattttacgacgaatgtaatagattgtgaaaaaatcatagctcctcgaggttgtccggttgagtattacttcttgtctcagtttgaatttatatatgatcagtttaattattggatgcattttgtgctgttaatttaaaaagatatatatatggacaatgtaagaacatgaggtgcaaattatttattgggtaaggccgtgtttaattagttgcaaagtttgaaccaaaaaacgtcacatctaacttttctacacacacaaacttataacttttccgtcacatcattccaatttcaataaaacttccaattttagcgtggaattaaatacaccctaaagatacttcgataggttaaggccttgtttagttcataatttttttttccaaaaacgtcacgtcgaatctttagacacatgcatgtagcattaaatatagataaaataaaaaactaattgcacagcttgcatagaaattgcgagacgaatcttttgagcctaattagtctatgattagccataagtgctacagtaaccgacatgtgctaatgacggattaattaggcttaataaattaatctcgtggtttccatgcgagttatgaaattagttgtcacaccccaatctggcaccgccgtataatggcacctgataggagcatgtcgtaggaaaaacggcgcaaaccgcttcctacgaaaccgcgatcacagtaccagtcccaggacatagcgctggtaccacggtgacaaatatgaatcattgcaatccttaaaataaatagatgacttctttaccttaacttaggttgcagctcagacagcccgagaatgcaaccgacgacacggacgaggagaacaccaacaacagcagcagcagcggaaccaacgaactaacacccaacaccacaggcgacggctgggaaccaggacgaaaccctattcttcacttcacttcatcttctctttaaggcagaggaactatatatatatatatttatatagagcaagggtgagtactttcgtactcagcaagtcacgagaatttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagagatgtttttcaatagctcatttggtaatgtaccgacctcccgggtcagatcattacttctcggctcccagagccattccacttgattaatcggttcccagagcctttttcattttctcggactcccagagtccagctgcccagtagcacaacaatccgcttccactcgggaagcctaatctatgatgcccatagacatcccgaattacacagattcgtttcttgaccactcaggtcgtccatctgccacataggctgattctggtaacgattcccacaccacaacaacttttcacaaagcataggcaaacaaatctacgctacaggaaacacctcacatccgcccatgaccgcgggcacggctgttcgaacagttagttaacctatgcagagggggtacactttacccacacgacattactaacccggatcacccagcccgtgagatcagccacgtcgggagaccttaaggctttcatgacaaggcatttggaaagccgacacaggttcaccatatgccaacgagaggggtcccagaccaacactagattaggtcccagaccatactgtgccaggaagcccgagggttctccccgacaccaccccgttgaatccacatgtctcttggcatcatggctcccccgattaactaattactcagccaggggcgtcccattgcacccgtgtggtcgcacttgttatatgctcggatgaatttcccacaggaatcggtacttatatgcgaatacgggacagtgccacacaagcacaacccccgcatcgcgagttttcacaatccattttattttccaacacaccgacgccacatgtcgggttttcaaggcttctcaaacccatttcccaagttttcgacaaacaacggtgtatgtgggatatttggtatatgcgctcagagagcacggataccgaggtaccacaaaggtggagcgacaaggaaatcagggtagtacaacctacaggaattagtgcgactactgggtaggtccgtcggtttggcacgcaaaccgaggccaagcaagttaagtgtgtgattctaataatgcaagttgcaaacaaaataataatgattttccaattataggagcaattggtcaaagggtgacttgccttgctcaaggtcttcacgaagcttcacgaatcttcgagaaaactcgcgatcgacgaaaatctggtaaccgtaactatacgcaaacaatcaaaaacctaaacaaaagaccaaaagaaagatcctatttagactaattagtactgccattaaatagatctcaattttatggaaatactggaagttgaacggagtcaatctgagctacggattgagagatatgaattttggaagtttaattggaatttctgggcaaaggaagatatttgtggaaaaggggaaattgatttatgaaatttatagaaataatattctcaagaatattattgaccgtcactgacgtgcgggaccaaggaaatgatttatggaattttgggaataaggaattgatttatgaaaaagggaaaaggatttattaatccctttggataagaaaaggaaggagggatgggatttagacttcctttggcggctcgggtacggcccaaggaataagcgcggcgcggccgagctaatgggccgggcgcgggcgcgaggaagcggcccatggccgggcaaggcgcggcccaagcgggtgggcgcgcggcccaagcgggtgggcgcgcgggaggagagagggggatgggtccgggtggaccggatccatcgtgccgggtcccgggacgggcccacgagtcagcgactcggcgcacgggggaagggttcatgcggcgcggggtgctagggttttgcggtcgcggctcacggcgtggcacgcgggtggaccaagaggtggagggcccatgcgaagcctaagggctctccgtggaccgcgcgcacagaagaaagggcggtgggggcggctgactaggtgcttgacccgatcaagcgggcccggggctgaggttgctgccacgtggtcggccacgcgggcaggggcgaaagggaaggaggaggaggcgcccgggatggacggcggatggcggcggagttcaccggagctcgtcgcgacgattcgagagagagggagtacatctgaacaatgggacggacgagagggagtgagccaccggatcggattcgccggagggaggccggcgacgacgaatcccggcggcgcttgccggcggcggcaaaagagggaaacgatgacgatgcgacgagagctcgattcctagggacttgagcatctacgcgacctcctgagttcatttctagagtcggattgggtggagctataccgaggaaggccggcgacgagcggctactaccgagtttgggcggcgatggcggcgagcctacggcgagcagcggcggcggtcgggacggtgccagcttgctattggaaggctactcgcactactacccagagctaaggagaggagagggagcgaggagggagaacgggagatgcactaccgagccgagacggacgctgtgacgagcggccgacgacgggggagcgagctcttcggcctcgggccggggaaggggaaggagacggcgcctggagtcccgcgtcagcttctcgcgcgcacgccggcttcaccagcacgagcgatggaggagggaggcgaggatggcggtagcaaggtggcaagggcacggtggtggcgagggaatgaacgagaggaagatagggaggctcggtttaatagatggcaatgtcggtttagggaggaagaaccgacattggcggtcaaggagagcgagctggcggtcatcgacgcgtgcagccaaggcggcgacaggtgatgacgccggcggtggtcgaggaaagggaaaaagaagggggaaaaagagaggctcgctccaagccgattcgggaagggagtaggagggagagggagagctcggcctccgggttttggcaggacgcgcgtggagcggctcaggcacgcgcgcggggccgtgcggctgcgtggtgcagcacggcagggcagcggggccgggcggcgcaggcgcggcagggccgacgcggcggcgaccgggcggtcggccatgcgcgagcgcgcgcgcgcggacgcgagggcgcgtccggattcaaacagcgacggcgggaaatcgacgccggggagagggagttcgacgagggagagagagagagaaacagagagaacgagagagagagagagagaaccgagagagaaggagaaacagagggagctcggctcggctcagcacgtgcaacgcacgtgcgaggctgagggaggagaaacggctgagggagggaggtgggctaagggggaatacggcccacaacacccgagggaggtaaaatagacttttgcagagaaaactgattaggagtagattcgaattcaaatttgatattcgaactcgagggtttagggatgtatcaagggaaactcaaggagaagtcatggaaaagattcaaaaggaatacttgggtatttgttcaagggagcatagggtgaggtcaaggaaatgattcggatgaggatcgatcctctcgaaatcgagagaaagatttggcaacgagttcaaggaagggagagattgacttccggaattaggatttggatgagatggaggagtcgccaacgggattcaaaaaaggggatttgaatctaaatttgatacttgtacacaagggttcaaggagacgagtaaggaaacaaagtgggagtttgatactttcgggaatgggaacaattatttggagaggattcaagggaagggattgactttcggaatttgatttcagagactcgaatcggaagaggaattttcgaggtggaggattttgatttcgatgagagggaacaacgggattaaattgagatccttggcacaacttagactcttacacaaagaacgaaaattttcgcaattaggatttttgccgaattagtttttaacgactcacgaaaagcggagcgttacattagttttttcattcgtgttcgaaaccccttccgatatccggtcaagcgtgcgatgtgatatctaaaaattttcttttcgccaagtgataattttcaaaagtgatcgagaccgtcaattgtcaaggtcaaacagcagcgttgtcgatcatgtcttggcgtacaagcaagcggtcagaattaaacggcgatcgagcacttggctggtttagttactaattttttttcctaaaaacatcacatctaatctttaaacacatgcatagagcattaaatatagataaaaataaaaaccacttgtacaatttacatagaaatcgcgagacgaatcttttcagcctaatttgtctataattagccataagtgctacagtaatccacatgtgttaatgatggattaattaggcttaaaagattcgtctcgcggtttacagacgagttataaaaattagtttttcattcgtgtccgaaaacccattctaatatccagtcaaacatttaatgtgacatctaaaaattttcttttcacaaacatttggatgggcctaacgactccgtcaccgtcctggcagtagcctagctcctcggcgaatcattcagcggatgggtgtcagtgcgtttcgccgtaatgatccacgtacgccggcgatgatgagcggttaacactgtggtcaacatgagccaatttctatcgacacaatgtacaattaatatatagtagttaacaaattaagtgcgtataatgttttggatgtagaagtagtttgtcccgatcggccaacgaagccaaatttcagtacatatcgagctaattattagttataaggtcaaacagcaacgtggtcatgacgttggcgacttggcgtacaatcaatgacgtatattgttctctcaaaaaaaaaaaaaggagataagaagataacgtaacgtaccattctgagctagattttttaaggcaatgatcctatatacatcctacaggctacaggtatactcaattagtcaaaaaaaaaaaaactaacctagaaagagatataatattgtacagattcgttgttctaggaggaatcatatatcctcttctaattattttttttgacagagtacaacgcagcaatttcgtagaaatagttcgtgccaccagatgaagatatttcaactggccagttccactgttccgtgtctgtgaaggccgtgtttagttaaaaagttttttttttcaaacttccaatatttctattacattaaaactttcttacacacacaaactttcaactttttcatcacatcgttacaattttaattaaacttttaattttggtgtgatctaaacacacagcctatatagacagctaagctagctagctagctccctccaaccctttaattaccacccgatctcactagcaagcggcagctcgatcgatatatcaccatgggtaggctcgccgtggacgccggccttggccgaggcttcaccgccgccgccggcggctccgtgcccgacgtgagcaggagtgttgtcggcatagcgctggtctttgtggcggccgtagcgatcgtggcgttcgtcgtgtttaactgcgccgatggctccggtggacggaggaggcgcaccggaggtggcggaggcggaggtggcggtggcggtggttgcggcggcggcggcggcggcggaggtggcggtggttgcggcggcggcggcggcagcggaggtggctgttaatgaagggaacagagcatggaggagagatatatagcggtgtaggtatatatatagcgttgtgtggaaacgatttcctatggaattcatgtcctttgatctatcccagtttgacgcatgttgctttgcactgtttttcatttgcatcaatcgtgaaataatgaacgctatggtaattttgcttatgtatcattgtatgtaaacatcttcttacatgtttatgtattatataacaatactttcttatgggtaaaatgtccatcctttactatacatgtgcttatttgaatatatgttatccaattgattaagacaaatattagagagtcccactacctatcgtgtgccacctaacgcgttgcccaaagcacctcgatccgctgacgatcaccgttgtcaccctagtcgctggctcgccgccctctatcgatagcatgaggggagtcgacatggtgcatggccctattcttttccgattaagattcagattttatctcaattttcattagcatattttttaaactactaaacggtatatgttatgtgaaaaattttctatatagaagttgctttaaaatatcaaatatatccatttgtcaagtttataataattaaaacttaattaattatatactaattatagccccatctcattttacgtacgtcaacttaatcttcatattcatccgtttcacatgtgcactgtattcttaggtgagtccgtgagggttgggaactctcacctccgacacgaaaacaacacaatggattagtacgtgattaattaattattagtttaaaaaacttaaaaaggatcaatatgaatttttagcaacttttctatagagttttcgtaaactataccctgtttagcagtttgtaaagtgtgcgcaagggaaataatagagtgaggttggaaacttactgaagaacgcagcccaaggctactacttttaggccagaatggaagtttagtatagtgcgggccataattattgggccgaaacgggactcccatctacgtggggaataagattcccgcccactcgcagcccatctttttttcggctgggatggaattcccatagtagttgggccggcgtgctggccattcttcttgggccaggcagcaacgagaacaatcagaaaaggattgtgggccaggccgaccatctcatcctttcggcccatgttgaaaatgatggtacagaacttcaattcgtccttgtttacggagataaatctgctctattagcctgtaactgatctcagtaaacagtacaagcataactcgtgatgagtactgaatcttttacttcttttgaagtacggaatgcaatatttagcttatgaagctggctactacacttaagaatttctgatagttcctgcattatattacattgtatacttgtggagggggagcaacttcttgagtaaacaggggccactactaaaggcgatctaacaaaagaaaagaagcaaaagctacaaagagacgtccctgcttccattgtacatgagccgccccagccgcgccgctcagctggaagccggcggcgagaaacttgagctccgactcgtatagctccgcggccgtcggcgttggacataggagaggatgaatctggattacgacccttctaggaggatgaatctggagtaagggtagtacatattcatccttctatgagggaacacatctccacataggaggggacacatcttctcttaggttaagtttttttttttggatggagagagtagcttctcgcggcgaatcatcagcagatgggtgtccgtgcgtttcgccgtaatgatccacgtatacggctcgtcgctcgcgattacaggtttattaacactgtgcgtggtcatcgtgagccaatttccatgaacacaatgtataattaatatatagttaacaaattaacactactacacgatagattttcccgtgcggtcgaatcggattttcgcgtacggagcttcggtccgtatggagcaaatcgcctgtgaaaatcgctatttttgcgcgcgggtggctcacccgcacgtgaaaatattcgcgtgcgggtgcttatgtcgcctgcaggcaaaaataaaaaatcgaaaaaaaaacaatattgaaatatacgaaacccttaccctagccgttgccgccgccgccgccctctcgtcgccgtcactgtggccggatccgccgtccgcaccgtcacccgttcccatcgccgttgccagatctgtgcggcggaggtccgccgccgttggatccgcgcagggggtggccgccactgctgtcgcgcgccacctcgtcgtcgccgccgccaccctcccgtcttcgtcatcgttgccgtagccgtggccggatccgccgtcgcccgctcccgtcgctgttgccagatctgtgcgacggaggtccgccgccactggatccgtgcgaggggtggccgccgccgccaccgttgcgcgccacctcatcatcatcgctgctgtctccgtagaggaggaaggccggggagggcggcggccgccagatcggcctggcgcctcctcatcggcccactgcccctgctcgcggtgagagagaaaaagatggggagaggaagggagaaatgagagaaagaggggggatgtgagagagagaagaggagaggatatgttgaaataaggataaggatgaaaattttgaagtgttgggagggaaaaaaattagagagaagggagagtattttcgcgtgcggtccacttaagaggttcgcacgcgaaaatcgatatttccgtacggtcttcttaagtcgactgcccgtgcggttagattaagatgcccacacgggaaaatgcattttctcgtacaggatacaacccggcgccggttcccctattttctcgtgcggttccacatacggattgcatgaaaataaaaggggacggcgtgcagaaaaatttatcatgtagtagtgtaagtgcatctcatgttttggatgtagaagtactttgtccccatcggccaacaaagcctaatttcagtagatatcgagctaattagcaataaggtcaaacagcaacgtggtcgtgacgttgtcgacatgacgtacaatcaaggacgcgcaatacagataattaagcatttaagctgatatgtaaaactagccgccgtgggaacaattgccaattagctaacttctagatggacaacgattgaatcagtcatccttagatatatatgaaaacctcccggtcaatcaagctatatatctgtaatacacgtaacgtatattgttctcgcaaagaaaaaaaggagacaagaaaataacgtaacgtaccattctgagctagatttctcaaggcaatgatcctatatacatcctgcatgcaggttacaggtatactctatttataaaaaaaaaaaaacaatctagaaagaggtgtgatattcttcagattcattatactagaaagagagaatcatgtattctctcctaagttctttttcttttgagatggagtataacgtagcaatttcgtagaaatagttagctcaccactcgatgaagatatttcaacttgacagttccgctgttccgtgtccgtttcacctggagtagtatatatatatagacagctaagctattagctccctccaaccctttaattaccacccgatctcaccaacaagcggggcagctcgatcttgatatatatatatggtcaggctcgccgtggacgcaggcttcgccgccgccggcggctccatgcccgacgtgagcaggagtgttgtcggcatagctctggtcttcgtggcggccgtagcgatcgtggcgttcgtcgtgtttaactgcgccgatggcaagggcagctccggtggacggaagcggcccagctatggaggaggtggcgggtgtggaggcggtggaggtggctgtggcggcggcggcgggtgtggcggcggcggaggtggctgtggcggcggcggaggtggctgttaataaaggaacagagcatggaggagagggcgtgttgtggaaacgatatttcctatggaatttcatgccctctgatctacacaccagtttgattttgctttgcagtgtttttcatttacatcagtcgtggaataagaataataaacacattggtagttttgcttatgtgtcactatatgtaaacatcctcttacatgtttatgtattatattagcaaaaactacctatactttcttatgggtaaaatgtactttattatacatatactactcccttcgtttcggttacaagacgttttgactttggtcaatatcaaattgtttcatgtttgactaaatttatagagaaatataataatatttataatattaaattagtttcatcaaatcaataattaaatatattttacttttttttacaaacttagtcaaatttaagacagtttaactttgaccgaagtcaaaactcattgtaacctgaaacagaggaagtacttatttgaatatatgttatccaattgattaagacaaattctagagtgtcccactacttatcgtgtgccacctcgcgctgcccaaagcacctaggcccggtgacgatcgtcgttgtcaccctagtcaccctacttatcgacagcctgaggggagttgacgtggacacttcgtgcatggcactattccattcttttctgattaagattcaaattttatctcagttttctgattaagatttagattttatcttattttacattagtatattttttaaactattaaactatacgttttgggcggaaacttttcaagttgttttaaaatattaaatatatccatttatcaagtttataataattaaaatttaattaattatatactaatagcgctctctcattttacatacgacaacttaatcttcgtagtcatccgtttcacaagtgcgctcggaaatcttcatattcacatgtgaacacatgtgtacttggaggttgatacggttgcttagaaggctattatctttaggccagaatagaagtttagtgtaggtgcagcccataatagggccgaaacgggactcccatctacgtagatgataagattcccgcccacttgcagcccatctttttttcggctgggatggaattcccatagtagttgggccggcctgcaggccagtagttgggccggcctgaaggccattcttcttgggccagggcgcaacgagaactatcaaaaaaggattgtgggtcaggccgaccatctcatccttttcggcccatgatgaaaatattggtacagaactttgtttcgtccttttttacggagataatgctccatcagcctgtaacagatctcagcaacgtaaacagtactctctccgttttacaatgtaaatcattctaacattttccaaatttatgttgatgttaataaatttagacatatatatctatttagattcattaatattaatataaatataaaaaatgttaatattgtgaaacggagaaagtacaagcataactcgtgatgagtactgattttttttacttcttttaaagtactgaatgaaatatttagggggtgtttgaaaactaggaactaaactttatggaaaatgttacaaaaacttatattgtttagttcctgcagtacatttcattgtatacttgtggagggagagcaacttcttgagtaaacaggggccgctaccaaaggcgatctaacaaaagaaaagaagcaaaagctacaaagagacgtccctgcttccattgtacatgggctaagctatcatggcacttgcagaatcatgtcagtagaaagaaaagctcaaaagaagctgagcggcaaacaaagctcagcgatgacaaaagcacaagaaaacaaagctacaaaagggtaaaagggcagtaaaataaaacaatatgcttgcgctgcatcgttttgttagcagagtcttctcctcctgtctctgacctgtcagtatctctctcctgcatactgcttcctactatgtttgcatcatactttatcatcataccactactactacattacctctcttttcccctgctctttatgtttgttgttgttgttgttgtgtgagaatgaactatgtcagtcttgatcctcatcacctctgatcagggatcaggctcttcatcctttttgcctgcaaagtgccacctccccaaatcattccatcccaaagattggtgtctgaaaggctgcaacatttgggtagtatccaaaggtgcctgctgctgtcatggagctttcatatgacccactgaaagctatgggtgttgcaaacggaatggagccgcagctgttgttggagctttgtgactgatcatcctgttgatcttgctgctgctcctgctgatgctggtgctgatgttgctgctgctgctcatgtaatgagacattggtgtagcaatttgacatggctccattgccattggcatttgcgaaatccaggtttacacctgagctgtagagaccgaagcctagcccctgaaggtttccttgctggtgatgctgcaatgcgaggtatgacaggtaatctgcctgatcatacttcattggaagagctgtgaacgcaagcgtcgacggtggcgcgacgccggtgtggttcgcttcggtggcggcgatggcgtcggcggagctcgacggagcgagctctaggccggccttggtgctccggttgccggccatgctcccgattggaaggttgctactgattatgctctccacgttataccggccgatctcaaagttggtgacagcattcaggccacggaacttgatcgccgcgatgtcataagcttctgcagcttcctcctcagtgcctgaaagaaggaagcaagcaacaatcagctgttgaacaccacacatatgcagaagaacgatgcgttattgtcaattttatttaggtacttgaagtaaaatcaacaccacctgtaaattactaatggctgaatagtaatgtcacatgaaacatatttgaattagctaattgtacttaacaaagtatggcatcatagtgcagtgagccttccagtaagtttatagataaccagcaagttgcaccagtaagactttggaccaagcaacaactgacgaaactgtagcccagtgtggtgatcaagcttagttaaatccaacatagtacaataataatggccggttcagcaaggcagtagtaaattaatcaccaatcacatgctttgtggaaagccgagcgcggtaatagcagtaataatgatattccaaacacgggctgctacatgcagtgaacgaagaaaggcagtagtgttcaggtttgcaaatcaatcagccatagatatatacatgcgtccatggtctaagcatggtgtgtcttcttttttccttgcctgctgcataaagccccaaaaccatcatgcatggcgcgcaaaagatgacaaatttcgaatcaaatgtgggcatgcttacatcttggtcaaagtagatgtttttgacctgcataaaatatgtcgacgaatctagctacaagccctgtgtgtgcaaagcataaattaagatggaacctacgtgcaagggcttaatattgtaatgttgagtgtaagaaaatgactaatgctagctaatgaggggcccaacacgtgcatgcaccctcctacttgcaatttcatctttgataaaagaaagttctaatgacaaagattatgtatagcttagcgtcgagaaaactcttgagcattcttctacatgatgagcacactgacattgcattgtcagtagatccactagtattagaaaacattagtatgaaagtagtattgcctacatgcatgaaagtattgcctacatgcgtgttttctgcaaacatcacccagatataattagtcaaatgttgagaggttttgttgggttattgatatcattttttcttatcaggtcatacatttgttgaagaagagggcaacaaaaaaaggcttaacaaatttctgctaaacaaaaaaaatgaacatggacgacagattcaacatggaaattaatgtacaaacttaattaccgaatgttccgaggtagagatccttgttgccagccactcttccgatccttgcttgccatcgcccatgctggtgatgtctacatggttgcatcacacaaaacatcagttacctgagacttacgtgcaagaggccaaacatggctagctaggctacaagtgaaagattagtacaagaccaatatatatatgaaccttgtaacacccctgtatatagaagcaccacgagagaatccactgctcttcctgcatgcaccagtacaagtttttcatcaagctgacatgaacaaataaattaacaaagctacatacatacatataaaaaaacaggtgatcatgatgaaacatgcatgcatagaatggctttgcatgggagcatatatactttgatgaatggccatgcatggaatatcacaacatataattaaacattgctaaagagtgatcattagcttgtacctcctaagtgaagctacaaactcctggcgtgtcatatgcttcatctcctcaagctccttttcgtactcggcaacctgaaagattataaacagcttgccccataaagatacatcaaccaaaaacacacacacatatacgcatgatgcacatgcttttactacacacttgcatcaatcaggagctatatattttgatcatgcatgcattgtaaatatgtaataaatccatctttatatatatgcatgagagttaattaccggaaagttggttgtggtgctaggaccccagtacttcaacgcggcaagatcatacgccctcgccgctttctcctccttatcatagccacctgtaaaatcatcgaacaaactctctgcatcattcaccttaaaatgttccaaacgatgcaaagttacaatagctgctactactagctagtagctggccaagagactagatgcatgtgtcttttcttacccaagtacactgtagatcgaagacaccagaaacatcagccataaatgagaagaagcattgccaacaagtcgacagaacaaaaaagaaaatcgaagttagctggatgcacttatgagattagatgcaaatagctagcaaaatgcagtagtaaaattattgagtagtgaccttggcgtcccttgcggctctggccctcacgccggcagctgttatcccacagatgcgcctcgtaccttccggtccaccgatgcctatacataaccaaggattttttatgccctaattaaaatctctgaacaaatattggtcatttgattcttctactcccattaacaaaaaaaactactactaaatcctattaatacgatcgatgatgcatgtgaatctatatatgaaggatgcacacgaacacgagatgattagtttgcgtgcaagaaattagacgagctagctaagaatttatttttagattttatggccgacacatgcatagactgatcgatctcagcttagcttagctatagcttaccgtgtgacgccgcggtagatagacgttctctgcccgaacgagtccaccgccttcttctgctccggcggcggcgccaccgcggcctgcggcggcaaggccagctgcttcgtctcgtcggtctgctctagagcagccgccggcaacagcgcgggcaccggcggcgccgccccagccgcgccgctcagctggaagccggcggcgagaaacttgagctccgactcgtacagctcggcggccgtcggcgccgtcgtctggaccggcgggcaagcgccaccgcttgatcccccgttgcagccgccgccgaggaagtcctccagtttcggcggcggagccgccccggctatcgcggccagctcggccgccgcgcccctctcctcctcctccatttcacctgcacaaacacacacacataccaacgcataagcacggcacttactccaaaaaatgaccaagaacacacacacatgtgatcgatgaacagacaacgaagtagaatgagtactaacagtggtgggcgagggagaagttgagccatggatagtggtgcgaggtgtccatgtccatggtaaggtaacaacgagagcttgtcgatcgaggcgagtatttttctgcgagctactagtagcagatagaagaagaagaagcagcagcagcagctaggtgaaggtgaagatgaagagagcaggaatggggcggtggatggtgataaaatagaggaaagagaagacacgacgacgcactgtagtctgtagagagagagagagaggggcgccgcacaggcaacgaggcgcggtatatttatatgagggtttcgaggaggcgccatgtatgtagagagagagagagagatgctttttactagtactactattccatggctttgaaagcttggccgctagtaggagaggagaggagaggagaggtgtggtggcagcggtgaagaggtggcgttttacaggtggagggcagggtgcggtcggcgccggcggtatccttgaccgccttggaagcaaagttgcattgcaggcaggggcaatgctcgcttcaaatctggatggatggataggcttggttctgcatgcccggccgctcatgaagataggtcaccctagaacaatcacgccgagttgatgtttacttggtaagagtacgtacaatagcatactttaaaccagctataaatatatatagagagaagatgaaaaaaagatagagataaacagtaggctacacatttatagctttatttaaggtaagagtatgtacagtagcagactataagccagctataaacatatatcgagaatatgaaagaagagagatgaacaacggtctataaatttatagccagctgcaacacaagttgtgggaccggatattaataggtagtatatatttataggtaactaatatatgaattggctattaaattgattatatatgatttggaggtagtagttggctatactccctccgttaaaaattattagtatttttgaaattcgacacagttttcgagataccattttgactagcaatatctatagaagtaagatgttttaaataaaaaagttatatatattatgatgctactttgacttagcaatatcatttttacatgttttatcatttttatttttttaatagttaaagttaaaaattttgacttggcactattttaaaaatgtttatattttgaaacggagcgagacagggagtacgtaattttctgaccgcacatatctatgttgagattagttgttttagaatagatctcgtcatcctagattataacattttataatgaagatgatataatttctatttgtatagatcgtttagattttcctaatcatttactagcaacatactatgaatctaaaatatgctctttgtcaagatttcttttactatgaaatgttccatataagattttcttggatagagggaagtaccattttcaacctaaattgccagaatatcccatataagtactgacaacccatcaaaataaagaaaataaccataacatttgtgtggtgtagagtgctgatgttataacatcgttataaagtatttaaattagttacttactattttaaatatctacttaaatatcatttaaatttgtaatataaaaaaatatttgcttctcattgttaatgtgatattttccaatgtgttcaattccgataattatgtttccatatttctcaatgtaattttgttgccattgcaatcgtaggaccaacattattttcgtctctgactataccatttcgattttctttccaagaaaaaatatatatttttggaaatggtttgaacatttttcccatgttgaccattttcatcctattatatattaccctccttgttttacatcctaattaatgttattaatcaaggactgatatttctccaatcttagaagtgttttgtactccggaatgcaaaaattaaagactactccgaccctcccccaacttttttttttgctgaattttattttttaactgtatacaaataaatttcttttttttactggcagcaccatatggtagcgcaccgaaaaatttcaacaacgaaccgctgaaattatgttccaaaatcattaacattttgcaccatatgatccgaccgacttacatcgctacaggtgtgtctaatttagatattgtagataattttaaaaacctctaaagagacaagtacatttatgtatttaattatgtatgcgcattgaccctagtatatttgtatcctgtcccctcaagaacagtacgaccacaaaaacatgatgtagtggagcaaactttgtagtcgtgcaaacaaccggtaaatatatgacaaaaatggtgcggagatggagcagaaatgggagggggttttatgcacggcacggaggaagcagccaccgatgacaggaaacgacgtgtacgtgtacaccattgcgtcttttcctcgctcgctatctacctcagctaagagaaagtttagaaagtttaatactattatatctaactaataactcaaaatcatctataatcaatttaatagtcaatacatataatagttacctataaaaaaatactatatggtctcacttgtcatacacattgcatcttagagtcacccatgggcgaagctataacgaaatgaagggggtgtcacttgtttaatttaatttactttatatcgagtttaagttgatacatgtttctaaatttatattgagagggtgcacacatgataaaaataggtaaggtttagttacaaattttttttcaccggctcatgggaagactctaactccgcctctggaatcacctgtcatacacctggtctcttcttttctttttatctcctcgatacatgttcatagttggctattgaacctactctaatcgtgcgacgacaatcgatggagcatggagctgacggagtaggccagtaccttggccgccgccaccgccgccgtgtagggtgtcgccacgtttcgccgccgcccgccacgcctgcactgcatgcactagctgctgctggttggcttcacacggcggcgacgaccgttcgccgtatcatcttactccaaggcttcaaagggtacggagaggctggtcgatcgatcggcaccctccgatcgttgcacggatcgatcggacgttcaggattcctcgagcagggctggatgacgtgtactgtagtgatgccatggacacgccggatcgatcccttcacgtcggcagggaggcagcacgtgagagaggcgtgcaaccgtaccggcgggtcgaccggccggagctagcggctctgcgacgcgtgcaccccggcgcacgtgcgccgtccgtgccggtcgtcgttgggggagaaggggaatctggtcaaaatatccatacatcgcacgagtagtaggactactcatcaccgggcaggtcgggggaagaagaagatggtgggcatcacgtggacatgcccatttttactggtttttcaattcagaatggcatgcaattcgctatggccccacggttgcgttacgtttcacattcgtgttcggttcaacggcgctgtcgatcgatcgatcggcgaaaaactgcgctgtgagtgccacgctgaaagtctgaactctgaactgaagagcggcttcattctgagttacaggtaaaagaattgctgggacgacaaaagtactcagtcagatgcggttggtagggaagtaagtacagtcaaattaatctacacacttgtttataacgatttgatttgatgagaagcgaggcacttcgccgaatagttttttgtctctgaacctccaacgctatgtcactctgaagaacagatctaaattcagttgtggcaatgaatcagacgattgcctaagaagttgacatatctaaccttagccatggtaaattgaagataacaaccaaacagtccttcggtccctgtgtcttattcaggaaagaattgtttttcatacatatgcaatacaactggagagatcgcagccagtaaccatagcgatgctactccatattgtctacaacccaacaacctaaacaatgtgtcctacggataaccacggatcctcttacccattgggacacgcagcacgtcatcaaagtgaaccaaacaggatagggacgacgacgaagaagaactaaagctaaggttagtacttaacacacatgctgccctacggccatctcattgcggtcgataatgaggttgttgatgatcgaattggttaattaagcagtacgcgagtgattctaaaggaaacacaccagacacctatagctcagctcagctcagcttgaattgatattagcttagctacctttctttgcttccggtgctaaccaagaggcttaaactaagcctgatttgccagaaagttcaacgtctgcacgtgcctggcacaactttttttctctccttggtgttctaggtgcaaaggctaagcttggttcgtaactccttacgtcgtctcaatcccctccagaaaagatgagacattttgtatacatctgctaggcaaattataatctatctgatgtatgttctgacgtgttcaatggtagtatatctgttcagatatggtccatatggacgtgtagatctgtcagtggaagcactgcactatttgtatatgtctacgtagaatatgccgtatctagtacagctgctgctgctgctactactactaccctttgcaaagttgggatcgtctgctagctctgacgaaacctgcagcgggaagagcaggttgtaatgcaagctgcttgcagctgatttccaagtttgcaactgctaaaacatgcagcatgttagcaagtaggaaggtgccatattttgcatgattagttggttggtcttcggcagaatcttgattaatactctaattgccactagcatgaagctgggagccaaatgaacatgaagtggccgttgtatctgaagacgtaagtacgtaggccgaccggccgagattgacagtcaaagatggtacagtgattttgttataaactgattgccgttgaccatataataatatgtgtgtgtgtgtgtgtgcgcatatcgtgcatgcccggcgattagtgtgcagcacgttaatttcctgcagctcggtgctaagcttcacatgtctgaagaaaagaaagacagaaagaagtgtgatgagaaggtggcacatgcagaggcgacgtggctgcttcttgtcacactcgccggccaaccggcgacagcatcgtcacctccatattgcagctaacttctcggagtgtcaccatgcatagtcagcaaatgctacattttcctatgcactaccaagtcactagccatagcaatgcatatttgttattatcaagagaaaaaaacgatgcattttgttttgatattgaagtgattgagacaaaggtgtccctatcaaatcgagactgactgtactatcctatctcaggacttgagttaggtcgtgtttggatccagggatttaactttagtctctatatttagacactaatttaaagtattaaatatagactacttacaaaactaattacataaatgaaaactaatttgcgagacaaattttttaagcctaattaatttataattagagaatgtttactgtagcatcacataggctaatcatggattaattaggctcaatagattcgtctcgcgaattagtctaagattatggatgagctttattaatagtctacgtttaatatttttacttagtatccaaacattcgatgtgatagggaattaaaagtttagtcccatctaaacagggtcttagttttgtggatttgtggagcagtagatccgatgcctcaccatcagagcatcatgactgtgttgtcggttgcagttattctgttcaattttctcagcattttgcagtgattttttcaaccaaatggacaagatctcagtgacggtgcgtgtgggtgacactgatcaagttggtggttttcgcgaaatctgatcggcgaaaacgaccaagctgctatgctatctctgacgaaaaatcacggagacaagtgggcatgtatgttttggccgtgctgacgtagacaagcacaaaggaaagaggcacaaattattgcgactaattatctacttgcttatagaaaataaatatttaaacaaataagctaaacaaagtggatcttagcaatatggtaggagaaagcttttaagaaaatataatttttgaagagtagagcaaataatccattccaataattcaggatggcaaaacaacagtggtagctacttaaagcatatgttttaattcataaaccagatgcaaaattggcttggtgttctttcaatgtatacacgatataatctgattgtctcatactgtatgatgtatccctcttactacaaactgaagggacagggccaactttcaggttctacaaatctacaacaggtacttattctttcaatcatccatataataataataaatatcggaaccatgttagatgtcaaagaattacaccgacttttaactccaattttctaagcaacggcacgcttcgttctgaaaaactcacgattggattggcatgcaccatggccttacaggcaaatccgactcttgacaccttcacttctacaaagctagagcgagctatttctgataattctgatggtgtcaccatacgtcacggaggtacctgccgtccatctgtaggctctttacatagctctcggttttggagctatccaaagatccctgaaacaaggtgcaaaatgtaagtgttaggagcaggaaaatacatgactaattcgacatctctcaatcgataaataataaagatattgatgagacaaagtgtctctctgtctacctgctcttgaacaattgtatgaagagctctgtgtacgtctcttgccatacccttggcatcaccgcacacatatatgtaaccaccttgtgagacgatgttccaaatttctgtggcctgatatcagcagaaaacctcattgagtatagccatgtgtggggaaattctgtatagaagttcaagaaaagcagcatagtgcggtagaaatgtggagcgtgtatcgaactaaccttctctgtcatcttatgctgcacgtattctttggctggtccttcacgagagaaggcaacaatcagctcagaaagtgcaccctcctgaatgaagttttgcaactcgtcttcatatatgtagtcctgcaggttggtcattcagatgaggtccagtaagagcaacatgatcataatatgtatctcatgaactatcttttgatgcataccatattacggttcctgcatccaaagaagagaactgaattgcccagttcaactccagattgttttagagctaatctttcctgagcaagcataaataacagataaagttactagggccatctcaaatccaaagtaaacagaaatgaagatttgggaaaacaaacctgca

SEQ ID NO: 61934 - DNA, 932 bp, Oryza sativa
aatttggagtgaattttgagggttttttatcgaagtggatttttcagcctttgcttttagatcgctaagaacgaacatacatacgtacatatatatatatatatatatatatatatatatatatataggggggcgggcgcgcgcgcgggcgcgctgtctctctccctgtctaatgagccagagagagtgacagggactcacgcgcacacactcacgctttcacacacacacacacacagagtctgaacggaaccggagcgtgtgtgtgtgagagtgtgagtgtgtgtgtgtgagagcgtgacatagagacagagacgtatatatacatggagagagagatagagagagagagagatggagagggagatatgtatgtgtgtgtatgtgtatgtgtgagtgagggatacacacacacacacacacacgcgcaaacaaagagtgagagtgtgagtgagagagaatgtgggagagtgacgggggcgcgcggtctgagggacacatatatagatatatatatatatatatatatatatatatatatatatatatatatatatatatatatatatatatatatatatatatatatatgccactcatatggggcgccagggtgcccgggcaccatggtatctcatgcacacaatcactcacatttttcaaaatttttaaattgtgagtatatacctaattataataatttgattcatacatatacttatcagcaaaacaactcaaatttctctttctttcacaatccatgattacatacctatctaattatatgtatggatgctatagacctagaatcaaactctaacaaaaacaagttcaaattcagttcaaacttgctttaaattagttagtaaagtagttaatgttaatacctaagtaattgaaaaagtttcatactcttttgaattgggtatata

SEQ ID NO: 61935 - DNA, 1810 bp, Oryza sativa
  unsure (1)..(1810): unsure at all n locations
tagtgtgaagttgtaccacatatccgtttacatccccctctcctggcctgtttttgctcttctagcgagggtccctttgaaatacaaggaaaaacaaaggaaccatttaggaatcactaggaatgagcaaaggacaaatgtgggatattcttctttccctgcgattatagaggaaaatgggtaggaaatttaacgtccactccaacatcatggtgaaggcaaatcatctagttgttacagacttgttcgttgatttattgtagacatctgacacaatttacaccaataatataatctagaggaatttacatgttttttctacaaccaaataaatgcatagttctacaaaattcccatgttttttcaatagtttatttcacatatctgttcctatcttattcctttgtttttcctaattttatataaaagtcttgtgtttcaaatgagccaaattatgtaattttgtacatattaatagtttctctctacatataaactttccgaaacatgtatagtgatgcgccgaacgcatatagcactatagaaaaaggcttttcccaggcggccaaatcatattttcgcaggcggacaagccatccgcctacacctcaacgcctgcgaaaatagttgatttttgcaggcgggcaacacatccgactgcgaaaatagcttcgagtgctaaaagaaaaatgggcagccaccgccggacggcggtagcttcccgttcccaatccattcccgaatcaccgaatcaattgtggcaaagaaagcaaataaagacattcaaaaaaatcacggccgccgcctagccgtcgtccgtcgccgccgctgcatgtccgcgccacgccgtcgtccgccgctgcatgtccgccgccgccgcacggctgtggcccgccgtcgtccgcgccgccgccgctgctgcctcaacccccctcgccgctgtggccgcgccgcctcgtccctcctcgccaccaccgctcgccgccgtgctcctcccgcccccctgcggccagatctgggagggaggggccgggagccgcctgatatcgttatctacagcccattttggacagatctaagagggagggcgcgatatccgtactccctggtcttaaccctaactgggtttaaatagcattgggaaaaagcgggaaaagatctttattcccggttggagagaacccccgggagcaaaagccaggttcccggccggatgtctttctcctccccccttaaagcattatttggaatttaatattcgccggggcgggccgcttttccttgtcttaccttcccttataactatttggtccgcgccgcggctttttggctatttcctttcctcttcctttaggcagggaatctctccatctgacactctcagacgtaattttatatgtggtacctgtgccatgtcctttgtattcggtactcgtctttttttctgttctcttcgtacaatgctttgtgttgctccaacctcccccctctgccttacatatgctttatcttcccactttcctcaaataaatttctttcgttacctttantctctctccctggccttcatattcatcccgtgcgtttctctcctaatcttgttattttctatctctgctttgctttaatatcataagccttttattccctccttactattataacctgttcgtccgcagatcctaacctcgttacttctctattacctctcctctaattgctcttttatttatctgttactatctcctaatctgcctctatcctttctttagtatctttcttcatttttctctctttctcacatagtccg

SEQ ID NO: 61936 - DNA, 6797 bp, Oryza sativa
ttgacgctttttcatggccaacacaaaatcacctaacgatttgcggtgtatgtaatcaacagagtcgccaaaatcgatagatcaaaatcggctagtgaaaccgatttcgagattaattcactttcgcggaatcaagcgactaatttacaagcaaattagtaaagaggataactatcgcacttacgtgatgatgaacgactagtttccgagcaaactagcaaaggataacctcctcgctttcgtggagaagcacgaccgtttttcagcgcaaaacggcaaagattaaccaaattctagggttgacagaactcagccatgaaaacaaaatagaataacaagaatgtaaagaagaggaaaatagtagattgaaattgtttggggggttctcaaactgatctaataccccactatatataggggcacctaaccaccggatgtgtaaatcctacattcatggaaactcttaattaacaaatcagctgctaccaaaaatgtatattccatagctgactttaccgcatagtcgcataatccagtccgcacacacgattctgccttggttgcagagccaagcagcagtgtacgtaagtgcatcaatttccatcgcttgtccagcacagcagctctcaacaaactgaaatacatatttcctcgctgcactccatcatgccatcaacccatcaactgatccatacatatcccaatgccagattaaatactatgatcacccaatgttttgcaagcatgatctagccgatgcaccgaagatccataagccaaattataccacaaacactaaaaaggttaaaaaaaataattaaaaaccgggtaatagtgtcctcgtcgcagaaggagcgagtccccttcatcatcggcagcatggcctccggtgccgccatggcagcggcagcgagaacgtcagcggacgcagtcgcgtcgtcgtgacgatgacatgggctacgcgcgccgggcagaaactgactcctgcactgcacatcgtggttgtgatgaggaggtaggggatctcacacatgagctagctccttcgtgatctcggcgatggacacgcttcgtctttcccggcgcccccacgatcgagccagagatgcaggagtacgttggcctgcatggcccctgaaagggggcttttaacttaggcctgatatgcgtgtgactcctgaaagcccactttggcctgatagcagagtataatcaggagttgggtacccacgggccacggacactttcacagtcctactcggtccttgactccttatatatgttttacggaattgctaaatggccttcaaccaaaaaaaatcgagaggatttcttacagcttttaaaccaccccatttgcttgaacattcgtgcgtccaacttcttctccagctccagcgatcgttacctgacgagttaggatatagggtttagggtggggtgaattaggggatggtgagttcagattggagtactaattagttagtaatgattttggcaatcatttttcctgacttcgcccctcatttgtttggaggagacgtagggttcatccattgttaacaacctgtcaatgtagcgtcaccattgacaacttgctaagagagcaccaacgtgaaaggatcttattgttgaggcttcaaccgatgggaactagtggtggactagctctatggaattgtgtgcgtatgaaaaaaaaatataatctggaggtttctcacagtcaccggaacatgatggagggaggagtgggcgggggaatgaatgtggtgagcaatgagaatccaaggataaatatgcaaacaatgtgagggtttttataaaaaaattcctatgcggaatttgtgtgcttcaatctaggctgcaagatctcttatcggcaagattatggaacaactttgtttggattgctaccattcttagcgatataatctataaataaaatcccttcatttgggaggaattttaccatccagcaagctgaagcggtaccaaatctaggtcattggctagtccaaatcgaacggttcatagaactcgatactgccaggtaccaatttaggctttgggatggtaccgtagaataaaagagacgtagaagggcaggttcatattttcacgttgcaaattttgctggttcaatctaaggttgatggaggataaggcaaaatcccgagcgccgccgccactctcatcgtggaatcgctgcattaccgtcgcctcgtccccgcacgagctatgccctcccctgtcctgctacttggttgtgcctccaccttcattggctgcccacgtccaccgttgtccactcggggcttgccgcctctaggggagacctcctccctgccagcgagccggaggccgtgatgggtggcagtctcgccatatcccctcactgtcgtccaagtccaaatccttgcctcgtctagatctcccgacctcctcctcctcctccctcctcccctccgctatacagcgcaggcggcgaccgtgggagtaggagacagcgacaggccttctccgcccatcttcaatttgtttccaatcttgcccctagtaattcaatggttggatttcatttagtacctgatagtactagtacctcgaggtactatctgctggacagtaacaaacctcttcatttggactgccaccacttaccagcactccaggagcaacagtcattcttttcccaaacagacccctactactcgttatttctgcttcatatctaatcagatccgggatcgcatgcctcatgtcagctttgtttcggtgtggcacatatcaagctatcactgcgtgatcctgcctaagtgcttcatcgcactctcgatccatgatcatatcaagacatgacgctactgcaaaaaataattttaatgaacactcccttttgttttttacaagcgcactaaaaaagacacgcctaagcaaatgtacttgcgtgaccgatcaagtcccgtccataaaaatcgtttttcacatactgacttcttattagggttgtttgcaaaaatgtgttagttttcaagcgggccccttaatagcttgtgaaaaagcgatgatttatcttcgtctcgagtccccgcatgcattgaccgcacgtaggatgttcctctcctccttaccctcctttttctctcctcatccttcctcctctccaccctccacttttcccttctctcagctctgtccctcactgcacgtgcgatggagggggcgattagatccgatgagcggtggtggaggcgatggcatatctgcctgcgcggtgaagaaggtgggcggatccgatgcacatgatggtggaggaggcggcatatccgacatgtgcggcctcgtgatgacggatccagctacgacgcccttgtgatagccggatccagtggcggcggccttaggataggcggatccgccatcgtcggtcattggagccacggatccacatgcagtgtatgcggggagtcaaggcaacaacaacctcgactttggccgtgggatgacagccacaaggacgacggtggcgacttcacgatgaccgattttctggatttgtttttcaattatttttttgaaaatgtctttgcattcagtgtcctaacttaggtacttgcaaaaaaaaaagaggttttcacaagcagcgtcattaggagggccacctacgaaactatgttttcgtgtgtagttatgatgcccgcgtatgaaaataccgatttttacaaacactagttagatgggtatgtacgatccatctgcccgtgaaaatgagttttggccgtctgcgaagaaaaactgaaaagaaaagagcatcaatataatcgacaagtaccacttgtttccgtagtatgatttgcaaaggatattatattaaaggtggacgtgatatttctttccaaactaaaaggttcatatacgtatacgtgattaattggacgggtctgtccggatcgataagcggctcatgatgactcacccactgtcctttttatagtgcaacaagtgtaataaggccaagcgaatgcgaatctctcgtgcttctcctgttcttaaggacgatggcaccatactccatgcatgcacatagcaagttgctagctagcgatcatcttatatatgtacgcggtgattattgttgttacaaagctccaagtctttggatccacccatgcgtgattgtctatactcccaacgtacgtgtttaaatatatataatggtgttaattttattatgtcaaacttttgaaacttggtaataagtggttgtagcttctattgaagtaaagaccagatattatccattatcttaaaaaataacttttgaaactttgactattaattcttgaaatgtttagttgaaacataaatcgtatggtaggtttttctttacaagtactttcacaattctataattttgttagatattatcattatattgtataaaaaatagaatagtggccaaagttatataccaaacaccgaaaaaaaaatcaacaatgttgtatgttttaaatagagaggtactactacttcgtcctccctaaaatacaacgtgtcctagttttgatcaggaaatatatatatcaacatttaaaatttttgactaataattgaatcgttagatttgtctttgaaaatattctcacatgatattaattttgtagttattcatataacatagtatgaaaataaatcaaagagatcaatgttagagaccgtaaagaaaactaactaatgtcataacttttattttagaaactgggggagtacttgataacaccgtatcatggcgctcgtgtgccacgatttttagtttaatagtgcaaggtaccaattaattgcagttgcactaattggcaggagttctgtatatatttaattaacaagtggagataaaaattttgaaccgatgtatctctttccaaaaaaaaaaaaactatgatcgatgcaaacttgtgtcaataataaaagtggtggccctccaagcatttggacgttgagactagtttatatctcgtcatgtgaggctcctgctagttaaaagttagtaaaattgtgaggacaatattgtgtccttcaatttacaggtttatgcagagtgcacatatatatatacccaccatgcattgaccatttcgttctgtatatatctatctctctgccgcctcaaagtcgatatgatgtgtgctgtgtgcagtaattcagtatctgcagagaagcattgcaaaatatatatagtgtgctaagtatttctaaagatatggttattaggagaccttttagaacataaaaattaaaatggatgttattactttgtcagcaagagatatctacttctaatttataaattgggtactctccttagatataatttgtctgaaaaataatactccttccatccacaaaagttagacatatttcacatttgagttttttcaaataattaagttgattttatttgtagtctttatgtatttaaaacttaaatgaaaatataaattaaatgcttgagaacctaagaagtcatctaaatactcgatcattggttgtatgcttacattcactcctggattttgtaacattcaagatgattttttttgtcttgatgataaaaagtagaatgtgtaacttttgtgatggagggatagtaatcaagggcctcatgatgatgagatcaagtagcaatgaacaacattagtttacctcgttgctggtgtgcacgtggatcgattcgtagtttacacggtcccctacagtttggttaatcattgtttgtttttaatttactaaaccaacagtttactaggatgctgctcgtcgcttcccaatattaatctgttgtcgtctgaattcatgcgatctgggacaaagataacattaagagaaattttatggtactcttgtcgagagtaccaaaatttttaaatgccagctagctaatacttcctccgtactcgtaaaaaaaatcgttttggattgcgacacggtctccaaagcacaactttaattttttgtttctatagaaatatttattgaaaagtgatatatgtatacttttatgaaagtatttttcaagacaaatctattcatatactccctccttccaaaaatataagtcttacttctttttgcaccaagaccaagaagcaattaattaattcaccatgtgacaaaactaataaacatgcaaccaataagcattaaatggcttcttggatttctatcaacaatttaatttagcacataataactacaaataggacttagacttttagaaaaaccaaagaatgaaatagatcttagacttttggaatgagggagtaatttttacattttcaacctcaacaacttaaaagttattcatgatttatattcccaaggtttgatttaaacattgtcctaaacgactttctttacgagtatggagggagtacatatttatcttcaaaatagctcaaatattaaacatttgtttgaagcaatatagtcttcaaagtacaaatgctaagtccgcatgtttctcttacttctctcaccgtctatgagcgagtactaatattgtataatttaatagacatccgaatattaagatctttattaatggacattataaaaataaggttttacttacaaacatcataaaacttagtaatttactggacagtagacactacgataataaaataatatatatatatatatatatacactcaggccagtgagaagccgtatatatgttactccctccgttttaaaatgtttgacgccgttgactttttaacacatgtttgaccgtt

SEQ ID NO: 61937 - DNA, 1834 bp, Oryza sativa
  unsure (1)..(1834): unsure at all n locations
ggggcccctttgattgcgttcgttgcaccgcccagtttagtgatcaatggtctagaacatgaaagctatttttccctgatgccactcattccgataaaaggcgcgctggcctggtggtcggctggatgatgatgaacctcgatctgcacttaacgtgcttctgccttgtaacaaattaaatgcagaataatgtgtcgcgctgtcccaattgtggcttggccggtagaaatttctgtgtgaactaatgcttacagataataagtgatgtgtcgcgaacatgaatatatacaccaagagcgacggcaattagaaagcgctattccctttatatatgacttgtgggtgtgctaagtgtatgtaaccatacaatttatcatgtacacatatttatgtcaatgttagaacctttatacaataattcagacaggtgcacaactctactttctcttactcaacccaatggacatattctccattggctcagcatgtccgcggacatgacctgaagggagaagctctagcgaccgttttagaacatctcaccaaatatgttttcctgacgtgttctttccaactagttattgactgtactgtgcatcgatcagagctccacaatgaaaataagaaatcggttcacataagataaataactaagatattaaatggaaattaacttctggcaaaagaaaataattattttccaggcagggtagcaatgaattaaacaacaaaagtttcgcatgcctgctggtccaaaacatatgacatctaacttattctgttgctagctactttcttgcaatagaggattatgttcttttatgcaaacgattgttcccaaatcccaattatagttaaagaaacagattggtaaataacgtttgcactttttcctcggattcacctaaatatttatggtgttattaacggagtagccaaccaccttaatctaaaaaaactctaaattgatatggggtttaaatattaactgaaggtgaaacaacgattcaatagattgtagagattatggtcggggggttagaatcgaaccagccataacccttataaaaggtttggtcttgtcatcataggaccttcgtcatgttctattaggatcaagaaacctcacgcccgagcaagaaaactcgagaaatgataaactggacagagtcagactctgctggtttgagtggtcacatgccgctggtcagaccggacccacaccgtcggtctggtttgccctatgattatggtcaggcctcatatggcgaagatggtctttttcaaatctggccatatttttctatttatcttattaggtgctaaatatgggtgttaacagatactaggtactacttttctatggacacatacatcacagctagattgctgcgccaatacaagatacattcgcaccagatgaagatgttgtcacttcctcttgtccaaaacgctccctggctaagctagggagcaattcagtgtctatgccaatgaaggtgtttttcgtgatgccactcattccccaaaatataaataggtgaactgaagaatgtttagcgctccaattacacactgcacgatggcccacttttcctaatagtagtcagttggggaagaccaagatttgcctacggaatatgtgtagacaaatctatgtagaaattaaaggcatggggattatgtggcggcaattcttcattttgcataaataaatattatctgtcccatgcatttgtttattcaacttgctttccaattcatttttttggtggggatcctctaaagtcgncctgcnggcntnttngaatgggaatctacatatcaaacgctg

SEQ ID NO: 61938 - DNA, 38004 bp, Oryza sativa
caccaccaactccctactttttttaaggaaaaaaaatagagtaccaagtctaaagggcccacttttcagctcaaaagatatgcaggcataagaggtgtgcagaaagtacggcaaaaacgggttgagatttttctttaaaactcacattgcaaggtacgtgcaatatactagtagtagagaaataaagtaaatgttttccatgtattaatagtttagattagagtggagttacgtgttgaatgcacgtcacatgtagaaactgacaaaacaaaagtctcatgctaacctgaagatgtaatgttcctctatccttggtgtccttaattttaagagaatctagtgattgctgaagtttcaaagtgatttcactggtagcctcaggttgaagactgttcactgctagtttagctacaccaagctttttgtcttgctgaagtctgtcttcatcatatacctgcaaaaaattcacaagcatgttatctggtactacattgagtagattgacacatagaagcataatattaagaacacataaaatcaatcaagatagaaacaacttatgggaattcaagttgaaccgaaatttctaccaatgatgcatcaggtccttccaagcactttcaatgaaactagatcactgccaggtatgaaacattctcaaagcacatctgattttttttctagtccaagtctccaagacgcaccaaggaagtatcatcatctcttggtttgattaggcaaattatttagtccaaaagaaatcagaaatttctgtcatctgacattcgtatgttaaaaacaattacatgtattgtcccatgactgtttggacatgaaaatagcaatgcagattagactaagatagtgacattgtgtaatcccttctagccacccaatatgtagcataatctgactaaaaactgcctagggggatgggacaagctcatgaaattaaggagaaaaaactaaattacattgtctgtgtatatattaggtccattttagggtaaccaaatttgaaatggctctattgaccaaaaaaaagggaatccaaaccagggctgagcagtgatagaaaacagtatgttaacaatattattgatccagctactatctactccctccatccaaaaatatagattatatagcattcgaaatttgtcccaaaatataaggccttctagactactacttccccaacccaaccactcatcgtttaattatattcaatcttatatgcaaagatatgcagctctgctgcgtattcgagaacaaaaaaaatccagtcttaccctcaaccacccctcatttaatgaagcattacaatcctttcccttcatccttaatccctccaaaagaagccctagaagtccttatattttgggatggagggaatacgttgcagttaataatatattgttgtggtacttaccatatgtatacaataattgccacctaaaaacaaagaggcatggaaaattaacaaaagggaaaagaaagatgacaaaatggaaaagaactgagtggatttcatgagcagggatatggtccatgctcactcttcatgcacgatcagtaccagactaccagtgcaatgttgttggctgtcccaagttggttgatttgtttatcttcagcgataagctgctaaatataaggatttgacgggagaggatttttgacagtttttgagttagagataataagttaaaaaaaaggatttatcccttcttaattcttttggtagagatcacgtgttagggctaaacctcaataaaaaaaaggagccatagcaccaccatacagaaaactaaacaatagaagttggcatgggactaccatgtacagtaccagacacatgcatcatagtctgaaacttctgtacacgtgtaatgtatggcaagcattgataacatggcatttccatccactgaaaaattctgaattatgggcatgattctacagtaagccttgaatggaaccaaaagacacattgagtgaaagactgaaacaccaagacataacttgactcatgactaatgtctcaaagagcattcatcatacatgtgtaccatgaaaaatagtacacacacatgagcatgccactagtccatagaaatttattgatatcccatcaaagcacaaatagattcttcacctttcctcaataactcaatcttttagattaactaatcaggccataaaactcaacatggtatcagagctagaagttctaagtttttctaagtttgtgatgtagcacaatcttggagaaacacaatgtcggcaaaatacatggtatcagcttatcatggtctccaccatcgtcaggctatcatgatgtcaactttaggacttccagctctgataccatgttgaggttcataatctaaccagccaatccaagagcttaaattattggagaaaaggtgggcaatctactcatacctcgacagctatactgattagcataatttatccctctgctttccatttatggaacaaaatattcttctatgcatactaaggaaaagtgagctccatatcgagttcatcagtatctgggctacaagcccacatgtcaccttgtttggtacaaacctgaacattataactaaggcttgtcttaattcatatctggactagcgaaccaggctttctagcttctatgagcatttttctgacatgtttacctaactgcatgagatcaataaactatttatacatatgagcaaagaatgcaattgctttaacagaagattttacaaccaacacacgtccatatatatctgactacaatatatcttgagtagggggtagatacagaccataccatcaaccccaactcccttttttaaatgagtaaagaattaaagaataactggaccatttgccagcatgatctggaatccagccattaatcagccttacaatccaatgcagattgtttatagaaagcaagcatataaatctttcttgataaaattgtctattcccttcatatgaatactagcaaaaaaacccatgcattcaaatggatctcataagagaaaaacttaaattatatatatttctcagggaaaacatatataatttgcaaacaaacatcaatacacaaatagcaaatgcacatacacaaaaatatcaatttatccaccgttagaagaacccaccaactctagaggtgtggtaggatggcagactcacaacactgtggtcttctatatactagagatatttgtgcatattttattgtttaattgacaccattttggtcatagttgcatgtgagaaagaacatgcaggaaacaatgaagaattacctcaaaaatgacagactgggtttctttgtcttcaacaatcagagggaatgtttcattccattcaggatttaggttatcatctatgacttttgttttgaccttgaacattggacgcacatatagtatcacatatggatctgatttaccaatcaactccttattcttcaatgaagttgcttttactacagtaacagtaagtcttccctgaggtttaagctccagctcactgcagatgaagtagagcaggacaaataaaatttttgaaattacatgccaatgggatgcaattcattataaagatacttttcagaacaaataaacaaaaatattagtgattttcagaccttaaaagctagcgtgaggcatcaaattaacatattatgcttgtgtatatctcatgcctaccaaaaaaatatggccaccaccaaatatactccttccgccgcaaaatatagctacctttagcattaaaaatttgtcccaaagtaaagctagctttccacctctcaaccaatcacaaccattttaatttctccacttacttcctcatctcaaccaatcacaaccatccatcattgtatttcacttttctcatcaatacccgtgcccaactctaaaagctcttatattttgggacggagggagtataatggaaagattggcaacccacataactcacctagatggaaatgcagtattcaatatcacataaggactttagattgggatgtgaatcctggatgaaatgatactccagaaatatattctgaagaactccagaacaaagctaccctatcaactttttcagatgggaggatactaaatctggatgtgtgatgcagactaggtcactcaagtgacacgatgacccagctaattttgtttaagttgcacaaaacaacagtgcaatgtttaaactattaacaccacctaatcggcacaacattgtaaaacacgccaggtttttgtcatttagaggaatcagccagatattgaacagcacactctgtacataatttgaaatgaaactatcaatatattccaatttcatcatctctttttccccaaccctttttcccgatcaagtcttaccaatttttcactaagttatcaaaacattctgttttgtgcaaaaaagatgctaatttagctcgagcaatatgaaatttactttaaattctaagtattgaggtattgtctggtccaatcgtgtaatcattaatgcagtcaacatctcttgttaagcattaatgttcatgtatcgagaacatcttgcagttggatgattcaaaggaatgaagaattattatgattaaaaaacaagttcctttcaagaaaaatgaatacatgatactatgtgaacaataaatataacacagaaaagcagctcattgtcaacatttattgcatatgattggagagctaacagttagcaggattgattataactggtgacaacattcaagagaagtcaccttgtatcaacattgacaccaagtggaacaacaagcctgtgtggccacttgagcatgtcagaaacaattgaattgacagtgtcctaattaaaggagaggaatcatggtcaggattttataatctgttagaagaaattaaatgttcaaaatactttcatctcacatcaatcatgtcggagagtcctggaacagcggtcagacttcctccaatagccttcaaagtgtattgtattttcggctctggctgaagcacaaagaaccgccattgaagaaataccacaggaaatgctcataccaattagcaaaagactccaaacctcaaatgtagtcaacagattatctccagagacattcaacaataatggcaaatttgcagtatggaacatgtattaagttcaaaaaataataatgatataggccaaagtaatgaaacatttccttgaattggccttaaatgttatttgattggccaatttctaatcaattaacattaaaactggaccaggtggagttggcttttcttttctcattaggaccctttcacataatctcctaccttggcagtccactttcaagctatacttggaacagtgttatgtgtaatttaatcaataatttcaaggaaacagattaataaggttataaacaatctcaaggaaatttcactttgtgtcatcctaatgataggggcacccggtgttactaaaatagctgccatcgaacaactgtgcttaggatgtccaccttgttaattcaagactcgtctctgcttagacatgcagatctcctgtattgtcttagaaaaaaaatctcctttgaaatagaaagataaatcattttttgtagatgtatacctctgcaagaagagcaacaacaacagcagagatgcaagggatctcctctgatagttgaaatacaacacggacaatggtgtagacttgaagatctttgagctgtgagatggttggcaaagatgatatcatgactagttcaagagagatttacttctgtaagaattaatcactgaaaagaacaaagaaatagtaaaacctgaataggaagtgatgcaacaacagcatcaacagcaaggattatgcttggatcaccaccccaacgaagatctatatccattatgatttggcctggctgaatattttgaatgcgaatacctttacacaacatgacaaaacgtgatgtctcagttatttagtattgcattaacatgatcaagatgctaaacaaaacatagcttagtggggcatccctaagaaagaactcatgcataatatacataaaggtaacatcaggtaattagcatttatttaatgagcattgtttggagaatgtacataagaccgtcccctggaggcctgaagcaattgaaatgacaatcgcatggatgcaactataccacaagggcaggggggaaactatagagactagagacttgtttattcttgcttgatgccaatacttgcaagaaacctcttatatagcggactcacctacctcttatatagaggactcccgctcccctagcaattatagatatgatcaatttaaataataacttgcctaactactggaaagataccaaacaacctaagagctagattatcaagtaacaaacccatgcctaatcataagacgatgtacttttcatatgagcagtaactacacactgcactacacatccagggcccatgccaacattggcagttggcacatgagtacatgacaatagtaaagaagaaattaccagcaaacacataaaactgcgaagatgatggccaaaacataattggtatttagtaattagtaggcaaagtaaccttgcttgttagctggctatcagttaggaagggtaaaatggcatattttgtgttttttaacctacaccaatctgcattgttttgtgccaaaattttctttccatatcacatctatttgacgagtttgtctctctcgacaaatcctatctgaagctttttcacatcaagttatcaggggtactcatgccattttgaaaattttccctccataaatacgtaaagaaatggactcaattaatcaattattgactgacagtttgcatcgaccgatgttaacataaagtgtcaacttggtaatgttggtcaatctacatagaaaatagtcactcagaggtcgcaaagagtgtatcgtcagattcacaaatcacaaaacaaaaggatgaacttgtatttagtagtcacgatggtcagttcctgcaattaaaaccatctaatgaaatactcctaaggcatgtcaccagtcactattaccactgggtgcagttcttggtttacatacatcagatgcaaagattgttattctcactgtaggaattctctaattcagaacccagacaggaggcatacaacagagtaaaaatcagataaatagtgcagaacgtggagattataataggaaaaccttctatctttggtgaaacagttccaagagagaatttgctgaacttcagagattttattcctggaggtcgataatcatctagcagtggctcaacagattccttgactactgcagtggcagcctgaaatggaactaaaagtttagtagcccccagaagaactaaaatctaccaaaacatagtacatacttttaagaaaaaaaataacttggagaatgagattggggcagaataaaacaaagaaataagtcctatctttattaacacaattgtacatatttaccacaattaaaaggattaggacattgtgcatactagtggaaaatgttaagataacttgatagaggtatgctttcaacgctatactgatgaagcgtatcttgatatatcttcaaaaaccaagcacaatttgtataaatagaaaatggcatatcactttgaatgaaagtgacaggatgattgagatgatcaatatttaagttaaaatgtttaacctttagaacctgcagttaggagtagcattacaatacacaaaaagatcaacatgaattatacccccccccccgcgcgtgcgcgcggaaatgccggtgtttttgtttagataatggaatataaattccggcctttacttcaaagaagctacagccacttattacacaaaactctcaaagagagccaatagtcaggcaacaatatgaactaaaactctcaaagaaatgccagtgttaaagacaaagaaagctattaacaaataacaattaggaagtttgctggaatagcatacacataggaatgaattttttttgtaatcaaaggaacgaataaaaatttctacaagaaaataccatagttgtcagcaaacgggggctgtaggactgccaaactaacagcatactttacattattatcagttggctagagcctagagatttaacaaacatttgtcttacttgatcaacgaaaggccagagtttgctgagatgcttgttcagccatttcacctgtagaaatcaaaattgtgggtaaaatagtcattgtccatagtacaatggataaggataactcaataagcatcaagaagtgtccctttatgatgggtatttggattacaatacgaatattgccagcacattaatctggacagacggtttttccagcttcgttgtactaggatgtgtctgtccagattcatgtactaggatatgtcaaatcaaccaaaatcccttatattatgggacggagggagtaataaattgcaagaaaactaaacaaatgaaacatcctgtcaatgtaatgatgttcatgttcaccacagttaactttttcacaagcttacaaattacaataagtatagccagctaaaggtcttttatgaagataaaggtctatttcatttggttaggtttgtattaggtgtagtttataccaccttgattcactagtgttcagttggtagtacagccatatgatggatatgagaatttcggctagtgtttactcgaaatttcaccattgggttgattaagctgtcacctcttttggggtaaatacaaagtagcaatgctaactaaattgcgaagattgaagcctgtcaatctcaatccatcatgcaagcatactatgatgtgaatcaccaatcctcaacattgccaatagtttctgaactcaaaatgaatgcatctattttggtcaaactaagccaaatcccttacaacctactgtcctactctagcagctgcctccgcatgttgctgaccaccaaagggctacagcacttaccaatcctcccaagggcagccttagttgctgagatgggctgttaaggcgatgtaaggcgacccaacccaaccttagcggtaaggcgtaaggcgatgcgaaaagaagaagaatgcgagaacagatatgggccagaagtacatccagccagccaccacactatagtattctgcagttaaccccagcccaacagcccgtttaaagccaaccaggtccctttcctctcttgccccagcatgccaagtccacaaacattctatatatctatgtacccatcttgaccctctatagcactactttgtttttgagatctctgcttcttaaaaagaattgcaccagacgtccaaacctacctttggctttgatcttgtagtttcaaaactagcacagaaacaagtcatcatgcaaactactacaattttccacttgtgaatgaaggggttaaaaggttagattataaattgtgttccattcattatttttctttacttgactttcaagacatggactcagcatatatgatctttttttttctctaatgacatattcatgaaaattatttaaagagcaactgcatgaaagtatttttatggcaaatctattaatgtcatttctacaaatcaaatcttaataattttgcatatgttaacaagttgaggtttcaagatctgacagcacggtgcatgcattctcaaggaaaatttggttccatgaaactgaatccatgagttatgtaaccatcgaaagctcacttcaatatcaccaaaaaatttgcaaagctcctttttataccatttccatccaactgcgctaactatgacccagaaaatcatctagcaagaacacagacccagtactaccatgcttatgctgtattaaatttttggtgaagaacagaaacggcgcaaactttcggtgtcacaaactcaatatcagttcttcccattctaaaacgtcatcatttgaggacatcgggtagtagtttacactttacacagacaagaacaaaaataagactaggaacatttcggaggaatcaccacaaacctgctcatactgcgggaaggatatccactcggggaaattgtcgccgcacagcttcttgagatcgtccctaccgagagacccaaggaccttgatatccgcagcctgtagaaaaagtttcggaaaaactaaacaaaaatcaaaacctcgaccacgaaaattaaacgaccatcaccctagccttatacgcagaaacaaggagcaatccaggcgaagcatcaccaccacgcgcacccgaaacacgaaccttagcgatgcgcttcctgctgcgccgctgcatcacacggctccacccggccataagcgcgacgccgaccaccatccccatcaccatccccgagatcagccccatcctggcgcacccgcgaccgacagcccgccctccgccggccagccaacctcgcttctcgcgccggcaccccccttacctcatcaatcgaatggcagctcgagatctgcggcttcgcagcggaggagacgagggggagggttacgcctctctggcttgcgttggcggtttgcaattgtggcttgggagtggggaatgcggaggattgcgacggattggggcttgggagaggggattaattacggggattagtgcgcagttaatgccccaagggaagcatcaacgaatcgatgtactgctcgcttgctggaacagtgacgaggaagtcaactcgaggagatctggagaggaaacggagttgatttttaggacaaacggcaagtcggccgcgagcgagggggcttttaactatttgccactcttacggatgttgcttaatgatttgccactaagctcacatgtcatagacacatgagggcccacatgtcattgacagggtgtggcaaatcgttaattgtcatgtcacaagagtggcaaataacgtggaccttccaacacccccacccgcgagcgaggggcaggggctgtctgcggggggaaatttaacctccacgtgagcctggctagtagcttcgctttttgttttacccaaacaaagcagatgggagaccgattttacaaatccaccccaagtttgacaaaactatcgtaaaaaactaaaaacgtctcttttgagtaccttcccatgcaacacgtagcactgcaaaacacgtacctgcaaaacgaattgcctgtatttgtatggatgtaagtaacagttgcatataaacatatagcaattcatatttgactatttgtggatgcagcttgaagctgcaaacatacggagtaaatttagagttgacatattagtctaccctttgtatataataacatcctccagtaattacaggcctgtttggcagagttctaactcttaaatttagctagttgggtctggagtggagtcgtggagctgcctaaacccaactccacttctctagttcattttgtgagagagctctacctagctctgctcctattttagatagagttgagactgtttggctaagctccaccttcaggagagctggagctggagctgtgccaaacaggcccacagtgagaaccacaccgattttcttatttttttgcagaaaaaattgcttcttttgaaaaatttgacatgtggtgggctagtttgaaaaaagatcattgtctacgtacaaaatatcaaacaaacctcccggcgcacttgacacctagttgtgttttttcggaacaactcttgtcttttcgtgatatacaatgtgaagaagagaaaattttgttgctatggataacactttacatatggaaactaaaggggtattttcataaaatctcctttactcacctcaacctctccaccccatcaaaaacccatccttctccccaatccgcgctcctgttgcacgagtgctgcacatccgtgcctcacgccgactccaacgctgccatcttcccttccttccacacctgtcgcatagccatcgtcgttcttcctccacccacaacctctcttcctgagcaagcacattgtcggctgcttcaaaaatccctatcttctcgaaccctaggccaggcgacaagagcagcaagcgtcggtgtcagggattgttggttcttctctttaatctagggatagttcccttcccttcctctctctcactctccccatatataagcccttaattagattagaaaatatataactgagatctagtgcttcaaatggaagaaagaaaaccaagcaagattgaattgccacccatttaataaatttgcatctacctacagctgacgttgcacggaaattatatggaacaaatgaacaatcaacttccaagcgagaccagcatggaaggatgcgcggtgcaatacaattatgatgaatggatgattttttttttcaaataagaattgataaaaatcgtaaaattcaaaattgcctctaatcattgtgccgacgggggatacccgtagaccgaatatagagggtattagggtatgctggtacgaggatctacgtagtacgacatcaaggaaacaaaaaacatgaattatactggttcaggcctcttgataggtaatagccctaatccagttgatatgggattatatagtggaaaccacagattacaaagggaatagtagaattcgatgataccgacgagaccgtagtcgagttggttcaactagatcacccgacaacttggctcctgtaggctccgacttcgtaggctgtggcggttgtattggcaatgagatttgatgcctttgatcctccccgggggtcccttttataccgcaggtcagtcggtttccaagtaggactcggagacatcggaccctacacgatacagtgacgacccagttctatccgagtaggaatctttccatctgtggactccatgatggatttccttgcgtgtacgaagaacgtccgtatacgcgcagatataccatatcgacgcatagcgtatatccaagggtagagggtataccttatccgtaaccctgacacattgagtttgtaaagtactaatacgcccttatgaaccgagagttcagatcgattctactagtagtatcataatatcagtaatactaccagtagataacaccattgtgggactctattgactaaaccaatagagtgattaaaattttttcttgttttttgtagcattttcctgttgccttgcatatatgatggatttggatgttatttatgatccttgttaacggtccttaaatcataatatttgaccgtcaatacctgcatataatgaaataaaacatggtatccaacttagtggtagggattattactaatcatttccaccagtgttggtgaaatatgtgtatgcatgtaatttgaggagaaaacacatccgtcatgcgacaaaatgcacctcagtgcattcaggacacgtttacacggattggaggcctaataagtcagtgaaaaccatttagaattgggccaaaacatagcataggttgttggggggccattaagcaacctcccggccgaaggagaggccgggaggagtgtttttgggttcagccgaacccatcctggcgctttccgccatctgttttcatgtggacggcttggatttctcccctatggcgtttacagggtggtttggtcatttcccatgcccctaaccgtcatttagagcttatataaggaggtctccatctcacttcaagcacacacaactttgagctgaattacaagaggctttattgtatcttttgtacattagaattaggtatagagtgaggggaagctctggaggagtgctcggaagtttggcgctcatccgacttctacctcgacgagaatagcttcctagaaggaattcgggaggagtacctgagctgtcggtacactctgctctgggttcagaaaaacttcttcaataaagtaagcattcgtgttcttttcttatgttatttaattactttgtctaagtaagatagattttcatctttgcgggttcattggttagtattcatactaagtgctctagtactaggactctggataatgaatgaagttcctgcacaaatattagagtagtaattaataacttagacgtagtgtttaggttagagattacctttgtttgttgtgtatcccacggatttgtcagaggtaggcgacaggtggtgatagccctaaatcccgtcctagtaatcctccacattcggatacatcatagaactatagccggaaccaggctggcagaccagcaggggtcggtgcccgaagcaacagataggaaattacctttgcttagcttagataattaaaacacatagaaagtcctctctagcctagccagcctacctatagttgttgtccttggatagtcttagccttaagtagattacacacgttcgctgagttcgatatccttttggggtcaccgaagatgaagtgctataattgtattctgtgcgcttgcggatttatctgtggtcataagaaatgccaacaatcctcataattaccaaatggattttacttggtggattttattttgcagtagtttctttgaaatcccttgtttctatatggtttcaaatttgttcaccatatgccttttgtgttagtgtattggttttgcctaacatttcatttgtttgtcttatctaagatagtgttgcattatagcttttggaatgtattccatcacagttagtggactaaaattatgtgcaaaatctgttatattaaaggaaatggaggaaagtgcacgggtggtccctaaacctatcatgttgtgtcatacaggtctgcaaaactctcaaaatacattttcaggtccctaaacttgtcccaggcacaaattggctccaacccattctggacactgacatggcataccatggtggtacctatatgtcattaggactcacatgtgatacacattaaaatataaataaaacattctcattatgttactttttttccctttcttcttctctccccttctctttctttactgtcgaggtagttgttcactctctctctctctccccttttcccagcgagcccctctttggagcggcggtggtgagggccaaggctacgccggtgagatcctgcttactcaaaatctcaaatgcgaggccttccctgatgtcatcatcacctatggtaatgtgcactggtccgcacaggttcctctcgttctcatatgccctagtctatagtgacaaaattaagatgtgcactgctcagttgtgaattgtgataaacctttcaagcaatcatgatgattaaaatccaactcatgaagcgtacgtagccatggacgtggccggcgaagcctcatagagaatgtgctccatgcatggcctttctcatggcctcgccctccacctcgtgtcccgcgttcatgttgtaccggaggcatttagcggcacaacgcgtcgtgccacggtggatggtggcaaggttgcgcgccagccacctacacggtagtactgcgccgagctcggagtctaactggtcattgagccactctcctcgtacgacatggcaagtccggcagccccatccactactaagaaaaagtatttttcatgacatcaaacttttttttactagcgggtttaataaacacacgcttgtaaacatatatttgagggtttctaatcacaaaccaccagagaaaatcgattttatgttagctgtcacttacgaggtccacctgaaaaaacaaatcgttataataaattgcagtgccatatgcgctaagtattaaataatcgctatcctctcaatttctccccagctgccttctcaattcctcttctccctagccttctcgattccttctcgacttctcctctcgactgctcctcctctccctccaggccccctccgtggtggctccctccagcgataggggctccccccagccgatgctctcggcaacaacagcaacggcgacaggaggtggatccggttgcgggatgggaggaggccgatggcgggcggcaacactcttgccctcccctctctctcctagatttggccggaggggaggagaccgctggtggcgacagcattagcaggggagcatcggtggtagccctccaatccccatccctcccagttctagtaggaggggcagcagcagaagcaggaggctggtgatggcagaattagtagagggggcagctgcgatggctcccccagacccctccctaccctgcctcttttagatccataggaggctgccggcggtgacagcagtagaggggacagtggtggcggcttccccactcctctcccctccctctcctagatctggccggaggggagacggccgatagcagcagagagggtggcttcggcgacgtcttgtccatggtggcttcagcagcctcaaggtagcagagagggtgacttcggcgacgtcttgtccatggtggcttcagcggcctcaaggtcaccagcgagctcatccatggcaactagggttcttgtgaattagcgaggatatgcttgggagcaagggttgcactggtgaatttttccgtgtttgttcttcccttttggcttttgcagatccatttaatgcagtggtgattagtatttcatagggatgatgtttgtttatctgtagttgatttgatttgatttgtggaaatgggtagctacatgcatgtggtatttttgaaaaaaaaaattggccacaatgcatctattctagcggtcattgtaatttgaccgcaaaaatcggactttcacagatggtcgcactactataaaacatcaaataggtgtcgccattataggtgccggaacaactaaaatcggcacctataatgcatttctcacccaaaaagcgcatccacgggacaccattggctagaatcggcacctttgtaaagagataggtgtcggttctaaataaaaaccgacacattttagattagtatcggtttttctgaaagaaccgacacccatatatttatattataggtgttagttttatgaaaaaaccgacacctattcggagccgactgacacctatttagagcactcagccttatcctcagcctctcttcccttagagcaagtataatagaaggctgtaagccgactaaatgctgaggtggaggagagaagagaggagagagaggagaagcgggctgtaaacttacagccggcttggacacaagaaccaagtaactctgtgagagaggcaagtgggctatgtattaattgtaaagagctaactattatataggtaggctgagaggaggctgcaaagaaccttacaaccaacaagtcggttgtattcttagccttgctctgatcctctcagcccctcttctctgtctcctcccctctctcagctctctctctctctccaccacacagtggcggcccgacggcggaaggggatgcagcggcggcagcggcctggcggcggctcagcggctcgggaagtggcggcggctccctcccctccgctagatttggcgggagaggggaggtggcggaacgggatgtggcggcgatggctcggcggcggaaggggatgctacagtggtgggaggggaggcggcggtggtggtcccacggcccgtaagatgttttgacttgtgattatttgttgacgtggtgatttaatgatgtaatgatttgtgatttgtgggatcggcttgacggctcgatgcatcgaggcgatttttttttggctcgtgtgtacttcaaaggtgccggttttgaaaccggcacctttaatcttctgtaatctgtgccacctctagagtgctggttgggaaaaccggtacctgagggggtttcccaaccggcaccgaattgagattctctagtagtgtcggcttaacctagttgcttgcgaaaaccattttcgctggcggttgggctaggtcacccgccagagaaaatgatttcttgttccgacagtcgccgtagaaaatacaaactggccatcaagaaaaatccattttgtactagtgattgccgcctccacctcatggttcccctcgttgaccatccatgctgctcgccggctggcataatctgcatgaaccgaccaccgatgttgtggtgatgctcgtagcgctgatgtccagtggcgactgtgacgacctcacaaacagcatcattgcgttgttggcaaggcttgccaagcagcccgtcggtgcggcagccatcctgtccagctgcttggcactctcatgtggctcgttgatttcctcagcgtgtcggtgttacggttggctaagaagcacgacactacgctgttggctcgctatgctgccacgcgcggcgacgcggtggtggcactgctatggcagcacattgccagcctgcacgataggggatgatagaaatgagcttttttttatgcgactgacttatgaaccccacgaaaaagtccaccggagattcatcgtggtccacatcagcgagtggagcgggttgcatccaatttggattagttgttatacccatgacgagtttagagatctgaaagtgcattttaagattatggggacctagatgacaaacatgataagtttagggactatccgttcactttacttaaaaaaaagttgggtgtccgacctcatttctatatgatatgcaatttatttatctagatgtctttttgcatctattgtgtttaaaaaagtgcagatctttattatgcaaactaaactgtatcattacttcttcatttttttaatttttttaaataaataaaatgttgactggattaccatgcgtacgccacgtaggataaaatcactctgtattgggtcgagggggtaatttgttcagtattgaaagttgagggtgaacgatgtctagttttcgggtttaggggggtaattcggtcgaccgtgataattggaggaggggggtaattggtacctttttccctttttttttcctcgtgtgagtgagcagcccttcccggtctcatctatctcattccttttttgaactagcaagaagtgatttttgtcgtggtctacgggcctgatgctagcacttaacagaatgggccaaatgatagcccacaacaaaacgagcaaaatggtagcccataaaacaaaaggagtaaagtccatcaccggtccctaaacttgtaccgctgtgtcatcccggtccctaaacttgcagatcactcgtttaggtcctccaacttattcagatgtgtcaccccggtccctaaacaggatggtctaaaaactttatatcaaaaaataattcataactttttcatgtgaactctaatgaagacaaactttatatcaaaattgtagccttcgacgcgacttacaactttgtatttgaaaagtttttgaattaaaactgtttaggtcccaaaatattgttgcatgtttatatattttgaaattttaattttaaaattacattttgggacaaaaaaatgacttaaaataaaaaaaattcaactacaaagttgtagatcgcgttgagggctacaagtttgatataaagtttattttcattagagttcacatgaaaaagttatgaattatttttaaatataaagtctttagactgtcttatttgacccagatgatattcaaatccaagtttagggaccggggtgacacaattgaacaagttgtaggacctaaacgagtgatctgcaagtttagggaccgggatgacacagtcgaacaagtttgaggaactgaacgatcgatttgcgagtttagggaccgggatgacacaacggtacaagtttagggaccggtgatggactttactctaataacgagtttgggaggttgggagcagatccgatccagttggcatccgagtgtggaatggggatcccgagtgcgggtgcgctcgctttgcttgggatgatttcatcggatgtgaaaaagggtgtcgaaactaagggtgtgtttggttgggcttttcaacctgcttttgcttttgcaaaagccaaaagccaaccaaaaggctcaaaagccataagggcttttgctccaaagctgcttttagtgtagtacaaatccaaaagcagcccctacccctgctttcactggcttttgagggaaaaaattacccacctatgccattatgaaaaaaaaacgattcgctctttctttctttctttcccgttccccttctcgcgagatcgagcgcctggccattcacggttcgatgcggcgctagggtttgcgccgccgcccgtgctcccgccgtcgcgcgccgcatcacccggtgccgccctgctcctgcgtccgtctccccgtcgcccgcccccacgccacccgacgccgccccaggccgcccggcggccgtctccccatcgcccaccccacgccggccgatgttgccccacgccgcgccgaagccgcccctgctcaacgccgcccgatgctgctccgacgccttcgctaccgctcagccgacttgaaaggtgaggccgaatcgcccctgcccctgtgctcttgtgttgatgcatgtgctgtccctagaatgttacagcaaattgatttttggcctgcaaattgattgaacaacaaattatttggttcaagaataggtgacatggcagattggggtgattgttttgtaaagcatttgtttgatgtttgcaaagaagagatagaggctgggaatagacccatgggaattttcaccactaccggttggaaaaatgttgtttccaagtttgcggaaaaatcgggtgacaagcgaaccaaaaaacaattgaagaggaggatagttattttgagatatggcatcattgtatgaaccatttatcttttgttctgtttatgtggaccatatcactttgatggatgaaaaaactaatatatttcgatgaaaaacttatacattttttaaaaaaattggccttttaaatacaaaatattgaacaggttaggtttgtacaagtaatttgcatataaacagtcctacatgccattaggggcattacaggtatttcttctacaacctacagtttcacagctgctctaaccaaacgggcttctgcttttcccacagctgcttttccacagcctacagctcacagcagcttttccaaaagccacagctcaaccaaacacacccttggcgatactagaaggggtagcgaacaagctatgaaagtgaatgggttatgagaaaagatttatacatgttcgggccttctcaatgagaagtaatactctactcctgtctcgggaaatattccgccgattgtgctattgatctaacgatctaatagcatctccaacagcctctccaaatctgactctccaaatactcatttagctagcctaccaactaaatagagtcaattttgctttcactccaacaacctctctatttacactgtccaatctaataattggtcccacatgtcacatgtcagtgtcagtatagttcttttacctccctccaatcttctctccacgagtagcacatcgccgttctctccttgtccccgcctcctctgcacaagccgtcggcaccgccgcccaagtcaccatcaccgccgcagcaaactgtcacgccgctgcccacctcgccaccatcgctgcagccgtctgtaccactgccgcgcaagtcgccaccgctgcatcagctgccaaagtcgccacctaatgtgaccatggctactacggatacaaccattgctcacatcatggatgaacaaggagatatcaagatcaagtcctccaagtgctggaatctgattcggccacctactacactgctgacttcaaatggccaccgaatctgcatacgacctctgttttcggcccgtaagtacttgatggaaagctcttggagccctctttccaacggatccagcctcatcgccaatttccatgtcgtttggccgcaatcacataaacaaggtgctatgtcacctgtcttgggcctataggcttgtaactttgtttgggaccccgacccaagtggggcccatgtggggtgcgccccaaccaggtggagaatgaccattggcaccccttggtcttcctcccacccctataaataggtaagcaccacttcagggttactcgggttttgtttagatgaaagtttagccattgctacttcctcgcagcgcgcgtgtcggctagaccgtctgtctgcttgtattcgaaaccccaacttatcgtgtgtactcaattcctatttgcaatatcagattgcttttatcttgttcttgcttgtttcttcgatttacttgcaggaataaggttgatctgcaccggcaagatcaacaacccacggagaggtgtatcgatcgctaaggtgcaacacaacgtctcgtacggttgtagtcggatagtcaacgtttctcccaaatcgtagttatctgaactcaccgaaagatcggggcaacaacaaccttgagtttcgagtggaactcagggtttatcaggtggtattagagctttcgttgctcggtgagtttttatctacccataaccagaaaataaccacaaaaaaatttgtatcatttacctagccatatttgtgcctttgcattgttcttttcagtttttgctttgttgagttttctgttgcatcgtcaagtcgtgttgctggtcgtagcgtcaagtgcgtttagggttttgagttctggtcacgcttagtaccactatcaccgtgtgctctgttgtcgtcgggacctacgaaaacggaatcggctcgttgccacggttctatttttgtagttttcagaagtttctatcggttagtttttgagttcttgagttgcatctaagggcttctgttcggtggttgtgccgtgcatgtgtgtgcgaggaagaagataacagatcagtagaaaagaggataaagatcggttttcagaggaagttttgcatattagatcaagtcggttgggttgtttccatgtaaggccaaacttcccactttggccgattctatttcctcccccacgcgtgaaggccggcgtccatctccttctgtcgcccactttagctgaatccgactccctccctctcacgttggttcctcctgttccgagttgtgtcaaacaccttggtgaatttttgcttggtttcggtttcgagatctgtttggaaaaacggaaccggcataaattcaacattccatttttgtataattttaatttttgagtttgtacttttacagctgagtccctgtaatttccatatttgcatttgagccccagtgatcatacattgaggtccttgagtcagtctttgtaaaaaaaaataaaagaaaaaaaaggcagaaaggtgcataaaaaagaaaaagaaaagaaaagccacaccaaagaaaaagagagaaaaaaaaagaagaagaaagaaagaaagaaaaagaaagaaggaaaaaaaatcacttgttatcttttggatcgcttggatatatcagagtatgcttgagttgtttctagtactattttgtggtgccgtttgtgtctaggctcgcgtctctagtacgttctagcctaggaccagcacagtactgactttgaacgattattcaattttgcattatctgatttgagcatttgctattcctttgctacatatttaagcctacccagagctccacagatttgattgcagccgtacagcaagtgtttgccaagtcatcgatacatccaaactccattggggtgtttggttgagtcggtgtggacaccatattctagtttgcattggtaaaaacttgtaagagctcgatataaagcttgagtgtgtgtgatttgtgagcttccactacctcctagttgataggaacgtatatattcttgtatatgtttcttgtttgctactaactatggcagggttacacaaagagtttggagctgttcgtgctcaatgtggacattttcaccttcgacaacacatggcaagtgaccaacatgacgcaaataaggtacatgatcataatcttgcaagagtagagtctgttttgctatcttttgatggaaagtatgattccgctgcatacgttaattgggagctagccgtagaaaaacaatttgatgagtatgatttttctaatgctcaaaagattaaggctgctagtaataagtgtaccggttctacatctttttggtggcatactgtgagaaataagcttgaaacttgggatgaatgcaaaatactgatgagaaaaagatttgtgttttcatagtatagacgtgctctccttgagaaatttgaacatctaaaacaaagtgacaaaactgttagggagtactttcatgattttaaaatttgtatcacttatagtggtttacaagaatctaatgagaacacaatgactagattttttagagggcttaattccaatattcaggctgggcttgttaatgtgacatataatcaaataggccaattgttcatgcttgcttgcaatgttgagcgcaaaattttggagaacccaacggagcaacaagctatgcttgtgcctcctatcactgatattttgcaggaagttcagaacagtcctcaaaatgagaagaacgatatgtttgagatgtcacttccatcactcgcgaatgaggagaaggctgatgcacctacattatctgaagagggcataaaaggtaaattaaatggtgtagaaattactcaaggtgagtgtgcttctgatgaattacatttttccacttttcatgccagagaagagcaaccattagtgaaaccaattgctgagatgcctttgtcacaagttgatttacttgctgttccttgtgataaagaagagttgtgtgataatgcttcacttatatccatgccacaactggtgaatggacatgctatttctagtatttctttgtgtgctgattttaagcatgttgttcacattgctaatgaagtagaggaacgtgaattgctatcttctttaaatactttgggctatgttcagcttgatgatttttgtgagcttgataatttggaggagaaattatttgctaagtctgatttgccatgtccaactaatgctatttttcatatatttggcgaatatgatgatagaggaatacgtttggtgcatagagtttatatatgttcggatttagaacctcctgtacatgtggataaaacttgcaagctagagaggcatgtaatttttaatcatattacttccagtttatcttgttttgattggatgaaacaggttgttttaaatcgaccacacgatgagcaccatatggaaaaccgaggacggtttttcgtgaagaaggggaggatgatgtgactatggctactacggatacaaccattgctcacattatggatgaacaaggagatatcaagatcaagtcctccaagtgctggaatccgattcggcctcctactgcactactgacttcaaacggccgccgaatctgcatacgacctccattttcggcccttgagtacttgatggaaagctctcggagccctctttccaacggatccatcctcatcgccaatttccatatcatttggccgcaatcatataaacaaggtgctacatcacctgtcttgggcctatgggcttgtaactttgtttgggaccccggcccaagtggggcccttgtgggttgcgccccaaccaggtggagaacgaccattggcacccctttggttgtcctcccacccctataaataggtaggtaccccttcagggttactcgggttttgtttagatgaaagtttagccattgctacttcctcgcagcgcgcgtgtcgactagaccgtccgtctgcttgtattcgaaaccccaacttatcatgtgtactcaattcctatttgcaataaggttgatctgcaccggtaagatcaacaacccacggagaggtatatcgatcgctaaggcgcaacacaacgccttgtacggttgtagtcggatcatcaacatttctccaaaatcgtagttatctgaactcaccgaaagatcggggcaacaacagccttgagtttcgagtggaactcagggttcatcaccaccgcagccgactgtaacgccgctgcccaagtcgccaccgccgccgcagccgaccgtaggatggcgagaagcaaggcgagatgggggggagcaggatgacggggaggaaggggtggggcgatggtggcatggggcggagatgttgacgacagcggggccgacggggccgggcggtgatcgtgctgctgcgctggataaggaggtggcggcggcgacagctcgaggtaaggggatttgcgtcggcgttgctactcgccgcgggtgggaggaggctccggcttgccgtcctcccgtctcgttgtcctacctttgggtcggcgatcaaggtgacgatggggtcatcttcctcgagccgggaaagactgtggcagcgacgaggggagaggcggatgggaggagatggtggcgagctagctgctcggggggcgtcgttgctagccctgctcggtttggggcagtgatgctcgctagtcctaccgccgccaacaggtggttccttctccgacctgctcgccttcctcttcctcttgccttgcctgcagcgcacgctcctcggcgccgtcaacctcgtctatgtcatcgcgtccctcgtcgtcctcgtccgtccccgcggcggcggtggcgacactggggatggtcccaaatgggaggcgctgctgccaaagccttggtcgtcgggaaggcctttcctggtcgtggtcacgctcggggcatcgggatgtttgtgtttggccaaccaaacaggccgactacatttggccagtgagatggcttagccattcaaatagagagtctgttggacctcattttcttgttaagtttgctactccctctgtcccataatataagggattttgaggttttgcttgcaacgtttgaccactcgtcttattcaaaattttttgaaattattatttattttatttgtgacttactttattatccacaatactttaagcacaacttttcattttttatatttgcaaaaaaaatgaataaaacgagtagtcaaacgttgcatgcaaaaactcaaaatcccttatattgtgggacggagggagtattttttaacttggagagtgtgatggccaatctgttggagatgctctaaagtatgattatgtccctaaggagccctcgacccttccttatatagaggaaggagtcgggattataagataaataccttatcctttacggtccaagttctataaatattttataattgtaaccgattaagactacatgatactttcttgatatacaagttaacataatacacgagtttctgttactatgagttaccctgataaccagtcgagtaatgcagccacgtgggtaatctccacaaagggctagtgtgtttataattttttttactagggtgatacatagacagtcccaatataaatatatcggagcacgcatctaaacgagtgaatgaatacaaaacttggcatgaaaatatggaacgcacctttatcataatcctctctctcccaacacgataggagaccaatcaataaggcatcgaataaaggagcggcgtcgcttcgcaccgcaccacccccaaagcagaggcgcggacggcggagcccacctactccttccgccgaatataagcaacagcccagtgaatttttttgagaattaatattatttttatggaaaatcgcaaaagtagtagtcaaccggggaaaatcgcgaaagtaggtccctgtcgaacgggtgcagttcgatagggcgcctatcgaacggccagagcgtgactggcgaggagatcagaaggctgccgttcgacaggacctgtcgaacagcccccgttcgacaggcagggctgtcgaactgcccctgttcgacaggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtgctaagttaatcgtaaagtgtttctcaaatagtacggacagaacagaaatgactaaaagtttaatacaaatagataagtcaaggacgatcagtgcccttcgcacgcttgctaggtcttcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggataagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttttcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggatgctcgccacgtcgtcaggcctgacgactggaggtctcgcgctctagtctttgcagcagggtgtcggactccatgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgaactaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcatgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaatgaatttaacaaaaaatacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcaccgcaagtaccgccgacccccaactgtactgtggaatctccgcgataggtaactttgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatccacaagagcactcagaagcgccgcgtcaatgtggattcgttcggatcttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcatattgatcagccatacctgcagatcgaaaaccacattagtacaatgcacgtacggtaacagtacagtaaatgtatgcaacataattcaagtaacaaatttgcatgccatttcaatttaaaattacagtaccagcacacatagatacagataagaatagttcagtacatttcaatttaaaattacaagcccaggacacatatattatgatattacaagtgcagtgcagttcgaaatttaaattacaattccaatacaaatacatgacgatattaaaagtgcagtgcagttcaaaatgaaaattacaaggccgttacaaatagattcgggtaataaaagtgcaagaaagttcaaattaaaattacagacgcactaaacataaattgaacgataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgcgactggcgacgacccttagtatcaactaataaatttgagtcaggaacccaattggcttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagtgtgatactctggccacaacgtgcattccaatgtgatgttagtagtcccaatgccgacaccactcttgtcacgaagtcgtatctcaaataacaactctctgttcccagcatgccacactctgtggattcctcccttcttacttttctcatccatgtactgtgtaatagcggggctatacttaacactgggtttgctgaggttcagactatccatggaataccttttacagagatacttctgtgtacccctcgtgatgccctccaggatagcaacaagtggtagaggttgtgtattcttcataacccagttatacacttcagcaagatttgttgtcatcacaccatacctcgatccgtctgtatcgtacaacaacgaccatttctcccttggctcaaattctacccactccgtgaagcacttcatggcccttccacgcttcctgcgccgagtaatacttggtgcttcattaggaatgggttcaagtccctcggctcctcctgtctggcaactatatgttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatgtaaatctggctatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccatcaaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatttgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcaacttgtccaccttccaacggagtttcttccaccacggcatgacttgactcccccgatcgatcaacacatgttgtcttctgcaccacgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcattcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattaccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctctcctcgctccctccggcgctcacggcgacgatgtggcgactctcggcggcggctggcgatgtggtcctcaaaacaaatcgaactcgcggcctaggtggacggggctttaaaccggcctgtcgaacgcccattgttcgacagggtcggtggagggccctgtcgaacgcccccggttcgacaggcctcgcggcgccgggtggtgggccctgtcgaactccctccgttcgataggtgagcgtgtcgaacgccagccgttcgacagggctttgtcgactgcccgtcgttcgataggtgccctatcgaattgcacccgttcgacagggacctactttcgtgattttccccggttggccactacttttgcgattttccataaaaataatattaattctcaaaaaaattccagcccagtcgccagcgcgcagatagagccaaacgccctccacccatagcctgacaagtgggacccacgccaaaatgtccccacatgtcatggacgcctcttgcctggctaccaagtgttcccctgcttgggaatatgtcgctcggccgacctctcgtattattgatgcgacttgcagcccaaaacccccaaaaagccacagaagagagacaggggagaaaaccctaatctcaaggccgcggctgtgagcgctcctcccgtctctcccccaacccgccgccagccaccgagctcgccaccgtctccgttgcctcgccgtgctctaggtctggatgcctgctccccttcatccctcctcttctccgtctaaagccgtcgtgtttagcctccaggggcggctcgccgcggcatcttttttttttctttaaggtggtagtgcttacatggcgatgctctatgtgcctcttgtgcgtggataggttctcggatggaggccgaggcggcggcgaagagggcgcgggagagcggtgacgcggcggcggccggtgccggcgagcaggcgggtatctctgccgtcatccctggatggttctccgagattagccccatgtggcctggttcgttccgctctcttaccctctgtagccctgttttgccattacaatgccacaccctcttgctttgtaaattcgctcgacatggactacaggttcgcttttaatttatataaaaaaggtttatatagtttataaaggagtatattgtttctttccagaattaatgtgtccagttgaatctccgattgggcttcttgtatcatgggacggagcacatcgttagggaactgataaaattctttgccattttttttaaaatttttagcttggttgggtataggggtgggcattcggttttcccggttggtacagttcggtttgttcagctttcagaaagattggtttttaataatcgcaagccaaagtgtctgtgagaaaaaaaataaaccgcgccgaatagactgatctaccttggttttcttgttcggttttcccgaataaaccgagaaattggctactcatggtacggaggtgccgcaggccttgtgcgcgcactgcacggcgacgtttaggctggctgccgtgggaattagcgcatgatctagtggcctctaggggctggtatgatgctatcaatgggcttttgcatggatcgatggaccgtggacgttccacctttcatagacatgcatagatcaatttcctggtttcttcgatttttggagataaaagaccaagcaaattaccgaaggcctaacaagggaaaaaataaaccgaagaggaatccgatgaccgaaaaaaccggctcttcggtttggattggccttcggtttccggtgattttatgcccacccctagttgggtattgctttatgctgttcaaggcttcaagcaaccgtgcagagaaacagatttaccaccctaaaaattctaaatatattaattatgcaacttgcgaataagattttttttctggccacaacacgtgattttttgcgctctagtaatttttgaaataatgtttttgagcccatggcaggtgaggcacactcattgaaggtcgaaaaggtactattccaaggaaagtcggactaccaaaatgtgatggtgtttcaggtaaagatcttttattgcaccaatgctgctttttcttcgtcttcactcaaactggagtatgaacctgtgctgttattttgctttctagtcctccacgtacggcaaggtgcttgtgctggatggagtgattcaggtcactgagagggatgagtgtgcttaccaagagatgattacccacctccccctttgctctatcaaagatcccaagaaggtaatgcatctaatttgcagattgtatgttgtataagttgtaatcctgctggtgtataacgagatgaactcttataattatttgtggttaggacatgcatgtgtgaaatatattagacataatattattagaccttgtcgagaaaagtttgctcgtattcttttgttcatatcaaccatgcacttccaagtactgatgatgataatattttttactgcaacaaacaccaacttaatgacaaggaacttgacaacatgattttggactaattcagagccaaacactggcaacatgtttgctaccctattttaacatcaagttttgagtgaaaagttccatggaaacacaagcaccatgtgaattctagggattcctaggattttcctgcacaaacgttgtcatgacccgaggtcatgacgggataaacaccgccgggaagatagccgggcggcgtcggctcctggagaagggatgtagattcaggctagggagaagaacattattgggagggagagattagactaattgatattcattgcttaacttgagatgaatacaatccatcccttatatagagatgatatgacttgacccataagaaactaactcaaactaactctatctaatcctatcctatctcctaaccgactgctacagtactcgtggtactgtttatccgctaggacttggcctcgtgggcctcggcctctctgcccaacgcctatgacaaacgtgaatgcatttttacattaacagaatcttgtattgttcttagttttgctacttgtcagcattcctattaagttaattcttctggccagaacataataaagtaccatttagttcctttttcttgcatcttttttaaatcgacgtggccaaacagtt

SEQ ID NO: 61939 - DNA, 6536 bp, Oryza sativa
aaagctagatttcacctatgacctagcagttttaactgaaaacagcgttaagttgaagttgtcattaatccgcgagggttcatccaccttccccaagcctcgcttggtcgggtttaccctcgcatctagttttccacacttccaacatcacaatgaccttcccacccatcgggcaaggtctcacctcattcctaatataagcaagattaaaatctatgaggctagtcaagaatagtacaagtcccggtgctcattaaccgcgagcacgactattcgaatagattggtttactcacgctgcagtggatgtacgcttttaatcccacactccgtgacttgcccaacacatgagcctagtcccaacacatgagacccggcttttcggtcattctcgcattttggcacccgctccaaggactataaatctccaatgcactcctagcacaacacaccccctcgagccagcagtgaggggagtcctggcacttacgggatcataagaagttacattacatatacggcatatataggtgcattttagatttcctgcgtgcaaaacaacacaacccttcatcaacatcacatcatcctcatacagatccaccatgacaggggtgccgccccacgagggattcttaatccaccgggtctataccccgtcgaggagtgtggtcgtactctgatcatttctgcctagcttcttgatttgggccttaacagagtagggtcgacgactagcccgttccagaaccacccatattctattcatggcacccagttgaaaacattttgtttcattaggttttcggtttttgcaaaggtttttgcatcgcgggtggcgctcatgtctccacccatcttctagcaatcactctcaacgagtgaccaccacaaacacatccataaccaactacgatggagtgtataattgtctataattaagcaaatctaagcaatgtcaatatttgaccacgcataaataatagactcaggcaacaaggatataataaaggtaacaaaatcaaggatggttcacatacaactttaggtacgcattttataattagcatgcaactttatttataaacaaaacatttataaaatgggttcaacatgctcaagagggaagcgcggtgatttgccttgcttttagaaattgatatcttcacgaaatccacgtccgttgaatatccgcaatatctgatacgcagtcagtacgagaaaaccatataacaacctccaaataaactaccaaacatttcaaagtgccatcggatagatcttgattttagaagaattccagaagttcaacggtgtcaatcggagtcacggtttgcaagatatgaatttccgaagtttttacggatttataatccaagaaaaaattattcctctcattggaaaggaatattcctcacggggtccactgtcagtagctcaggaaggccggtgcatggtagatcgggtctaccgagtgcgcggcaggccaaggtggtggaccacgcgcgggaacaagggtgggtcccacgtgtaagtgtctatcggtacagagtggattaataggagattacatgtggtgggacccatccataagtgactcagtggtgagagacacttgagggggatcaggaggggttactgcccgaggtgtggggagggatataataaagacttttggtggaggaggtggcggtctgtgggttttggcccgagggagtagaagggaggtgaaatagacttttggctggtcaaacggtctcagggagaagtcaagcacctacaaaaaaaatttccatgaaacaacagatctgtaaggtactccttgcttgcaaaaatatctgatcaaaaggcagagaactgtcccacactatgcccagggaattccaacaattgatcaaaaaggggcaaaggaagaaaagatgttgtaaatcttctaccagctgagaaggacaaagaacacagcacagatcacaatttggaggcgcaaaatgcttatgatgaagcatatacttagtatttaatctattcatcagaagcagccatccaaaaactttcacttttgaagtaactttgctattccataaccatataaattgctggggaggttgcaaagcgcaaaaattcagagcatagaattttttataactatatctcaaagttccccaaataaaagcccatatgtctttctcatgatccaaattatgttgctgcaactaaatctgaagtgtctggaactcctgcaaggcctcttgagacagaggtacattgaaattatcctctgaagggactgagagagatttttcgactgaggaattaggactcagagcaaaagaaaacaatctgagcatcaaaattgaaaggggggcatcttaccacacatcataccagaaagagcatgaaactccatcacccacattacatttagcaatacaaatgaacagatccatcagactacagacatccttccaccaaaaggaaccttttagatttgacaaatgtgggattctgttaccataataagaagaccaaataaggttcacccaaggcaagtctctcctattatagaatttctccaaaagcttgaacagtagagcctgattctgaattgagaggttaataactcccaaacctcctttcaatttaggcttacaaacctttatcccaagccgctagggactttttgtttgaattcaaatctgaatccactttttgttgctccggtgcaatatatgattaggaaatggtcagaaaatgtgaagtgcactgctccaactgaatgcacttctttgattactcgcatagcaaaggggcttggggttctttctcatgatcagatagcttacatttcagcccatcgtacctatgttgatgaatcttacttagtgcaaggtcacatacttaagcatggagtagatggctctctcatattctttttcccaggttgtacaaatgaaatcccattacccaatccagggtatcatttgtacaactgtcttgagctaaccattcccctatagacgttagaggaatttcgtctaggtacgatgcatagggagccatgtaacatggcaagagaagagcatgaaggatcaacgtcctcaccaccagtgcagatgtacgaggctgactgggaatagggatgcaaggggggcaggcaagcgggtttttttagcccacttatctcacttctagttcattttttcttctaaattttgtactactatgtggaaaatgaactagcaagcgggtttttatgcgggtagcaggactacccacttgtatccctaactgggaaccaaccggagacgctcccggatggacccaagtaccacactacaatgccggaggttcagcctggtagagtgctagtgaacaccggtggcaagtgtctcaagacacatcgtatgggaactcccgttcttccagcaccagtggcatgctgcgaatctccaagatgtggcgcttcaattcctctcgaggggtcttgggagagctcactaggagaatggacgcactggagttgcaggcgggagaaatctagcacaacctcgaaggacacatggcccaaacgcaagaatggcagcgaaatgctgatgttcaattcgccaacatcaacaatttgatgcagcgacagcaagttgacctgcaggcatactttcgcttccaaggattcaacccctattagggaccctaagcgaaaagcaagcttgggggagatgcctctcccccactgaggtaacttgtatcacattgtatatttctttcatgcactgcatttataaacttgaaaacaatataaaaatttgcaaaatagaaaataccgaaaagataggctagatttgtatgctaggtaagacaacctagttctgcatgttgatatgatgaatagttgctctgttctatatctcttatgtatatgctaatagttaagtattctctcaagtttaagtaaggaaagccaaatattattcgggaacctgagagaagtaagttgcacattgcatgatctaagtctaggttgttgtgagatatgagatagtgaaatagagttactatagccttactccaaagtttgacttaaattccagataatttgtttttcaaaatgataaaattctaaagttactcatttgatatgaattccagccaatgccaaaaatgttatgcatcgttgaaaccttatacattttggttgcttgtatgcccattaaattttgtcaaactttatgacttatgtagatgctttttatactttatgatcaagatcatgcacccacatatgtgcacatgtgctaagtttctacactggaagctagcatctattccattccatcatataccatatatgtcatccactaaataagtactccatgatatttatacctctttttcaaaagaaaaataaaagaggagattggctagagagagagagagagagaaatattctctctcatattggggcatgaactctctcaaaaatattcttgagaaaaaatatatttagccaaaaagactctctcaaaagctttaaaaaatgaggaagaggtatacaaaaggagtaattatgttcatttcatttccaccatatattccaaacacgatgcacgatcttgatcttaagtatgatttgctatctgctttatctagattttttgacttagtaataaatgtgattgcaagtatgccttgttcttaatccctaacaaaccgcacatattcagctttagtgtaggagacaaaaaggcataatcttggtgaggaacaatattcatacacattgagtgatttagagaatcacttgaggaacttggttttatttgcaaaatcatttgaaaacttccggaataagagttaggcaatggatgagataattgtactctatgatctatgttgtctctcaaccacccaaggtgaagagaagcatgtgttacgacatgagattgggtgtgtgggtaagccaccatgtctacttgcttaatacgagagagagtactcaaactttgcacttgtacattctagatatataacatagtagcaactcctgatcaacaaccaagtttaatttttgtgattcctttactcgggatgaacaaaggttcaagcttggggggtttgttgacggtcattacagaccaatttcgaccatcaatacaactagaataaaggagaactagttatgcttgcaatgcatatttgttttagaataatctatttccacttgtacttggattctatctgtctgtaaataaagagatacaatatggaggagaaccgatagcaaaatactcgaacaatcaatcagatgctttcgagaatcagatttgtggagaaatgggctagaaactcataattgacatgatcaaatgggcccataatttactgatctgagtctagaagcagaagaggagacgacctgccgagtactaggctggttggcctagcccagggttcagggtttggctgaacagtaccagcaccattcaatccaggactttgatcagacggtgggaattcactcccaatgacggttggagggtattaccgacctttccaaccgccacaactgttgttcttcagctataaaaggccctcacctcctccactccttttcacactcaagcaagttcaagatatctcttctacactttagtttagtattctagtgctaagtagagtagaatagaatatctctcggagtcttcggaggaatttcggtatggctttagtagttttccttctttcttttaagactctcggagtaaatgaaatattattctttatatcctctcgatactttagtatttctgagtactgtctttgctttatatctgtatcggtacagtcgtaaagttagccgaccaaagaggtgcagtggtgtgggtttaatgtccgatactcggttactctatgacatctcgagggatgtagagtagtatttaataatgtagacgtggtgtctagattattaagtattattatctgggcatatatgctatgtgtcagtcgaggtgggcagatgatggtgacagctcagtacgggtattcctccacaatagtatatattcctaagaaactttcctggggatggtactcctccgtatttagccccggttggacaaccatgacaggttgtcggaagaaactccgcaacctggtgcccagttggacaaccatgataggttgtcggaagaaactccgcaacccggtgtggtctctcaaagcaccaggagggcactgttagggggtattggctatatggttgtatactagtaggtgtaaagtaaagttgagtgtatactagaattatagggattgattgttcttctatttctcttccacttagtttaggaaagattgaatgagatatataagtgctttgcttcatgtcactctacccaaataaatatcttaaccccatgcctagattttgattatacaagtggcatgtatacattattagcatagttatctcttacaatcttccctgggattaaagaaatacgatacctgtaatggtccagatgctatcaatccccg

SEQ ID NO: 61940 - DNA, 583 bp, Oryza sativa
tatattattctgcttcatatatactcaatgcgtggctctaaaatacgcgaaagagaacatactctgtcgatagctcgattagttatatcaaccacgtctgactctgaaatacgcgcacgacgaaaagaaaaaatagtatatataataatgttttaattttttttaaaaaaattgcatcttcactggcgggccacgtgtcagaactaggacagtccatatcttcgctgtcgggccacgtgtccatccacagaagccttacttcatttttcctagcgtgccacgtggcctaaaatactgagccgccagcaaagaattatcttcgctggcggccgacctaaggctaacgcaaatggagatacttctttgctggcggccgcattatgtccgtcgccagcaaagacatgtcttcgctggcggccgtcctaaggctaccgccagcgaagacatctctttggtggcgggcgttcctttctcggccgccagcgaagatgcattttggctggcggtaaataaccgctagcgaaaatcgacattttcactggcctttgctttctggcgggtgcgatttccgccagcggaaatc

SEQ ID NO: 61941 - DNA, 74838 bp, Oryza sativa
agcgtagctcggtgggtttttgtcgcgcgctggcctgaaccgcgggcgcatccgtgcgcggatataacacgaccgaccggcgggggagcagtagcgtgcgtgttttgcagcgagattttgcgttgggggtagctttgtcctggcatgcatgaaagcaaccactcgggtcgacgagacttgctactgttgggaggcttgcattgcatgcatgtgcgatgggacgcggcttttgtgtgtctctctgcgtgggctccatcgtcaccgcccccggccccagcagtggcagagaagggcgtacgtacgctgctgctgggtctgggtgtgtgtgcagggatggtttgccacgatcgtgcaaccccgcagccagcccagcgcagctacgtgcatgcatgcgtcgttgcatctcatgcgtcgtcgtctgcttcttccttggttcgatcgatagctccgatcctataattaattgcagcattttaattttgatgtatatatcagcgtccaatctacatatgtatggattgttaatttcctgtctacaacttaacgactagcaactatatatatatatatatatatatatatatatatatatatataacaaattgagacagtctcagcatgtgtgtacgtccacgtacatgcatttgattaagacgtcgacctcacataaaagtccatctcacagatatatatatgccgaggatctagctagttagtaactacgagcactacattattcatgatatttaagagccaatggcatgtcatatgtgtgtgtagctactatcttggtacacgacagctaaagatcttgacatttggtagctaaggtggtactacgcattcatgtccaattgtaagctgattcactcatcatctttgatccggcccatggatcccaatcaccaacgttttataacacttttttaagtactagaaaccgagaattatcaagaaaaaaaaacccctactggcctactccgcatatctaagatcatttgggagtcgactatttatgtttagtacattttgagttaattaattaagctcgttgaattgactcgactaaactttctattaattgtttatgcctgtatcccaaataaaagaagacaatctctatatgtttcatattatttatcatcctagcatttattttttttaatcaaaatatttttcattcttgcattccaagtttccaacataattttagaggtgaacttcccctctctacccttcacgaatgcagtcacaactcttattagcttatttgctttggaaaaactaatgggatgtacttataatgagagtaacaatgtaaactaccatatatcaattggtttgtgtgaggtttgctagaatgataagtactccgtccgtcactaaaagagcgtagttttagcgagtccactactgaaaaactgatctctgctcagtcgccctaaaaccacaatagtcccggttataaaaagaaccgggactaaagatgatttttagtcccagtttaaaaccccatagccattctacgatctttagttccgattggtaataccaaccggaactaaagatcatcccatgtcagtcccttattagaggggcagggatctttagttccggttggtgtcacaaaccgggactaaagatcaccactttagtcccggttggtattattaaccgggactaaagatctcctatatctcacgcgtagtatataatccctattccctattctctcccccacaaccggcctcaatctcctcaacaaccgacctctcctctcctcagatccatcgccctctcctcctcccctcctccccttcctcctcccatcccgaccctctcctccccctcctcccttcccatccgatctcctcctccccttgctcctcccatcccggccctctcctccccctcctcccttcccgcacgtgtcaggcggggccctgcccggcggggccgcacgcaggccgcgcacgggccgagtagcgagcggcagcaggcggcgctaccggcatccattctttttttctttttttataatttgtgattcactgagatgtataattttgtgatttgttgtatggatctgatatgtataatatgtgatgtatttggtttgtgtgtaatctttttaagatttgtgatgtatttgatttgtgtgtacaagtaacttaagatttgtgatgtgaatgttttgggatgttactttgatttggggtttgatttgggaatatgcatcccactcgatttgggagaaaatacagggattaactctggctaaaaaataacgaaaaaaaagaaagaaaaggagacctaatgggactgccgctacccgctctttagtccctgttggtaacaccaaccgggaataaagataggtatctttagtcccggttatttcacccgggactaaagatagcgatctttagtcccggattcgtagtcccggttggataaccgggactaaaggggggttacgaaccgggagtacaaagggtttctccactagtggtcaaaaaaagattaagcaagagatataaaagactactatgtcgtttattaatgctgagagaaaggccctgtttagatttcaacttttttctttaaacttctaatttttccgtcacatcgaacttttctacacaaacaaacttttaactttttcgtcatattgtttcaatttcttcaaactactaattttgatgtggaattaaacacagccaaagtaagaagggaaaaaacaaagaggaggagggagtaacgacaagaaaaaaaaataaagtactgaagtattaagaggtttactggacccactttaaagatatggacagagagtaaatgagtaggagtataattcagtagttttcatatatgggattatgggttgcctccaagtcgaacccaaataagatggactaattggataattacccatctgtagtaggaggctggtgattaattcacaacttatgtcttgttgacttgtggatcctccagctctagattgaagcttattgccatggcgcaatgaatgaaagggggtttgagcaccgagcccccagtaggtccggcactgttgttcatttctgatgaacatatgaatggattaattatgcgtacgctttctaaacttttgaacatatgatttttaagaaaattatatatatatatatatatatatttaaattcatttttttaattttataatagataattcattcattgttcatttaaataattatcacacattattcaccagccattcaacataaaagaacagggaagaagaagcaactatatggattgtgtccccctgatgataatagatactatgtactctctagcccgatatttaattataaagggggtgatctataggtgcaaatgaagatggtgacctggtatgatcaatgtggacaagtgggacataatcataaaaaggagtccagatactgaccaatgcaaatgctgcgtcagagattgtgatagatggagggccagatcgagtcatgaccgggctgtgcatgctactagctattactcaaggagtactgatccagtagtactacatgggaaggaattaggaataacaggcagcataaggcctcaatgacatgaaaatcttgtatgatgtattaatttgggtgtaagatcactgatcacaatgacctgttaaagttaaacacctatttctctgaaagtttctcgaaaacgtgtggggttgctgcatataaatccaccactgtctcgtcctgctctgctcactttcaggacgtgtccttggtgatcaaaatttcaacaatatatctacatattgcccatatcaccatctgcatgattgaaaccttggtaaattttaattttacttgtgttcagttgatcagttcacatgtgtctgtaccagtgaaatggagtaaaagagtgacagtacccggccgatcgatatgatatgatcgagccgctcgcggtcccctacatatcgatctatctatctatctatcgcacaaaagctgccgaaaattgaaacaattattgggatgataggaccagcaatgtaagctgcatcagaggcgagattgatcggttgatcagagggcgatatgtttgcgccgattgattcgagattttgtggacttcaagggggttttcctgtgctgtgctgccttttcgctcattcgaatcagagcagctgcaacgcatgcatgcgcttctgaaacctgcaaacgcctgaccctcaatgctcaatgcaactttgagtatattatcgtgcacgtggacggcacagcgatcccaatcaggttttggtggatagagtttgtctcattcgatccaatttatggctctgtaaatgctgtttttgcagagaaaaattcagttcattgttttccctgaatcacttaattaattaatctcgtagaggtatattggaaaaaaaacaaagaaaaaaaaggtaggagatcgatcaagaaggatgggcggcgaaaggtcagatttattcggatttaattcgttttgaaaattgtgcaagaccggcttgaaaaacaactctcagctacaaggaaaatcttcacgtcctttaacacttattgaaatcaatatgttttgacaagttatgtaagtgagaaatcgattaatcaatgcgatgttgtacatcatgtggaagaaattgccctttgttttcttgtttaattggtgcactacattactactggtaatgaattcttggctctctagttcattaattataggaaattactacattgtcgtggcaggctaaggattgttctttaacctttttaccgtggacgaaaagaaacacagagaattgaaggaaaggaaaaaaaaaaaggaggcaacaacgccacaagcaggaagatcgaatgtacagcaggctaccaaatagttgattaagaaaaggcactatttaatgtgactattcccctatttgccttggtactcatgccaaaaatagaagaattaacaagtgatggttatttaactgaccggtgggcccggcgctcttgtctgccctggtcagttactattaccagctgctttttaccctgagcaactctgttcaccccaaagtattgcatccgagcccaagccatggacaagcacacgtggtctttcatgccactgccactttgtacggcagtttgcggctacatcggatcgtctgcgtcgcctatgttatgctgccatattcatagtaagagtagtactagtgcggaattcgaattagaccgcgcatggagaaaagatccaaagcgtctgtttgggggagcttctagttgctgtagctactcctaaaatcagaagctccccaaaacagtctagcttttggtccagatttgagaagctgtaattgtagaatctagaaaatgaactagcagccagaagctgggaaacccagcttttccagattctcagaagctggctaccaatcaactgcttcttcgaattttaagctccctcaaacaggcccaaagtcttgtacatagacaaggaatatgaaatcttttgtttgaaaacttaagttaggtattagcacgtgacatgagcctacacgtctatatcagtttagcaaagcgtatagtgttaagattaattcaaaatgacaacgactcgtaaggttgagaatgggttctgacaatggtcggctatgtacctacaaaagatcacaaaacatatctcgatcaattcattgtgatatttaatgcccccaaagcatatatataagttttcacatttccgccgaattcatccagaaacacataatcgtggaaaaactaagcctattgggtaccgccgccaacgcgccggccacgcgagaccggaagcgcagaagatcctggctatccatggaccacacaaggcaggggcaggctcttccacaatcccgggtctggtgacatgagccacagttgtggcccgaacaaagtgacgtgtgtcgagtcgaacgccaggcctcgcgcacacatgcattgcactggcacccgctgcgcctgcgctgcatgcactgctgcgtcccagcattttctcccccttcttttgtaccggcctcccacacgcaccgcgcgtcctcctgctggccaaaaagccaaatgttgtgctccaaacggccggcggttccggcggctcgacctcgacgcgacgttgctttgcttcgtgctcgtgcatatacgggtcgttctttgcttttgcatatttatattgcaaacggtgcgtgtgtgatgtgtcgatcgaatcctggtcaaatatggcgtactttattctcgcagtttgagatcgatatgctattgcaccgaacgctgctcagagagggggctttctgaccagctggtaggcaggggtgcaaaaaaccagagtctaattttatatgtactctaatctaaattcattagcctgatgatagtatccagtagccacatagccaacaattagacaattttcttttttaatgaaaaatcaggttattttggaaaaatattaaaacctagataaatagacgtgtccagttaaaaatatcactgcacactgtgatataggaagtaacaacagcagcctatcgatgaattgaaccgatgacctaaggttgccgggtttttgggtgcacccatgctttggtactagatattgcaacaaaagagcttcacaaagtgttttcttttagttgtatgtgttgtaaaattgctctattgtagaaagagcgacactgcaataaaagaacttatcgaagtgtattatgtgaaattactctattgcagaaagaacgatcaacgtaacggtctacatatgtgtttgtacgagatttaacgacaacagtcaaagcacaatttttttttaaaaaaagaatttagtcaaatcctatctctctctctctctggaacgttgggtataggcgtgcataaaactgacaatttgatcacttatttctcttaaatggtatgactaaatgttgaaaaaaacctcatcagcgttttatatagttttctgtaaacttcttattaagaaactactatatgtcaaagttagtaatttagaaatttagaaaaaggagggactaatttctttccttgcaggaattaaactagctagctaccggaattcctacgaaaccgtggacttattatctactctccgtcaaaaaatacttatattttgggacggagcagtatcgatcttaaattaaggcctcgatcgagagtaagggacggtaataatcccttccggtacgaaaaacggagcagaccattagtacgtgattaattaagtattagctatttttatttcaaaaatagatcaatatgattttttaagtaacttttatatataaacttttttaaaaaacacaccgtttaatagtttgggaagcgtgcgagcgaaaaacgatctagtagcgggggcggttgcccgcgggaacgagcgcaccctaaatctgtcaaactgtcaaagcggcgtacacgtaccgtgcgtgctgctggtcctcctgggcctggccggcgcgcggctatgtgcacgatcacatcgacgacaaccacgacaacggccgtgcgcgtgtcctggcacacacacatactacaagatcagatataaaaataataataaccatttatctcctcacttaacttctagccatagaatcatgtcgttcgtcgcggccatgcagtgcgcgcggtacgtgcacgaacacacacacacacacacacactcgtactcgcatcgtcgtaacgtactacgctggctggcctggcatattatgcatggtacggcgcgcgatggcgtacgacgacgcacgggggcgggcgatcgaacggtcgcgcgtgcatgaatgcgtgcggatccaatgcgatgctactccagccggcgacgacgacgacgacgtacgacacgaggcctgatctctctctctctctctctctctctctctctctctctctctctgctagtgcttgtcgtggtctcgtgatgtctccagttaatcgcgactgtttcgacgacccccacacgcacgcacgcacacacgcgcatacacacgcacgggcgctggcctctgaccgtgcacgcagacgtcgtcgcagaggaggaggccccctgccctgcagctgcgagagtacgtggccgtgccggctgcctgctgcctgcccggctgcacgcagcaggaatgcatggcgcgcgcgcgcgctgcatcaaaaaaatccaccgatcgaaacaacaacggtctcaggttggtaggcaggatcgcagggttttgctttgctctcctaagctacagcgatccgcctgctcacccactgttgcgtacgtctaaatccctcatccatcagttttttcatcaggccgtacgtcgtcgtttcctcatcgatcgatcgatcgatcatctctcttcacccaacaatatatgcagcaaattaattaaagcgacgacgttacgttcagcaccctgcgctagctttccctgatgaattctgaatctctgatgatatcatacacaccgagatatggttaattatacatactggtatgtgttgtatacatggacacatatatgcatcactgtacctaaagctgatggagtctgagatgagatgactgccgagatacatacatgcattgcatgcatatgcatatgcatatgaatgctagctaccacagcagcatatactgcatatatgcacgcacgcatgcaatctagcgaagcaggattgttcaaatgtggagcgcagaagacatggatagcgacctgacagagccgatatgtatgcatgcagacaagctgattttggcctgtctttttaatgtgcactgctatgtgtgagatccttgcactgtgcatgagtcaatgcgagtgatgtcgccacagtgaagttggataggtggccggctgagatcagctgtgcatgcactgaaaaaaaaaacatatgcatgctagctgctgctagctagctttgcattggccttgccttgccttgccagccacactctctgttcgttcgagagccaggacgacagcttgagccatgaatatttttgtacgtgtatatactagcttgcttccttgacgtacacatacataaattacatgtacgtacaatatatacatggatgtgatacatgcatgcatgcatgctgccatgatagctggtatacatctagctagtcgtacgtacgtatagtagctagaaatctttatcacgacggtacgtttagtggggaatggatatttgtcttattgtcaaaagatatacagtagtagtatctgctaatttctataagaatcttaatttgatcaagtgatgagatcaataatccaatgtagtgtggggacagattcttacctagctagtggatgggatagctacgtaatgtgtataaatgttcggtggttcgatgactaaatctttaatctcatttgggacctttcgatccccttaattagggttcctagctatatatttgttcagttcattaactagctgaagagaattcctagtattgacatagggtcaaggcaatatatgccaatgctctgctgagagctacgcatgcaacatttcttacgatctctgcttttctgtgtacttgtagttgcctttcagaaagtaaaatctttcactgatcctgcaggtaggggcctcactctgtcatttgcatgccaaaagaaacaccctgctcaaactcaccgtgtagccggtcggccccaatgcaagggcaagctccgtgtagatcacttgaattttgtgagtttcagagtgtactcagctagttagttttttttataacttgtccacccaatttcaaatcgggtgcttaaatttttagctcttttttttttgcagttgtaggtaacgtatcacttaacatcaagacgacgagacgtctgcactgactttgtcaatctcaaaatatccctctaaactatcagaagtgctcatgaaaaatgaggtgtgtgtatatgagggggcctccatttttactatgtttcgcaacaaaaaattacatgggacatgttaccatgttattaccaatcaaatgtttttctttcaaatagtaataacgtttttgattgattaggatctattcaagattcgtacaacactttatatatctaaccactccctcttattgacccggccagtattgccgccactccctcaaaccagtgtgccattgccctccacctcaatggtgctgcaccgaccctagaaaggcccatgggccactcccagtctctccaccattgtccccttcctgaagtcctacatcaatttcctcgcctcgcctcgcctctcctccacaatctcaagcagtgtgaggcggtagatccgccgcctcctaaccactctgatagagtccccctatcgccgacatcggtgcactatcctcctctcaaaacattgaggcgacgcgcactacagtcccaactgcaactaccatctcgtgcgaaccgctgtcatccgaccatccctttatgaccggaaaaccctctcttccccctgtctcaaccacttttccatctcgaaccctaatatggcacaccgtcaccgtcatcagagaaggcctcactgctaaggacgatgggatcatgtgggaaactgttttaaacactcgggtggacgtccacccgtttcttgtatgtcatctaaatggttatgaaaaattttcgacatgataggttaatatgtaatatatcatctcacaaacatgctagttcaaattcgacttctacaaattgtaaaaaaaataacaaatttgaatgtgaatatatgtatactagttagagtttaatttgttatttttgttacaacttgtaaaagtcgaatttgaacttgcatgtttgtgagatgatatattatatattaacctatcttataaatatttttaaaattttttcataattatttaggcggcatgcaagaaacgggtggacgtccacccgagagattagaatccatctccgggatcatgtctcttttggaaagatagatggtgagcagattcgactgaaattgttatggatttttcaatagtttgacgaatagcaagggatgtaatacaacgtacaatttactatacgtggggggaaccggggcccgtttcttgcatgcaaaagctagggaccgccccctgatgatcaacaaatttctgttgtgatataacccggcctccaataatttccagtgaaaattattctttctcttgcattaattgtgtagcttgtttttccttctgccactagccaaacttcctgttgctataaatgagcgtatattaggtcacgcaggaccaccgttacttatagctaagccagagatcgtatatctcattatactgtaccactataccatatgcatgcttgcctgtttgtccatatggggtatatatcaggtagatctccatgactgcgaaacacgaatatatcgatttccatgactgcgaaattaacaattggaaaatatatatatacatgtgtgtgtgactgattaattcagccatgcatgtatagtgatacagatacagggtctcatcgtttaccctatggcttataagccaaaaccaaaaattaaattttaatacttgattttaaatttgattttgattccttttcaatatagtttttttttcaactttagcttttcaatcactaaaaacatatatacaaaagttttacttacatattattttttaatcgctactccctccgtcccaaaatgtagctatttctagcatagtgtcttgtcccaaaatgaagctatttcttcacctacctcctctcaaccaatcacaaccatttttcttcacctactttttcttttcaaccaatcacacacttcctccaatcattctcacttactttcttaatacccgtgccaacctcaaaaatggtttcattttgggacggaggaagtatgtattaagctgttatggtttataataaaactagaccagccgatgaggaccacagccaattaataaccgtttcgttgcttgctgatcatgtccgtgcacgcgagacgacgacggcggccggccgggcattccaccggccggccggcgcgtacgtacgtctcgagccgacgagaggcgacgaccgatcgatcgggcgcgcgactgcgcgtacacatgcctgcgcgcgcgcgtgcgtgtcgtctcccgtctccccaaccggccggcgtgtcgcgtcgcgcgcgcgcggcgacccgtccgggcgccggccggcgccgtgcagcgagtgagcaaacctcgccgccgagatcacgcgcgcgcgccgtgtcctcgccgccgcgcccgtacgcgttcgcgcacgccccgatcgaacgggaagcaaaaaataatataataatactgtaatacttggtcttttctcctcgtcgattttaatcggtcgtaagttaattgggtacgtacgatcttaagaattaattgcgacacgcatacatgtagttgacgggttagaatttaaggatgcggtacatatatatatgtgctgtacagggcagtgaggtaaaaagggagcagtacgtggtaattaaccaacttggccggaaaaattacttcgtgatgagggcctaattagagtaagtttgatagtatagcccactactagctccaatttatctatagccaatctaatagccaattcatatatacaataattgcttactgtactattagtatatggtctcacctgtcatacacatattatgtcttagagtccatactgtagctagctacagatctatagtccgctgctcttctctcttatcttttatctcattaaaatgtgtttgtagctagctaatagtctgctattgtatatgagtaggggcatggaatatgtgagccagcgagagtagccggtcgggaccagcaatgattccgtcgatcgagattgtaactgtttccaactcggcaagaaataatacggcacttatgaacaattcggtttttaaactccggtcaaaaagatgtaataaaaagaataaaaaacaaacgcccatgcatgggtacgccggaattcacttgactggatataatctatttttttctctttgtagaagttatatgttgagctgtaaatttgtagagccacagatagcgccgttatcaaagtttaaaatattttcaaattttattattgtttcatgagctttaaaatatcaatgtttaaatcaatcttaattaggtgcttctaacctaggtagagagagaaaattctaataaatgctagtaaggcataagttaatacatctatctacacccgaccaaattttagtggaaaaaacaacttatatagggaggagaaaaattagaaatactatcatggaataaataatattagtccagtgtaaaataagaaaaaaatagtttagggggttaaatgtattggtgaagtttaaaaatgtaaaatggacattttcttccaccaatttcattgggtcactcgttttaccttgggtgataggaggtgtaacatttaagctagtaattaagatatttgatatatctcgatcggtacctcttaattaagaccataaaatttttcatggctagaatgcttatttctccatggaatgcaattatgtattagtaatcttttttgaaaaacatagaaaaaaatatatgcttcatatttagtttacataaagtacaattataaacctagcttgagcttgcttaattaaatatgtaaatattgaagaactcgtggcaggttatcatgaagctagataaagcgcacacgccaatttctcctatttaaaatgaagtttgacttcattgtgaaattatagcgtctgcagatactctgtatatgttttttccctgttgtgtagtacaacttatgcaaaatgaaagacacgtgctgacgtgcatgtgagcacaccacaccgcttgcacaaactcacgtgttactagttaccacaaggtttttctctttactctgctgtctagttggggttgttttctctaagttaactgtgtctgttttttcaccttctatgtgtaaccccacgatcaggtcaactggttgtagttgtacaagtttttctttcttctgctaattaatatatcaatgtgtaaggtttcacacggtaataaaaaaacgtaacggccgatgttaaatttttaaccttactaaattttatcgtactaactatacggggttcactttatagggcccaagtatcaatgggtgatggcggtaaatctatcttaccgccaccaccataagaaacgtttaaaggtataaagattagaagagcacctatgcacgtaattgcaaccatgaagatttgattcttagtctatggatcattgaactcacctttgggcttcctttgttgtatgagaaattttatggtccttaaaaataatattttgaagtatttaaatttgaccttaaaaattttagtacctcgagatatctagtatctgaaggtatcaatttttatactagaaaatatgatgcctctcaatatcttcttagtgatagtaaaattctcagtaccttctcaataatagtaaaattacccttgttgtatattacagtttgatcataatttaaatatcattagattatttctagtctcttgaagaaagctataagaattataaaaaaacttaatcaaacaacacattaatatatgttagtttgaccaaatgacatgttaattggacaaggtttttgtgcttctttgggaagttgctctatccatcctaaaatataatagtctcaacctcttggtgtctgaagatacggtaaattattttttctgaaaaaaatacagtacatccaaagaaacaccaaaaaaaaaaacctcttgcgacagtgtttcctccaattttggtctgaattcagggcttaaaatccaattagccaagtcaattaattataacagaggtcgactagctagctagcatgtgaaggctgcacgcctaagcaattttggcagcactaaatgtttgcaagtgccttgacgcgcaaactttcgattaattgcccaaataatgacacgatatatactctctcatccatcgatcgatcgatcgatcgatcaactaattaattaatatttacagctagagatcgatcgagcaggaagcaaagacacacttaattgcatacccatctgtaaaaaggaattactagctagagccgtaatccgtagagccagcgcgagcgcgcatgacgggtaggcagtacacatgtacgtacacacgcgtccacctctttacgcaaatacagtagcagtcgctggatcatcatcaagattaattatcctttgtggaaatgggagggctcttgcgatgatctgggggacgatgtatcgatcgatgcgatgccacctcactccgatggagccaccaccagcaacagctgcagttagccatggatgatatgatccattggaagagtagctagctagctgctgctgctgctactcctagctgaggtgatgaggtcctccgttctgtacgtacctgtccatgagatcacatctcatgaatgggaaccgtccggcccggccggcgcccccggcgtcacggagcgtacgctccatcggcgcaagcgccatgtacgtacaccacacaacacccccccccccccccttctagctacaaccttcttcagttctccatcccccacatgctacaagctactacatgccactagttgcacatacctgcactgcatttgcgcgcgtgcgatcatatttatgatgtacatatgcgtcagatattttgtttaggttcgtactaataagatatgttatattcatattatgttgttttattttggaataaagcgagtatgctactaaggccttgtttaagttcccaaaacaaaaaatttttcacccatcacatcaaatgtttggatacatacatggagtactaaatgtggggaaaaaaccaattacacagtttgcgtgtaaattgcgagacgaatcttttaaatctaattgcgccatgatttgataatatggtgctacagtaaattttgctagtgacggattaattaggcttaataaattcatctcctagttttctggcagaatctataatttactttgttattagactgcgtttaatacttcaaatatgtatccgtatatccgatgtgataaccaaacccaaaaattttcccccaactaagcaaggcctaaccctggccggtcgatatccatatatcatggatcgatcagcctgttgcattgttcaaggcgcacacatgctatagtgacgtaccatacgttgaaacaaccactactactaccactacgcctaatatacggatggaagcaatggaaaaacggtggccaagcataaagcgggagcagcagaggccgcagcagcagcagcagctatcaccccctcaccaactccaattaagatagctcccggccaccccaacccaagcccttctcttctctctccctcttctggtttggtttgttgctggccctagcatcagcgagagaggccagaggcagacaggcagctgctgctagatatagctagccggcaacgcactccacatccagccgccctcctgctcgatccatccatccatccacccgaaccctagatagatgaaaaagggcaaaaccatggcatatgccgcgcgatccatctctgcgcgctgctgatataagagatccatcgagtagtagccctgttagctagagcgagctcgatcgatggagaggatgatggtggtgtccttgccgcgtcctctcttccattcctagtcctttccgtgtgtgtgcgactgcgtgagtagtgagggatagataaaggagggaggaggagacaggccgcgaggatgatgaacgttccatccgccgctgccgcgagctcctgcgatgatttcggctacaacgccaccccgccgccgccgccgtcgcttctcccaatcatggaccaggacggcggcggcggtagcatccagagggatcaccaccaccaccacaaccaccagcagctcggctacaacctggagccgagctccctagctctgcttcccccttccaacgccgccgccgccgcagcacaccacgccaccatcgcccacgcctccccacatgacctcctccagttctacccgacctcgcactacctcgccgctgccggcggcgccggtggcggaggcaacccctacagccacttcacggcggcggcggcggccgggagcaccttccagtcgtactaccagcagccgccgcaggccgcgccggagtactacttcccgacgctggtcagctccgccgaggagaacatggccagcttcgccgccacccagctcggcctcaacctcggctaccggacctacttcccgccgagaggcggctacacctacggccaccacccgccgcggtgccaggccgagggctgcaaggccgacctctccagcgccaagcgctaccaccgccgccacaaggtgtgcgagcaccactccaaggcgcccgtcgtcgtcaccgccggcggcctccaccagagattctgccagcagtgcagcaggtcagtgttcatcgtcgtgtttagtttgctgctcgaattcactattctccgatccactgttcatcgatttcccagaagaggatgctggcccgatttaatttgctttgtccgattgattggtttaattaatgagacacacatcttgttgcggcgtgtttaatttgattggagaatatgatttgtaggatcagagagttgcattaattaagtgatctggaagttccattctgctcactattgagatcatatcgaagggtgaaactttaataataaatctcctaatttaactacctaggatttaagcttttctttttttttcatacaagtaatttcagctcatcattagccgcctgtttgccctcaaagtaattacgttagttggaacagtcagatgaaattgaagacggcaattgctttgaactttaattggatgtgtggtaccatctttggcctcttttcctgagttcttccggttccttgcctcatgaacccatgagcagttcaatgcttgctctacatttgcccagatttccttgcctttacatttctttgaaagagagatttcttcctatacaattatctgattcttaactgcttaaactgatatttctagtattttttgatgaacaattccctaatctgttctcagaaatttgagctaaattggatgcatttagcaagctattgctgcatatttgatatatacgtttagccgatttcgcaattagctatggtgaggagaaaattttgcacccattttatattattgcctacactgcaggctaattaagataattcgtgtactatagttattaatctgttcggacacaatatataaattttgaattatcgctgttctgaacacataaacgttcattcgctttgcaaaacaaaattacaaatagtatgcgtgcatgtttctaggtttacccaggtgatgagctagagattcatatgccatctttttctttctttgtgtttcaaattaaagatctttctttggagaaaattgtgtttcaaaatattgatttctgtttaattaaattgaatcctgatcactatctatcacatgctgggacttgggggggaataaccaatatctgtacaaatacatattgatcttgtcctagatagagttgcttattttctcctcctttggttattgttccttgaaactagcccttcccatttatttttcttgacttctccttcgcatgtttgagtggttacttccaacagtattcgagacgtctgtacatgtattttggcctcacaaagtcagaaacaatgcgactttctttgcaagtatagcaaagactttgtacagcccgctcacgtacatatgtacgtaccagcacaagttgcatttgcaagcaacgtgttctttctctctctctcattctttttttaccctgaatgtgtggccggccgtcagtaacatttacctcactgagatgaacggctcggattgattgagaaactgaagaagaaactaccttcgatgcctcctaagcatgcacgtgttaagctcagcaatgcatttaagggaaaacaggaaccttttgcagtatggcacaccatatggaaacactccatatgagtcagctgcaaaactccaagctgtctctgggatggaacagtttaggtgtatgtgcttctcgtgctcaggatcatcattagcttacatattggtccccagaatgttcttttcatcagtagtttcttctgaactgaagtttgatctggcctgagcaacctgtcattttgtcttcgctaatgtgcacgtttatgtaggaaatatgcatgcaggatcatgcaacaagcttctcaatcgtagaagtagtacttcatcttccatatcctttatcgttgtaccgtagtatttcatgtgtattcgtcttcagctcttcgtagttgcatgcatccctctcatttctgtatgttaaccttttctaacctgttcaattattcagattccatcttcttgatgagttcgacgatgccaagaagagctgcaggaagcgactcgccgaccacaaccgccggcggaggaagtcgaagccgtccgacggcgagcattctggtgaaaagagaagggcgcaggcgaataaatcggcagctactaaagacagtgcgtgatatctctctctctctctctctctctctctctctctctctttattcagtattttcattcatgatctcaaccacctgaaaatgcatgaatataacatattctacaccatttcctagatagtcctaagatatgatgcatgaatgggttcttaatctgttcaattcctagataattaaccgatattctacaccatttccttcataattgacagaagcaggaagtagcagcaagaacgcaggcattggagacggtttcgagacacagctactggggggtgcacacatgtccaaagatcaagaccaagccatggatctgggagaggtggtgaaagaagctgtagatcccaaaggtaaggcatcgatgcagcagcagcagcagcaagcacatcatgggattcatcagcagagccaccagcagcatggcttccctttcccttcgtcgtctggctcgtgcttattccctcagagccaaggagctgtctcgagcactgacacatcaaatatagctcaagtgcaagaaccaagcttagccttccatcagcagcatcaccaacacagcaacatccttcagcttggacaggcgatgtttgatctcgacttcgatcactagtataattaatatttatcaatcatctcgatctctccttctctctctctctctctctctctctctctctctctctctctctctctctctctctctccctcgtacgtgtgtgtacgtccagacatctcttttcatcttgtctctattaattactgtaatttggatataataatgatagcttatgcgttattgtcatgtgtactggcagttttcctcgttggagaagctggttaattagccggtacatcaaatttagtgtaatttatagtttggtgccacaagaggctagttggtcaattaatttcatctaggaagaatgcaccacatgaaagttgtacgaatttctacataactacctgaatttttcgtgcaattgcacatggctagatattgtagttctttgactatatatatatagttttaatttattttctattgtttttgtatttatttccaaaataaaattgtatgtcttatacaattgaattacgcatcactctaacatatatatgtacaaaatgatctacatatctttgtaatatatggatataccctgatcaggaaataaatagacatttatatttttaatattatagtcgacatataactagatagggcgctctaaaacaactatccactaccttttttttcatcagcgagaaaattttagtatagtctaaatacatgacgaattgttaattttttgtttaccggaaaaacagtgggggaagcctccacggttaaatttcatatatattaaaaggaaagaaagctgtacatgtaagaatttgacaacttaatttgttaactttgcaaggttaacgcacaatttgcttaactttgctattttccgcgacatgattctctttgttatcttgaacatataatcgcattgtccatcatggtccataaaaattgtcttatatacccatatatctaatgtcaataattgaacgtagggcgcacatcaaggcacatacacatgtacgcaggggatgcgataaccgaaaggttcatggtcgtatataataaacaagttaggccagaagagatatttactatacatcatccatgatctgatgacgacaaatatcccattgtattttaattatattatcatttatcaaaagcattcactgaatttagttggacgcatggttacagtggaagccaaacatgatcaaatcacataatcgtatggccctgaattttattttgaaacaacccgtacaaaatagtgcgacgtttctattgatagagcaggaaaaaaatacaagtctatatccctggaagactatagccagaaaaaagaaaatacagccacaccacatgtctacgtctaatcctactgttagaacaaaacaaacacacagcacccctaagtaatgggtcttctgaacgacgcctccaaggagggaacgacgccaagtgtgccgccatcgcccgtcctgtatctccaggacgtgggttttcacctaaagaacccattgggagagggaaggaaatgcagcaacgccccaagggggaaagcggcacccataggcgtcaccattgccagtatggccctgaattttacaattaatcataacttgttccaaaggtgcattcaaaatgtttatatatagttgatgtgttgcatggatgcacacacggatcaagactataagatcttcagggtcatctctattaattatatactacatttttttagaactaattatatgcacactcactggagttatctttataggattctaagaatctgatgaaaatgtttagatctggccttatccggttatgcatatcaatttacgacaattgattattatcaacatatgtttccagtacatcccccaatggaaaaaaataaccacaagcaatataatagaaatagtccagttaaatttacaccaaaccatcggctaaagttcctagttctaactgctactatacgggaattaaattgaatttgttctttgttagaggaaattcgaatttctatttgaacttacttgtactcgaggattgactacgacatgtcctaaagctagccagttctgcacaaaactttccaatttagtatttacaacgacatgtaaaaggagtgaggttttaaaagccccacgttttatagtcaaaattgtaaaataccacaggtgttatgacttttggcatttaaccatagggttttgtggtttaaatgtttcataaacccgccgtcattcataatttgattaatttcagcatatttggattttctttttttaaaataaaagttgtgaagagtaaaactatcagctttagtaaaaacttaataactaaaaatttcatatgaagttatactgatagttttactcttcactactttttagaaattcaagtaattgagtttgtgctcaacatgtataggagtgaggttttgtgaaactttaaaaccatttacctagcgactggagttatgagccaccagtcataatatcaagggctttatgtaactttgactcttaaacatgagttttctgaaatttactcgataattaatgatattgtgtttcctttactttctctaaggtaaattgcacatgagttttaagtgcaatattgtctcccaacaattaaattgttgtttttatatcacgggttcaaaacaataaatcctttgatcaggattttttgatcatgtaactgctagcaaatcaattatcctcggctaaggtcgttcatatatgtacatagatggaaatattgatccagggtacatgcatgcatatgcccatgctctctttgacgtcatccatagctactatttatgatgatacatctatgtaaactaacgatagacctggtactgtaacttatcttaaaacttgatcattgacgcatcatgacttcatgaggtagcgtcagctacacagcgcatctagcactgcatatcctttgctcgttactatttaattgacattgtccggcatccattccaacattatttattaagttgcatgcaaccatttcatccaaaaacggaattataaaatgcaattagggtaggggggaaatggccctttttatttgtccttcgtacatagttactcgtacttgcttttagaaaacaactaattaagctgtactatatatttgttttgggtaacagaacaaatattatgttcggatataaatacaacgggattaaatcctaaatttaacagtggtgctcgtacttatggttaattatttttaagttgtaggcaatgtatgcatcgccaatgagacagctatagtgactttgtcaatgttaggatatgatgacttagtatttcaaggtgtttatacggatatggtatacgtgtgtgcatttaaaggggcaggcgtttgtgttttttaaaaaataattagtgaaattgatattctctagataaataattgccttttatcaaacgcattgatgtattttgtcaatttttgtgtgaatatgtacttaattattgagagtttggaagatagaatatacatccccgacatctacatctaagatgcacttaaaacttaagacccatctgcagctacaaatgcatataagcagctcgtgcggccggtttcttattcactctatataacttaccaactgcatctgtttctttttttaggaaaaggtagaacctacatattaattggctattgttttggctcatcaacctaaccgtggaacttacaaaggatcgatgacgaagctaatttggttacgggcacccggttgttgaaagttgacttatgcacacaactaaccccaggaggcttaatgcatgatcgatcagctagcttggcctcatttatgaagtagtgcaacgagagctaggcatatgaatgccagatcaacagtaagacccctattatgtatgttgtaccttatattctggtactagcagattcatttggcaccattaattattagaggagcgtacgtggtgttgcagttatttgtacaggtacgtacgtagcttgcgtttgcaatttagctagcatatgcagctctctgcaaggcactgtaatgcatggttggttcatgtgagagcttagctaggcaaggtttagcctcgatctgaagctatctatacttgaattgaaggacatgttgggtgctgtctggtcggtaattgtcatgctcatgcaaatatgcaatattttcacagaaagaggccgcccaacctgcggctgtttggtacacagctggcatgatcatgcatgtagtagctactctctccgtcccaaaaaaaaaagataaaccctgggttttcgtgtccaacatttgaccgtccgtcttatttaaaaaaaatattaaaaaaaattaaaaagacaagtcacacataaagtattaatcatgttttatcatctaacaacaattaaaatactaattataaaaaaatttatataagacggatagtcaaacgttgaacacggaaactcagggtttgtcttttttttttgggacggatggagtagctagctagctagaatccaatactagttcacgctttgcgaaggaaagaaatcaagaaagtcgatggccgtacgtacgcaagatcgatcggttaattgatcgattagccgatataaattaggccaattgattgcacattcatgcttcttaagaaacttaggccaggtgatcgaggagagtgagagtgtaagaatcagctgttctaacttctaagtaattaactagtgaaaatcagaaaaaagatggttccccatcttctatccttttattttctgaattctaaaactatatattctcacaatcctaagtggtgatctaaactatttgggggagagctggagattaatttgaaagaagcttcccatatcagaagctcagtagtgtacacggccttcagtactaactccgcccgccaccgaggcgccgatcgcctcctgcaggcggcgtcgcacgtacgtacatatgcgcggcgtatttctgccgatcggtatgcatgctgatgtggtgtgtttccgaaggacgcaaccgcgggcggccgcactccgcgcgcgcgggacgacgtcccctcgtcctcgtccgcgacccggccgcgtgagaatccgtatttccgcagccagaatccgttcttggcgagaagccaacgcgcgcgctgcgcggcggccgggtaggtggccgggcggagaggaggcggtacgtacgcgcgcagatacggacgttgcgtgggtgggtgggggcggatcgatcgggctcgccgccgtataatccgtggagggatttcgtgcatgggatcgtcacgtacagtaccatacacggacgtactcacgtcggtgattaattggtatctttactaaccgctcacgttttcatcattgttttgattgtgaacctcgcgctacctgcaacaacgccgttttctgggccgtagtgtggcctgccacacatggcctaagctcaaattgggccttttgagagttacattgcaccgtccgttttcccgcggcccaaacagcctgtagacgagaacctccacggcccacggtctcggcatgtgagctgtgaatttttgcgataggtgcgggtgggaataagttcacctcgtgaccctcaaaagtgatcgaaatataatccgtgaccctaaaccacaaaactagatatcttgaccctcaaactcttaaaactggtgcaatttgactacctgaacggttttggatggcggttttgctgacatggcatctacgtggcggtattgaccgggtatcctttacacgtgacgttgacgtggcacttaggtggcattagaatttaaaaaaataattcatttatcattcacacagaggatgacatgcggggctcactgacatggggacccactgacatgtggatcccacatgtcatcctctctcatccccttcctcctccctctatctcccttctctcattctctcccctagcctctcttcaccaccggagcggcaatggggatggcggcggcatcgtcgggtgggagctagagcggcagcggagacgacaagggcggtagatgcagcggccatcgacgtgctcatgctggacggcggcggcgaccatcggcgagcaggcgggtgaggaccggcgagggtggtagatgtggcgaccatcggcgagcgggcgggcgaggactggcgagggcggtagatgcggcggccatcgacgacgacgggctggagctggagtggcggcagctgcgcctaccgctgccatcgccgccgcctgccgaaggggaagagaaatcgtcgggaactcgtcgctcgatgccgccgtcgccggggtggaaggggccgagcctgcctctgccgctctccgtccatctccggtccttcccttctctctctctcttcctctcccccttcctctccccctttgctgcgctggagtggcgggcgaggccggtgaggcggcggcaacgacggacaagggctggagcggcgttggtggcgggcgagggccggagcggcgacggcggcgagcgagggccggaagagagggaggagaggcggcgcctcccgagatttcgcccgcccaccgcccctcgtacgcccgtaaagccgacgactaccgcaatgccgacgacattgtcaccagggtcccctcctacgcctgcacccgccttgccctcccgccgccaccgttggcggatcccgcgcaccactgccgccgccactggcccccgtcagccgtcacacggccgccgctcgccgaagggaagagaaatagagagggggaggatgattttatgtgggcctcacgtgttagtgggtcccacctacacttttggtggatgacaaatgggtcccacacttttttttttatttctaatgccaactgagcgccacgtcaatgccatgtggaaagaagaccgagtcaataccaccacatagacgtcacgtcagcaaaaccgccatccaaaaaccgcccagggagtcaaattgctccggttttaagagtttgggggtcgagatatccagttttatggtttagagtcacggattagattttgatcacttttgaggttcacgaagtgaacttattccgtgcgggtgtatctgatgtcgtgtcatgtttcgatgcaatcccaacccatggacatggcacgttcccgtacctttcgcatgtgacatgtaacatgttcgacccgtcggcacgggcctgttttgtactgttgcattgcatatgcctttcgtctactagtgtgttccatctcccatcacgacatctcgcagaagaatccatcgatctagcgtgagcatatgcagcatggctatacgtacgttgatccattgataattccaaattctctccatcggtgaataccactcacatcacatgtaacgttctttttcggtggtattcgcgtacaatagaacgatgtcaacaacttctgcaactgccaaaagaccaaaaccaaaccctcagatgtcacgagtgcttttctggtcgatcaccgtgtaccacaccaagctggaacaccaagactaggaggcaaggacataacaatgcatcacccatcagcaccattctatcatccattccgtctcagctcaaagaatcggctacaaaatcccaccacaaaacatataaacaacaaaaagaaaccaaaaataaaaagaaaagaaaaaaaacaccctgcatctgcggccgaaattaattaatcgtagtactactactacgtgtttttctttcaccatcctacccagctaagtactccactttttaagtagcagaagatgatatgcaagtactacgtaaacaagctagttgacggcggtgcagacgcggcggatctcgccgtcggagccggtcttgacgccgatcctgccgagcttggccatggcggcgacgaaggcgtcgaagaaggcggtggagttggcggcgaagaggttgacggtggggcgggagcggcggtcggtgaagaggatctggtcggaggcgaggaggcccttgttgtagcggaggttgttgaagtaggcgttgtcgaacgcccgcggcgtcgacacgtccagcatcgcgaacgccgtcgggctgtagttgatcgggcacacccgccgcatcgaccgcaggaagtccaggttcatcggcgggttgtaccccagccgctgcttgaacgtgtagatccgccgcacgaacttgtcgcagtgcgtcaccccgatcgtgtgcgcccctgcagtgcgtgtgcaccgtcaatatcagaatcatttcagtgagaaaaaaaactactccctccgttacacaatataagactttctagcattaaccacatacatatagatattaataaatctaaacatatatatatatatatatttagattcattaatatctaaataaatatgagtaatgctagaaagttttatatcgtgaaacagagtaagtagaggaagtattgtttgttccggtctgtgcctgtacagttgttttaacctttttactgtactactatatgcagagtcaggagtggctctggttcggtcaaaagttaccgctagtggttgtggtggtttcggttttgtcacaagggtagggcctcttgtgtccaaatctagacacaaagattgtttaaactaagcttaggatctgacaggaccaaaaacattcagacaaaatcgccccagttctcatgtagtactaagatcttttttattcttcccttgccccaacccagcaagggtatttaagattaatcaaatatgcctactactacttaaaaaaaaataagaggtgcttccattgtctgtcaaaaaaccgcccaaaaaaaccgaacgagtgagaaaaaaccggacgaaaaaaccgtaactatccgataaaaaaaggcgaaaagaaacaatctgcgacaaaaaaaccggaaaaaaaccagacgagtgagaaaaaaaccgtagttgtccgataaaaaaagggggcgaaaaaataatccgattccatgcaaaaaaaaaaaggctgaaaaaattctccgtgaaaaagaagagcgacaaaaaaacgaaaaaaataatccgattccgtgccaaaaaaaagggcgaaaaaaaatctctatctctacaacttaaaaaaaagatatgtttccttcgtgcgtcaaaacaaaaaaaattagcgaaaaattaaaaaaaatccaactcctatctgattccctctcagaaacgaaaaaaaaagtccgactatagatccgatccccctgaaaaataaaagtcaccactccttttaagtccgagataccagccaccactcctctcggtttcaatttataccgtgatatctctcacatcttggtgaaacaaaatgatgtgacggattgaagatctgtttacaaaaacggaatctacaggtcgagagcattccatttttatattattttaatttttggtttgtacttttgcatttgagtccctataatttttatatttacatttgagtccctataatcttacaataaggtatttgaggtcgtttttgttaaaaataataataaaagagagataacaaaagcagaaagttgcataaaaagaaaaacaacaaaagttctgtttcccataagtggcgaaaaaaaccatagatccgaacgaaaaaaaaatctgattcctataaaaggcaaaaaaaaaaagtggtgaaaaaacactagattcgatttctttaaaaagggaaaaaaagtttgattcctataaaggcgaaaaaaccgaaaaaacatctgacaagtccgttcgttcgatcccctaagaaagtggcaaaaaaaatagttcataaaaaataaaaagttggttcgtataaaataaaaaaatgcacactagaaataaaatggaaatgacgaaacaaagtccgatttctaatcaatatatatctcttctctatctctaatataatctaactatttaaaaagagaaaatgcacgagaaaataaaaacggttcaaaaacacgcgtgagaaaaaagtaagaaaaaagcgcaaaaaaatacgctaaaaaggttttccatcttccataaaaaataaaaaaacacgcgagaaaaattatttccatcattggtaattttttaaaaaaaacatgcgaggaaaaaactgtcagaaaaacgcgacatttctaaaaaatggttttagaaaaccgcgcaagaaaaaaaacagcgtctattaaaaaaatcactctaagaaaattatcagaaaaaacgttaaatcgatggacgcttgagtcggataggatccatcgatttttttttgccacctactacatggcttttattccgtaatatattctcatgtattggaaaaaagcaaaaaaaagaacatttgaagaaaaaacaagcaaaaaacgcgcgagaaaataattgtcaaaaaaaaggcaaaaaacacacgagaaaagaaaatgaaaaaaagggagaaaaatatggtttttgttgtaaataaaaagcaaaaaaatgctaaaaaaacttttagaaagaagtgcgtcatttctgaatggtttgagaaaatcgcgcaagaaaaaaacaccgtttataaaagaacaaaccgctcattaaaatacaaacattgtcattgacatgattattaatgaaaaacttatattatcattagaattttttcacccattggaacgcacaaaaggaacagaaaaatcttttaaaaatcctctacaatgtactacttcaatctatcctaaaatataagtatttttgaatcttgacatagtctttgatatgctactttaactaataatatctataaaagtaagatgatctaaataaaaagacttacatattacgatagtttgtttaatgataaatctaataacatcaattttatatgatttatcattttattttatttttgctattaatggtcaaaatagaaaatgtttaacttagcactattatgaaaatgcttataatttagaatggaggaaatactccgtagtacactttgttcttttttctgaaagaaacatgcgtgtgttttaaaaacagcttcggttttatagtagctacaaagaatatttcatcgctttctgccggtcttttttacatctaaatgtgaaattccctgcaaagcaagtactactactccacgcttgtgtttttttgtctactttgcattataatcaaacaaaaacaaacgagcctcttttcgttttcgaaaagaacagatgaaaccagtataaaacagcgaactgctttgtcttctgttgcaaacagaggatatgtcactcacgtgaagtgcagaggccacgaaaaaaagatgcttgcactgcgatcaacctgctactaatacttgtaataaaaaaaatgcaaccctaacgaggaattgttaatttctgtgggtaaccggcaaccatgctattgtcgcctcaacgttcacaaaacagtaacctgatgctttttcagaacggctagtatcaaccatgtaaaatttctccacgtcaatggaaattttgaggcaggaaggaagaagcttaccggaaagcgcaatcatgtcggtctgcgttaggccattgctggcgaacaaggagttgagctgatccagattgaagccagggccgggcaggacgtgcttgacaatggctctgttgaacgtcttgccgtccagccgtccgagctccacggagtagctcggcccgccggtctacaacaacacaaagcaacatatcatgcaatgtcagtaagtgaacaaattagcgaatgcaacgcactaacatctctgcttcaacggcaatcgttacttcattattagcagtttcagaatgcaggtagatatgcatggcttgtgattattcagcaaccttttcttggctctccgagagaactgttaatacaacgtcatgtctagatgtctacccggtggaaattttgtctgcctgcttgctgagaacgaggaaaatttccagccttgctctggcagcgcccacgagcccagccacgggactgtttttaggcaagggtaatacggcaagcgtcacgggcaacacggacaggagcagcgtactacagttcaggagaagtatttacccagttggaccgaggttacaatttagaaaccactcctacgggctacgagacgtcgctttcgcagaaatccatgccgcagaaaaagcaatactcgttcaatagagtcatcgtacgctcaaagcaatactgtgcaggcagtagccgcagtacgctcaaagctgttgccatctcaaaagatagcggatagccggagacacaggaggagaatacccgcctcgtacgctcgtatgctcgggcgccccgcgccccgccactacgcgatatcgcctatcaaacccggcgaatgcgccacagtgcgcgagccagcaaaccacgaccgtgcgcatgcgcaatcgcaagcgccgcgcggcggtttcctcgcgcggaagccgaggccgacacggctcacatgtctccgtaagcgactttccccttttctttctttttttcgtaggagggggccaaactgcgaaaggccagccagccagagcgaccgaactaaaccgaacccagcacagcgcctgcggctactgcctgcagccactgtgcgggtcaggctgtggagacgtggagcaccggaaccaaccggggagacatggaccatgcgtggctcgtgtctgcggtgtctcatggccggagtcagccatgactcatggccatgggctcacggctggatagatcgatcgatcgatggtccagtttgtcaaaaaaaaggggttactggcgcgctggatgcaacagtagctccgtcggccccacctgtcatcgcaccggcgtggtgggcccccggctgccctctctgcttaaaagcgttagcacttgcaattgcaacgtactaggagtactccacacacaggatgatggggagtatgaacgctagtactactacgccgatgcttgagcttgccaatcagggtgggtccgtgcttgctggcgactgacaagggcgtgccctacactacagtcgagccggcggtacaccgcattgtagtactagtattgttgaacgcacactaggacgtgacgagtcgcgacaggacggggatttgtgtgtacagtagtgtttattgttaccagggagacgacgtcgcgggcggccatggcgaggatgtccgcgcaggagaccttgccggcgcagccggggagcgcctcgaccgccgccttggccttgttgatcgcctccaccgcgtccggcgacagcgtggcgtccgcgccgctgtggctctcgtcgtcgccgttcggcgccatcagcatcaccgacgcgtcacacccctgcaaacgcaaacgccgagaagatgaacacccaaaacgccgagagaccgagaccgagagagaggacgtaccctgacgaagcagtcgtggaagaagaggcggagggtgccggggccgacggcgaagctctgctggaggtgctgcgagatgacggaccggacggtggactccgcgttggggcacgtgctgccgtagtagttctgccgcagctgggccctcgcgccgccgccgacgcccacaagcgccacgaatgccacgagcgccgcccgcgcgagaagccccatgccgccgccgccgtgcgccgccctggccatcgccgaacaagctcaggctcagctcggcccggtgtgtgtgtgacagcgacacagtgtgtggtctgctttgagggtggtggtgggacgcgggagcgaggagaaaaatgcgggagttcgggtggcaatatatagcaggggtttagcttgagaaaacaaaggaaaaaacgggcgatgtgggggaggaggagccggaaacattacggcgggaatcgagatagagactgtgtttagatttcggttaaaagtttaggtgtatcacatcaggtatagggatatacatttacatttgaagtattgaatatagattaatataaaataaattataaattccgtctataaaatgtgagatgagtttattaagcataattagtttattattagtaaatgattactgtagcaccatattatcaaatcatgaagcaattaagatttcatctcacaatttacatacaatctatataattagttttttttatatttgatactttatacatgtgtcaagtatttgatacgagcggatctaaacagtccggaatcatagaagtggttacgatctttgcgcagatgggacggaatatctttttcccttttccggttatcgatgaactgaaacatttttctagcgctttttttttgtgcggcgtctgatcagctttggtgcggggctgactcagccaacctagctagattgggggattactacgtgcatttgccactgacaccgtgtgatgtactgcaacaactttacttgtaagattcagcaacgaaaactaaagaccagatagcagcacaaagccacagaactagggtacatctactgtagactatagcactgtataagtgtacatctgaagaaaaaaatacattgtactccgtataattgtacattgtatacgagcagcgagaaaaaagaggtcgcgtgcgtgcaccaggtctaaggtatggctactggggcagcagctagcatcgtctcctctgcagtgagctgaagaaccctctcggcttgcacgcatattcagagtagctaccatccaaagctttctcacatggtctcgttgcgtccagcttgtggccagcatgcacctcacctccctccacctccatggcatggcagcaatgccgtctccctttccctgtctccgctacccaaggcgcaccccggagaaaaatacaagattcacggacatgttgcacagaaacacgcccgctttccctgcctatacatttagctagtagtatacaataagcaacactccagcatcgtcttcggctgtgaccaacttgtagcagcagcagtgtactagctagtgtctgatggataatggactaatggtgcaagcgtttcttccgcaagtttcgatgagattgaaaccatccatccttggaatgatggcagcaattagccattactggggacaggtttcatttcgtttgagaaacatattcagatgaagcaaatagacatcggtttatctgacagaacaaaatatagggcctccatgaacctcttgcttaatttgttgcaaattgagcaagatgtagtacttgttaatttgaccctctcagaaaacaactatggaagcacacaacagttaacactagttaacaggatagaaaaaactacaacgccttcgacccataccttgggtgcagaaaacaaatcccacatctgagtgtttcagaagaccaacatgcaatgcgagtggtgcagtgcaggggagttgttttcttgggggaaatgggtggatcagtggatgtactcaaacattggagaatggagaagcaaaccttactattagtatgttatttaccatggaagcaacttgacagtgtagattaatgctatataagaccttctctggaccctctacactctagtgcattggacgtgttgttttgtagtgtctcgaacgggtgcatctgcggtctgcatcctcgatctatcacaaggaaaaagcaaaaatatatgctttgtttatttcaccaagcagaatacgagggattctggacatttctgccggaatcgtctcgcctcttgtgatagctggtgtccatgtcttgtgttaaactactgcacctccgtgtgttctctctcggtaacgtttcctgatactgccaatgccaaactgtttagcctttactcgatttacactacgtatgaggctttgagaaactctccaattcaggccctctctgtcactgtaaaatgcaaactgactgactaagcttttcttcacataacttgtgcacttgtgcttgaagtatgggacacactcagaatatgaggaacaactgccatatcttccactaacggctggctggccattccatattgaacttgaagctggcgaaggtatgtcctgccgatccttcaatcacggacaaaatcctgtcaatttcggcgagccagttcccaagttgccttaaagatgacaggaaatatttcccttcaatcacggagggaaatgttagcaccatgcacgatcagaaggatatgatagtgcacatgtgcacaatgcatacagctagcccatgcatcagaaatacggaactgaccatttgaacaagagaaaattaggaaacaagtcatccggaacccaagcatcatctttacctgattttttcgcgaatgcacaaaaaatttacacgataatatattagaaaaaaccagaattcaaaatacacaacgcaatggcgaaaagagaacacacaatcaagtaatatatagttcgccgtctcaagctcttgagcatagaaggggcaaaccaaatggtcgtcgattccgcgctttaacagaaggtcaatcgtccatcaatgccgctgaactgctaattagaggaagagcttgtgtttagctaggcctttagcttcccacatgtcggcgcaagcaaaaatatggagatccagaaagaagacctggtttaagaagtttccaatggatatggctaattcatagcctgatattattaactcctgaggatctttttaaaaagatagtagtatacctcatggcgtgtgaaaggtctcaatcttttttatgtaatcagcaggccaataaaattgcgaatagtcttgagtgttaactactacttttctttcgatgaatttctgcaggtagaatttcaggattagtggattacacatcccccttcttcccatagctgtactgaaatacgaatgcaagatacctctgtttacataaaaaagattagtgccttttcacgttcatttctcagaaagagacgaggactagcatgcagtacctctgtttgattgcaatagcctgtacaagcatccagaagtacggagtacttgtgattttcattgacaacttcagtctgcaacaaagagccagacggtagatgtcaccgaagtctctgaaaactaatttgaccagtgttgtcaccttttcctacagctttgggttcagcaatgcatgatagtatgtaccaaaactgtactccctctctttcaaaatataaggccatgtttagatgggactaaaactttaagtccctatcacatcgaatgtttgaacactaattataaatattaaacgtagactattaataaaacccatccataattttggactaattcgccagacgaatctattgagtctaattaatccataattagcctatgtgatgctacagtaaacattctctaattatagattaattaggcttaaaaaatttgtctcgcgaattagcttttatttatgtaattagttttataagtagtctatatttaatactctaaattagtgtctaaatatagagactaaagttaagtccctggatccaaacactacctaagtatttttagctataaataaaaataattgtatgtctagattcatagctaaaagttattatattttgggatggatgtagtatggcaaaagcaacatcttgcaatacgttagccacctagagccacagaaaataaaaggtgaacatttcgagtgtgcaacgaataaagatactgcatgtagaattgtgtttcacaactaaagttatctgagtaaagattttttttttctaaaacgaattcatgtcggttgtgtaacataaactcttttcttctaatatactgacgtacaatatttttacacattcgtgaaaaaaattaaaagtattcatgcagcaactgatgataggtactataaatttaaggattaggattcagagtatgactctgattgagccaacttcagtttaggtcccagcgtcttaaagaagcttccagtgcctggttcatcatatatcaaaaattttctggacttcagcatacccccgtgttgctacgtactattcaaaatagcaacaaatattacgctcttgttgaaaaaagagtaaaatccatcaccggtctctaaacttgtatcgatgtttcctcccggtccctaaactcgcaaatcgaccgtttagatcctcaaacttgttcgaccgtgtcatcccgatccctaaacttgcagatcactcgtttagatcctccaacttgttcagttgtgtcaccccgatctctaaacttggatttgaatatcatctgggttaaatagaacggtctaaagactttatatttaaaaataattcataactttttcatgtgaactctaatgaagataaactttatatcaaacttgtagccctcgacgcgatctacaactttgtagttaatttttttattttaagtcattttttgtcccaaaatgtaattttaaaattaaaatttcaaaatctataaacatacaataatattttggggccctaaacagttttaattcaaaaacttttcaactacaaagttgtaggtcgcgtctagggctacaattttgatataaagtttgtcttcattagagtttacatgaaaaagttatgaattattttttgatataaagtttttagaccgtcttatttagggaccggggtgacacaactgaacaagttggaggacctaaacgagtgatctgtaagtttagggaccgggatgacacaatcgaacaagtttgaggacctgaacggtcgatttgcgagtttagggaccgggatgacacagcggtacaagtttagggaccgatgatggactttactcttgaaaaaatattggcttattcgacttaaaaaaaagtaaaatatcatattagttttcagtacagactgatgactccaatcgtgataacaagatgccttttgatgtgattataaaatatgtaatcgtcaataaagtgttttgcctatctcattttaaattacaataaaaccctaaaaagtttgtgagttttttaagtcaagatagcaagaagcaaatcaatagagaattaaagaactgtgtcctatagagtaatgcaagactagcaaaagagtaagactacgtacagctactccacaaaaatacagaaaaaactagccaaacactttttcacgaacgcacaaaaagaattcacgtcaatatattagaagaaaagagttttgttacacaacgcaatcagccagactagcttatgcctagaggtggaagaaaacaaagacaaaaagcaaggaagaaaaagaaaaacacgtacgacgggtaatgctacttcaatcagtgggaggggacagagtcacgctacactcccaacaaatccccaaaggaagcaacgcccgctaacgaccatagccggccttccgaaaggatggactctaaaaccactgagaccgaagagagtgcagagtcaaaaaccctagagttccgttccttccacagttgccaagagaccaggtggatcagggagtcgaagccggtacggaggcgttcaggtaaacaggccctagaagatggccaccagtcctggagccagtgccaccagggggggcggggagagggcagcccagccaggaggggacaacacccataaccagacctaacaagcgaacacacaatcgaagaggatgtggttcgccgtctcaagctcctgagcgcaaaaggggcaagccgagtggctatcgatgccacgcttatggaggagatcagccgtccgacagcgctgctgaatcgatgccacgcttctggaggtgatcagccgtccaacaacgctgctgaaatgcaaaccagagaaataatttgcatttaacaggacccttcgcgtgccagagaagatcagcacatgcaaaagagtgctggccatagaagagcgcctggtacgccgaacgcaccgagtagcattggtcactcgtccagcgctaaacaagacgatcaccgacacccggcgaaagctgaatgtgaagcaccgcatcctaaacaaggagaaactgggagatgattgggacattgagggcgccgcggatgtcagaaatccaggaattgttcgcaggccagaagcaattgtgcgcgaacctctaagccgcaggggcacagcgaagacatgtcaaacactcataacttatacttataccatggcccacatgtcagtcgcagttctgccaatcaccaccaccattatagattttaggttccattaatagagcgtatttaggggaaaaaaacatgctccatctgaaactgaaaatggataggtatgctctgctgaagaacatcaggacttcactgccagaaaatttgatctctcgtgtgtgaattaagtcaactaggaaggtggcccgcgcgcatgcgtgggcacttatattattgaaagataagattattgttgttcaaaaattttgtctcatagattaagggcaaactaaagctcggataatgtcattttatgattatttaagggttctatttttcttaatgtatcttaaaaaaccattcacaaactttgagtaggagatgaattaagtacttacgacttttgaatcatttttttctcgagtaaataataaactattgctagttaaatatcatacaggccattcatatacatatcgtgttgtatggccacaaatgaaaaatacgagagcaagatactcaaaattcttgtgataaattgtctcatgaaggcgcatgatatagtaggaaaggggggaggggagtgtatgcatagaaagaaaaagaaagggaaaaatgaaaaaagggatggaaagcgtacgtacccatgtacgtaggtgcgtacctatgccaggggatgagaggtgggaccttgcagtatttagtttgctctaagatcaatttaatataacggtttataatattgggcgtaccgatttaaccgaaaatcaagtaatggatactttgcttttctttccatagaatttctaatatttcctctaatttattagagcaccacgtgacagcttgagagcactttaagaaattttaaaggacttaacacatgtaattagaatattaaccgcttaatatatatgtatggggcatatggtaatatttgttctagcttcgtgcatgtttatatacatgtcgagagaaattaattatgtggctagcaagccattagatgtctaattagtagcaattaattttgacaccaatttacagatgttgatagtagtttgtacatattcatcttacgactttgattatccgttgatccctaatttaatgatcaccatgactcgcatgaaaaaaatatatactacttagggtttaggacagctgaaattgatgaattatcttatttatgtgatagctatttgagggtatacatgaatgaattgacttctaaaaagttaaaatgttgtttaaaaatgacaccgtttagaaacttggaaagcgtgcaaacgaaaatccaactatagaatcaaggaaaaaaagagggtcttaaacttccttatagcactcttgtctttgtaagagttctattgatattcgttaatattttgctcatattataacataatgatttcttttacgtataccaacaaatagtacaaaatccaaatatgacataacacaatacattataattattatgtaattaactttcgattccaacttaaatagagctacaaatagtacaaaatccaaacacgacataacacaatacattataattattctgtaattaactctcgatttcaacttaaatagagctaagtgttagaaaaaacgcaacccatattgcttaattctgctcttgctgcatcacacctctaattttcttttcatgttattaataaattaatcttctccatgtatgaatttatatgtggcaaaacgttagtgctgcggcagtcataatcaccttagatgcctcagacacgatgctttgtcacgcgtgcaaaaggtaaaggtgcagacgtgcattgtgtagcgggccaaaaagagaacttcggacgctttatttattagcaaataatatatcagatgatttaaatgatgagtccaccggttctttataagtgtacattagttattatagattttaaatttttaatttaatgggtacacaatataatgatgtagactttagtgcattatttgagaataatagtccaatgtaataaaaaatagttccgatgatttaaataatgggtccatcggtttaagtgcacatataaattagttaatatagattaaaattgtttatttgataggtacacaatataattgtgtaaactttattttaaaatagtgtattatgtgaaaataatagtacaaaataatgagtacacatgtttatgtagaaaatatataacattattaatttaatggtaacatataatggtgtaaattttattttcaaaaattgtagagctaatttagttacctgtgagcattctttgttggtgaaattatgattttatatatatatatatatatatatatatctattatataaatggggaaaataagaaaaaaggaaaaaaaagaagggaaggaagcatacataccatggtacatacgtatacccacacatgtgcgggagaaggaggagaggtgggaccctatagtacttggtttgttttaagatcaatttcatctaacggtgtgtaatataggacccaccaatttaagtgtaaaatcaaggggtagatgtttttcttttttcttagaatttttatgattttctctaatatatcagagcgccacgtgatggtttgagagtgtttatagaaagtttaatggacttttagtatataatagatagatagattatataatgtatattattcatttatttagatattttatgaatatttcgatgacgtgcgtatagtacaatacgaactcaaaataacttatatttgtacaactatgggttgaaattattaacgtggtttttatctcatgtgagtgaaaaaaaggaaaaagacaagaaaagtggggacgtgaggccctacatgcaagtacatactccgaaccatatgggctggaatatgaattttgttttttctcatgtgttagtgaaaaagaaaaaagaaaagggggagtggggcccacgtacaaaatatgtaacgtacatgcacgtacacgtacagggcatgtgtggatttttaaagataataataaatctaattgatattttttatgctatatctaacgtttaaaaatagtgggtccaccagattaaatgaaaaccaacggctagatgctttgcttaattcttctaatttattagagtgccacgtggcggcgtaggagcgtttgtaggggggcacgtggcggtttaggagcgtttgtaggaagtttaatggacttttagtatataatagatagattcgcatgatattgcaattggtatggatgaaaaagaagggaacaaaattactgaaaagtgactgtgagcagatgatttgagcatggctaccccccagtctaaacaccatacaagaagatgcaagggaccaaataaatcatctactgtaatcctgattccatatttcaacagcagataactatcgatctctgctagcccttgatttagaaacagggaattgtgtgaaaaattgctgtgactatcaggcatcactcaaaagatttttcttcagacattgtttagtgttatctctcaaagcaatgtaatttaaatctatttgtctctgtaatacctgtctgaagctttgagcaaatacccaaattccgccatcgctgcttctcagcaaatctccaattatctttccctccctgtaataaaatgtagataaacaaatttttctcagagaaatttgtgcttgaagtgtgagataatcccagaataagaggaataaatcgctgtcctgttgcttctacattccaggtacaccgtcgaatgcgatggtgcgtctcatcacttgataaaatcgccattcaacaaaaacacactgctgcagtgcaggtttcagacatcagcgataaacagatgaggtgatggtgtgttctgaattctgatgcgatcatggcattcgtacggagatgggtacagttcttacctggctttggcttgctacggtgctgtacttccgggtgctaggcgacgcaagggcggagcggcggatgtgctcgaagagagaatccatggcgcttttgggcttcggctgcggctggccatctcctatcccagtgaacgagaaagctggcaaaggtatgatctgctgatccttccgtctcggagaaaatccagtttaaattcatcgagaaaatatggcgaatccgatttaagtctcggagaaaatccccgtgttactaaggctgtgtttagatccaggggtaaaaagttttagcgggtcacataggatatacggacacacatttgaagtattacacgtagactaacaaattacagattctgtctgtaaactgcgagacgaatttattaagactaattaatccgtcattagcaaaagtttactatagcaccacattgtcagatcatggagcaattagacttaaaagattcgtctcgcaaattagtcgcaatctgtgcaattagttattttttaagcctatatttaatacttcatacaggtgttcaaacgtttaagggtgggatctaaacatggcctaaggatatgtgattggattcatgtgcacaaatcattgctgctagaccattcgtaaatattgatcaattggatccgaccaatcgtactagagaaatgtaagaagcaaagtcattgggaacccaagcattgtattgatctttttttcctttaatctgatttacgaatgttgcaatgaatatggccgttggtaacttgaaactccctccgtttttaaatgtatgtgacacccattgattttttttgcttaaactcaaacgaattaaaaagtaacatcgtcatacgtttgaaaccggagatagtgttattataacttatggggagatagatttcgatcatttttaaatgttaccataagctcatacaggtcataattgttataacttattaactacttcttcctttgatgaattttcttcagaaatgatatcaggatctcccgtgctgcatgatccttctgagcttcgatagaggtgaccaggtggttgtagcatcgacgttcgaactcggagaagatatcctggggaggacagaactcacagtcagccaaatcaatggcccatatctacattactacagcaagcaatgtgaaatgagctaaagaaaaggtaacatcacgggcatactttcaaatcaagcgccgcgtaagtcctctttacttcggaaacagaacttgaatccttcttgccatagttcctctgtgaattgcgcaggaggttattatttctgttcatgtccatactttttcagatagaacaagatggtaacttacatgtagtacttctatttgattgttgtcagcatgaccaagagcctgtactattaaccaggaacacttatgatcttcgatgtcagttccaatcttcaatgtagaataatgtcagctgtcagttgttctcttagttgctgaaaactattttgatctttgtccttaccttgcctatggtgttagggtcagcaaaacagtccaagtagtcatcctgaaaaggcaaagtaaaggtaaaattgactttaaggtttcattaaagaaaaaaaagcatgccatatacctgtatctgaaaatatatgcccatttcaataagtatatcctttagaccactgaagtcttcaagttttgcgccagataagagcaaagcattggccacctatagttgtagaggaaaatgtgaacatcataatgcactaattgaagatacatagattaccaaccaatgtactgcacgccacaattatcatctgaagaacgtaatttctgtctgaaaaagattcatgtagcaactgaggacaggtatgatcagaatttaggatagcctacttcattcttcctcaacatgtttttcctgcaccttttttcaagagtttgccgcaaagaaacccctctatttatctgattcatatgatatcgtgaacttgaagaacttgtacagttctacagcctatattcagatacatgacgttatgacaagtgaaaagtaggactgcatctgagtttcggtcttccagacttacaggaaggtaaaaggagtagtacgctgtcttgtacttaacaatgcgacggtagctacatgacaagagaaaagatagttattgaatacgagcaacatcccaatattatcataagcaaatcaaatattaaataaaagagagggagaggtagatggatctagattatgtacccttcaatactgtattttgcaagatcatctgctccagtatgtgtgctaataagatcaagcatctgccccagagaagtctgcagagctatctgaacaaaatatccattctaaacagtatcaaccaccatcagaaattatgataattgatgtttcagtagtaattcagatgtttgctgacctcgctccatatttctaagatatcaagaaagtaaggcttttctctgaaatacttttttatcattatcaagatgtgacattttagtatgataccatcgtttatacccctgaggccaacctgtaacagaaatataggtggaagaactaagtggcctgttttgttacagcttattaagagaatcagagtatcatgtgaagatgggttgaagaacctcaggtcgccggtaccagcaaatctgatctctcctggtatgtgaatcgtccatgatgtcatcaagtagtagtgcacatgcttgaaactacatgcatttttgatagaaccaaagataattgaaacctgttagtatcggcatgagcagattcaggaataaaaggatgatgagcagatggattgagcaacattacccattctacacaccaaccaagcacacaagcaaggaagaagtcatcttcagtaacctcacttccttgtttcaacagcaggtaactgtctatcactgacagccctcggttcaactttcctttagagaaacagaagattgcattgaaaattttgtgacttgagagttgagacacttgtaaaaggttttttctctttttttttttttcaaaaccgaaactcagctagattcacttgcactctctgaatgtaaagtgtgcactatatttttttaacacttgtccaattttcagatcagagatgttcagacttgcaatgctttagaagatgcctcctcacctccaggtacattgtagtcgatcatctgcccaaagaaaataaagataagaaggaatcaaaacttttagcactgaaactatatagaagattaacttcactttcttcaacaatgaaattatataaaatattagcttcagtttccccgttacaagtgaataatgtatatacagtatacctgagcaagccagcgcctggcttcgtcggtgagctcgcacgagtcgtcgccgacgagatcgtccctgaggcggccgtacgcctgcacgaacctctcgcgggcgtcgacgatgccatgatcagaccgccaccgctgctcctgcctggtgcatttcgccggtgaggcatcgccgcgcaacctcagcttctccttgagctcgcgttccagagcatcgctccggccgtcgtcgtctccaatgcggagcatctcctgcatggacatggttagttcttcttccctttttcacgttgatgtcagtagctgtctcgatcgatctgtggtgatgttgcttgtgatttgcgaggtaagtgaagtctatggaggagctgtatttgtagaggcccccgaagctggatcggttgcttgttgactgcacaagtgcagaacgtggcgggagaagatcgaaccagaaggtaggccttttgctgagctcatgcgagtgttcaattttctgccaaacaggtggttcgggcggtggtagctagctattgctgctcgtggaactggttactgaaatactgaaataccaatgtatttcctacttcgtagctccattggcgtcatcatagcgaaaagaacagcaagctacgttgccgaccccttctgccaccatgagcacgtgatgcatgatgcatcaatcatcaaagtctgcgtgacgcatgttgcaggcctgcctgtgaagaggtacttagaatatcgttatgttgtttcaaaatataaggattttcaagtatttaaattaacagcagttactaaaaggaaatattattttgacttaaccttagtatttactaaacagaaccaaaggatcttcgagcacaaggaaacggcggcccccaatcttatagcaaaaataaaggaagaggcaagaacctggataatggcaggcgcaaggcgacttggagaattcctaccaacttaatcatagcgcttatgtaattttgtacagctcttttttttttgcccctaggggttgtatttttttacgcctatatctaatgaaatagcacaatctcgtgctgattcctttcaaaaaagtatttactaaacaacctaaaatttttcatattttagagtggatgaagtactaagttataatcaatcaagttctgaagtctgaacaagttgcatttatttctcagcttgttattgcctttatcgctcttatcctctgattacagaagaagagaagctaaacacaggttcgatcgatccagcgtttcaggccgtcaggtacgtacgtcggccgaccaggtattatctcatcatcgccaactaaactctacagcacgtacgtaggctcaattctagagaatttttttcatttttattttttaatatttacagaaatattgtaccgcgaaaatatttacagaagtagggcggcagggtgacgtgagggacagacaagttgaaaaaaaactagaaaaatgcatttttagtacggcaaaaattgcatttgtgtaaatattttagatggtataatatttctgtaaatattaaaaaaataaaattgaaaatgaaaaaaaatccaattctagacgccatttgggccaactttcgcgtgcttggctcgatctaaggccgctgcttcacgtgacgcctaacatgcgagcacgctgcgtctctaactacgcgtactgttgcggcaacggcagctgtggttgcctgttgctgcaacagtggcaggtgcggaaaccgctgagattatgagccggttgatcgccggaacatgcatgttcgtccatgaactttgctggatttagcgtagtgtcagtaaagccgggacgtggggttgttgggcctgaatgggagcgaattgaaatgatttgctggatgatttttttttagggaagccatttggcgcgttttattgatatgaaaacacaattacatctttcactagaacgtttagcaagaagctagtggattacaagaactaattgagatgaaagcatatctagctggatgtttgctgtgttagctttaatctgggactgtcactctgaagatgcgcatcagctaattagtagttgatcatgaatgaatgcatgggccggttaggcaggtcgtccagtcctccttccaattagcatggcccaatttggatcggttctctaatttatgatgggcctaatttggctctgaataatattcacaatcaaattgctacggcccagacaagatctaaggaaagacctaatttggtgggagtgtgacattttgaatttaggatctctcattagagttggctatcctaattttggaataagttcactttagatccctctatttgtcgcccagtctgattttcgtccctgaaccgcaaaaccggatacgacccgtcccccaacttacgaaaaccgggcaaacgaggtccctcggcggttttgatatcggttttggctgacgtggcacctacatggctaatttgactcggtgtacatctgacgtggcgcttacgtgacaattcgatcccaaaaataataaaaactggacgtccacgtgtcagttaaaagaaactaaagatggtgggacccacgtgggtcctgcatgtcattctcaccctcctatcttccttctctctccccgcctcccggtacgacacggacacctcggcggcggcggcggtgccgccaacctgcacggctgcacctccaggtacgccactacgcctccagccaggctccagcacggccaccgtgtcctccagcaccttcacctggtccactgccgcctccacgatctcctccctgcccgctgcatccaaccattgacaagatcaaacgacgatctccctcgcagccattcgccaagaaacccgaggaagacgacgaggcgaccatcgcctccggttggcaagaaaccaacgaataagacaatgcgaccggccatcgccgccgttggccaagaagccagaggaagaaggcgacgacgatgacgagacattccctatcactgtcatgtttggcatgtgttctatgtttgtcttcatggcggcaatcctgcagagacggctaatggttgtttatgacctacacaaatcatcgataagtatgtatctttcttcattattactccacatatgagaactaaaatcgctttgccattcaatttctttgattcctaactgttggggttaacatttgctgcagaagcacaagagatggttgatgaagatgagccactgaatccttacggattgataggatcatacaaacaaatcgaatatcctccgcgtacttctcgcccagggagacactcaccgccgagccgtcgccaccgccgccaagggctgccgcctgctgcccgtggccgcacaagacgtgcgtgactcgcgtgtccggaggggcggctggcgggcgccggaccgcgccgggcttcctcgcatcctgctgctgctgcgtgtcagagaggagcatgacggtggcgacgggttgcggtcgcggcggtcctcaagcaccttggtggccttgcgcagcgcgtcgctaatgcagacggcctgcggctgttcctggccctgggcggcggaggcggtcgacaatctggcgcgtcatccggcgcagcggcaggaggcgcttggcggcgccagagaaggcgacgatggcgaggcggtcggtcgggccgtgagaggcgatgacggggcacatccctctcttgagcatctgaagcttgtcgctcatcatcgactcgctgggcaaggtggagccgcggtgaggtccgtcgcgacgcccgatgccactccgccccgcccgtttctgccggccgccgctcgccccgctccatcgaccggatagagagaagggatagagagaagaggggagagagaggatagagagaacagggaggagtgaggatgacgtatggggcccacgtgggtcccaccattttttattattttgtgtaaaactgacatgtgggtcccatgggttttattatttttttgattggattgccacgtcagatgaagaccgagtcaaattagttacgtaggcgccacgtcaaccaaaaccgccgagggacctcgtttgtccggttttcataagttgggggacgagtcgtacccggttttacatctcagggatgaaaatcagactgggcgataaatagagggacctaagtgaacttactcccctaattttacatgtgttttggttcaacgagggtggatgaacgcaatgctaattggcgcagagggttttataactttgactatcaataacttaaaagttatgggactatctatctatatgacgccatatttttcatgaaaaaatagtcagaatatatttacattgtaagtccctaaaattacatatgtaatttcaatgtatttacactgtaagtctcaaaattacatatgtaagttctaaaattacatatgtaaatagtatgtaattatagtgtaattaggaagtaattatataacactaactattttatccctctctcgttacgtgttctcattcgtccggtctcttactttgaccaatgtgcaactgtgtacgagcatgtagcagtacccaacgtaacacatctgctcggtgaagttatcgtatttctggtggttatgtacaagagcacgaatctcggcgtcaatcgtgtgggtcaaagaatcgactgaaatcaaggtaaaattgtggcgccacaaatttagcagaacggaaagttatttagttttaaggcattagaacaacatatgcatatttgccatataaagtactacaataaaagtaaaaaaatattaatttattgcgtatattttaataacaaaatatagacaaagatatattttagaagatatattttaaagaccatgtcattatccaaaacattaagaattattaaaccggagggagtaactattattgattagaataagattaagaataattagtatatgttttattaaaaaaaaaagattggctcatctcatgcttaaaaaaataaaacgtcccatccacccaactaaaacacttcatggattgccatgtccggtccaacaatgctctcaacatggatgaatttatacatctacaaccatacataccattgtactaaaaattttattaccaaattaacattaaaaaacatactcttttcacatactacggaagaccattctattgcatattattagtgtcacatagcaacacaatacatatgtcttcttttacttagccacatgtgtgcatggcggtatcctctcccagttccagaagttacaattttttttgtgaacagtatcagagggcatatgcatgtcattcaatgtagcgcatcgcatcctccaactgtccaacttgccaagcggttgtgtccgaactcaagcagccactgtggaaaggtgtttctacttcttcctcctgtaaatcttcttcagaaacgacttcaaaatatcccgaattgcacggtcagtctcggcgtcgatggtcgaaaccaggtgcttgtaaactcttgactcgtactccaaaaatatgtcctacataagtaataaaggagcaagaaaaacgttcacagttagatgtctcgtttttctgtggttggaaaattcacctttcgagtaacaatcagggtggctaatacagaaccagatgaacttgttaaaagggtcatggcattgcatatcttattatgctttctaactagtctggttagaaagagttgtagtacctgaagatcaagctccctgtaaacgctcttcacttctgctacgcattttgggtcagacttcccgtagttctcctgagaaatcaacaaatttacacgcaaatatatgtgcagttagtacttggaaaaaatctgtggttgctttctccgaagagatcatagcatagaagaaaaaaattgtggtttttcttacatatagtattttcatctcattctcattggcgagttccatagcctgtactattagccaggaacacttgtagtcttcaatgtctgttccaacctgtaccacattgagctcagtaaagcagagcattttaccagcagaaacaaaatgtaaagacaagtttttatgtaagtaccttgccaatcacttctgggtcaccaaagcaatccaagtagtcatcctgagaagtgcatttatgtcagaattaatcatgaagttgaggacaatacaaccatttaggaagtataaacggacctgtatctgaaagtatacgcccatttcgataagtacatttttcagctcaacatagtcactcaatctcgcgccattcaagagtaatgcacatgcaacctgatgaaaaggaaacaaattcagaactactggtctactacaacaaacagttgtcttttcagaactagaggaatttcatcattcatttaactgttcagtttgaagctcagactcaccggcaggtagaacgaatagtatgatgtcttgtacttgacaatgcgacggtacctggcagaatcaatttgggagcaaattaagagaaatcactaatgctattttaacttgagtagagttacttatacactgcatgcatacccctgaattctgtatctggcgagatccttggcgccggtatgagtggtgatgagatccagcatctgccccatggcagtctgcaagcctatctgtcccaaaaaacaagatcaaaactgagcaatatatgccaattaaagatgaaatcctaacaagttttgtgtttgttcaggccctccaattacctcgttccatagctccatgaggtccaggaagtagaacttctccttgaagtatctcttgatgattgcctggacatggcacttgagcagcacaccatcgtttatagcagacatgccaacctgacaaaattgtcaattacacgaacatttttcagttaatcaatcattctcaggacagagattcagatctaccacaaagagaacacagcaagaaatggatcgcaccgttggtagcttgtaccagcagaggttatctcgcctcgtgtaggcgttgtccgtgatgtcatcgagcacaagggctgacgcttgcagctgcagaattcaggcaccaaaattcatgatgaatagtaccaagatctgacagactgacacaacagagttttgtttcgctagtgattgggcagggatgacggtgttgtttacccattcgacgcaccaaccgagcacgcaggcgaggtagaaatcctcgtcgtcaacctcggttccttgtctcagcagcatgtagctgtccaccaccgagagcccacggttcagtttcccttcagaaaaacgtcacgagacatgtcagcttagctttcagggcagcagggccagatcaattctgcatgggcatggatgctagcttgctcacctcctggcacgttgtagtccatcatctgcaacagcaaagaaaacaacagaggacgcattacatttccattttcgtcagaaacaacggagataacaccatataaaagtattttaccaaacaaaccatcaaggttaaaatatttctgcaggtttgattagattgaagtattgaacatagaagttacaaacaaaagaaccattttttcagtggtactagtaccaagaacagttaaagaactcatcttgacaggcataaccatcaatgtgaatttgatgcgtatagagaagccatatgaattaagcaaccaaaaatattttataatgtccccgtctcaaagtataagcatgttcataatagtgctaagtcaatcatttttaactttgactatttaatagcaaaaaaaataaaaaagatcaataatataaaattgatgttactagatttatcattaaacaaactatcataatatacaactctttttatttaaagcatcttacttttatagatgttattggtcaaagtatgtattatttatagttaaaaaactaatgctaaaaaatatacttggggtgaaaaaccccatcatggagtttaaagttaggtttgaaattttgacatttgtccgtgacagaactatgtatgcacagtgtttgggagaaattaagatggagataaagtcagagcacacaaaacgaaaaaaaatcaattaattgagctttagttattttaaacttaaaataaatttatttgatattttaaagcaatttttatataaaaagttttaaaaaaacacactgtttaacagtttgaaaaaaaaatgcaaatgaaaaccgagttaaatctgcatctaaaccttaacgatccatggatcaagcatgatttaatccaaaccacatgtatgttgtacagtaataaacttgcaattaatcgtgttcattaggtatagagagagtaagacgtaccttggcgacccactgcctggtctcctcagtgaagtcgaagttgaaggctcggtcgttgagcagctcactcttgagccgctcgtacgcgcgcacgaacctgtccctcgtctgctcgccctgcccctgctccgccgccgcgccgccccgcccgcgcccgccgccgttcagccggagaagctcccggagctcgtcctccagccccgccgccctcctcaccacctcccccgggctcgccgccagcgccgccaccgccgccgacacccccgacggcaggtgcgacgcgatcgacgccgccagcgcccccatcaaattataccaacagttttccggaaactctgatgcgatcttgttccaactggtgattaactgacgagtttgatcaatctctgcgtggagatgacggaggctgctgctgatgtgtttgggggttttaaccgctggtgatcagtacgtggatagatcgatcgcggcgagcgagtggcgttggctgcaggtgagctagccaacaaaagaaaaattcagctcgcggcgcgcgagaagcatctgcgaccgagtggtgcagcacgcaagaacgagtgttcgttcgtgtcagtgtcagtgatcatagcaaatctgaagtgtatgcggaggatgcatctgtcgtctccgtggacgcagcatatcccggtggcttttagcctcagattttgatgcggccgatcgctacatcagccataaaaaaaaatgcagctcttttttttctgaatattgagaagagactacttcaggttttgatcaggcttcagatttcagagttcaggtgaacgaacgtgtcatcctttctcattctcggctccaatcaatccatgccatgaatttatatttttcaaaattgaattcagttataattctgatcagctagtattttatttcactgtttccatcaaatttcccccttttgtagtatagaacatctctgaataatcctgaacgtttgtagtatataggacttctgaatactgaaccttcaaacatatatgggtgctatatatgactcatagcagcgaagcatctaggtagcgttatccttttcgggcattcgctacatcacataatcaaagcaacaaagttccaaaagcatataataattcaagtacgagcacggcgccaatctttctacgcttggcaaccacttcaaaagtagttagtgtcaccaatctgaatcagaattattcgaatcgtttcatacaaaactactcgagtcaattttgcaatcgttttcagtcattgtaaatgcccggcattgacccgtttttgagcttatactgcgaggtttttttactgttctttaggttgtgcagtaccaaattctaactgttgatctggcatcattcaacggtcagaaatcatccgtacctcatggtactgcacctccccattgaagcggtaccatgggcgggagggtatttctgtccttttgtttgtttcacgagagaaaaaaactcctcaggagagcagcagcgtgacggcaggctcgagggggacggcggtggcgcctggatgagcgacggcggcggtgggcggctggatgcgcgacaacagcggcggggtcgatgtgtgacggcggcggcggggtcgatgcgtgacggcggcggccggctggatgcacgacggcggcggcggcctcgatgggcgacgatggcaacgggctggatgcgcggcggcggcggcggcctcgatgcgcaacgacgtggctacctcgatgcgtgacgtccctggccggcacggatgatgaagagagaccttatttttgttagtccgatcgtaccgtgctaaatcaacggttagattacattggtacctcatgatatctcgtacctcatgataccttctcaaggataggaaagatgctcgtatattgcaagatgaaagtaatagcactacaactgtacaccggatagctcgatcggttatcctgaatcttggaacaaaaacaagtgactatctcactgccacaaaaaactagtctacagtaaaccacaaacaaattgtcgcaagatatccatcgaacatacgagaagagatgctccagagccaatgaaatatgtgaacatttttttttcagatttcagagatcttctaatcagtcatggctactcatccgaaaaaatgttacagtccacagctttattttgtgaacgccatttaatttattttactcggcctgcatagcggagaggtagcgagaatgctagatagatatctggagtcgtcgtcgtcgtcgtcgtcgacttgtcatccatagccattgacgacgacgagctctactagcaatcgatcgatcgagttctcgccgccatgagcaagctcgactactgcttcagcaatgactacatggtgctgcgccctgacagggccggcgcgtacgagctcctgcacctcctcttctcccccaaggtcggccggaacaaggccgtcgactgcttcaccagcaccgagctccacagcttccggcgccgcctctccatcttcctcaacctcctcctgcagctcttcctcctctcgctagtcggccccctcgtcgccgtcctcggcggcgcgctcgagttcgccctcaacctcgccagcaacgtcctccatggtcagtggtgacactagcttgcatggatgtctcggatagttaaccctaattgtgtgttggtgcagggagaatggagtatcctgatcggaagtcggcgtcgtaccgatcaatcaccgggctcatcgacccgagggttgatctggagaggagcatcacgccggcggacagccggtaccacgccgcgctctgcgtcatggcgtccaaggtggcgtacgagaacgaggcgttcatccgcgacgtcgtcacccgccgctggcagatggagttcgtccagttcttcaactgctggaacggtaagcacagcatcaaggacaggttctgtacagctccatgcgcgcaccggcgcacgcacgcaacgtgtttgatgttatgcgtgtggtgtttgttgtattgtgcagagttcgagaacgcgtacacggcgcaggcgttcgtgttctgcgacaaggcggcggacgcggagctggtggtggtggcgttccggggcacgccggcgctggacgtggcgcggtggtgcgccgacgtggacccgtcgtggtacaagatcccgcggctggggcgcgcgcacgcggcgtacacgcacgcgctgggcgcgcagcggaacatcgggtggcccaagtgggtggagcacgtgaagggcaagccgcagcgggtgcacgcctactacgccatccgcgacgccgtgaagcggctgctggaggcgaacggcagggcgagggtgctggtcgccgggcatggctccggcggcgcgctggcggtgctgttcgcgacggtgctggcgtaccacaaggagaaggcggcgctggaccggctcgccggcgtgtacaccttcgggcagccgcgggtcggcgacgccatgctcgccatgttcgccgagaggaacctggacaggccgaggaagaggcacttccggatcacctacggcgacgacccgctgccgcgccttccgcacgagagctccgccgcgcacttcctccacttcggcatccgcctccacttcgacagcttatacaacctcaaggtgaacatccatgcctctcttctctagcttgatcactgtctggttatatttccttcagaaaaacgttcatttttttttctccttctgatcatatattgatcaatgcatgcttttacaagcacgtatataccagcttctgatacattggtactcgaggtattatattcaggcttaaacaggttaattttaacccaatgtagtatagaaaaaaccgatctgttggatcaaaggcaatagatgttcgttttttggtgtaggatacggtaataaaattctaggttagttgatactcatggaagaggattttgatccctcgaggggatattcgctcgttgtttgcatgtcactcaaatggttatgaaaaaatttgaaaaaatttaagaagatgtattaatatgtgatatatcactccacaaacatgcaagtaaaaattcaacttctacatctcgcaacgaaaaaacaaatttgactctgaatatacgttaactagctgcggttcaatttgtttttttcgttacgagatgtagaaattgcatgtttgtggagtgttatatcacatgttaatacaccttcccaattttttccaaatttttttataaccatttaagtgacatgcaaagaacgaggggatatcccctcgagggattaaaacagtttcccgatactcatctataacatatactccttccattttttaatatatatatatatatatatatatatatgacaccgttaacttttatcgtgacatttaactattcattctattaaaaaatatataaatgttatttattttattgtgtcttgttttatcatcaaagaaactctaacattaatttatatttttataaatttacactaaatttttatataagacgaatggtttagacagacaaatcagaaacgggtgatgtactgatgttgaccggttggccccaaagaatgcttggtaaatttagctatacggtaaagaaatttctttcagattttgtgttcattttgagtggtacagcaagcacatcgtatgaacaatccagacagagaatccagtgaaagtgagcttttgttcggttcttatgacactagtacatgcaggcaggcagtcttgatggtggcctgaataatctcattgctgatgtaaggacacaaatttctggttgtatgcttcagatgtagtgatgagtagataaatgaagtgtggtggatagtgattgatgtagggaaattcaacgagaaccactgagccagagttgtacctgaattcagccccaagattcgttatcatcgtctgaatgaaaccaaatgaaaattaaacggaatacaatcttcttctgttctgcagttatctgcaatgtcctgtctgaaggttgtacatttggttgctgttcttcatgaaagatcttgttgctgcatgcatgtccccttccatgacacgatctctgaatattgctcatcaatcgtgctgtacgtgtaacttatgcaggtggtgaaggagttgccgggagatgggagctcgtcgtcgtcggcggcggagttcgcgacgagccgcatcaacgcggcgtgggagctggcccggagcgcgtacctggggtactggaggagcgcctactgccgggaagggtggctgctgatggcggcgagggcggcggcggtggcgctgcctggcctgccgttccacagggtgcaggactacgtcaatgccgtcacgctcgccggctcgaacattcccaaggacatgtgacgatgtatcgagtttctgaatgcaatgctgcagagactgcagctgcaggcatcaaacttggatgagagattgcaactgcaatataatggcagatgacgactgcatcgagcaggctatgggacttgtcacttgtgtaactgtaatgtgacgtacgtactggtagtaattaattacgggtgcaactgtatgttgtcgcgactaattctgcttctactgaataaacatgtagtgataagtgatatgcttgtgagttgtgacttgtaagcatttgatgtactgggacaagtactactagtataactatgagaagataaataattgaagttcttgttttcgtttctcactcattccaacattttttgggtagagccgtagtggtgttgaagttgtgggtatataacttccctcgctagagtttaaatcgtagttttcttgaattttatatgcatcatttatagacgggcttttagcatgattttattaaggttgagacaacatgtgcacacaagtcttctcgtgagcgcaattaattacaatactactatcactactagagaaatgatcttcaatcacggtttctaacccactttcaatcacggttcataacccactataatcccggttatgagagagagacgtgggagagagatatttatttccaatatcaaccgggattaaagatatgatctttagtcccagttggtatcaccaatggagactatagttcgctcgatgcctgacatggcctgacagttattgaaccgggactaaaaatgatttttagttcttgttggtgttaccaaccaggattaaaaataaaaaaaatacctctaaacttataaactgggactaaaagtgctttttagccccggttttttaaagaaccggggctactgtaagaaagcatcgacgagttgttctcatacctctcataaacagcaattctcatatgtagacatgtttgcaaatatgagaaaaaaaaaaccactatgagttcaatagtatcttctctttactgtctcttactataatcttccgtacatataattaattatcctataattattgtaaattagtactaaaatcgacccatatactatagtctaccttctccgatccccaaaactttcttgcttcttcctgctgcccaactttataggaccaaatactcgtattagaggtgatcttctcgatgctatattgcgagtgtgactttggtataaatgctggttcgccatcacgaataacaaggtcaacatgaatggtcttaggccactcatacaacctcgggaggaaaaccttgttctgcatcgacttaagcttggtttttctcatcattgtcgtgtatgttccggtgaacaatgcccgtccatccaaggattccatcttctcccactccattgtctcctcattgagtttgaggacatggacaggcgtaccagtgtagccgacgaggacagccatgagctcaccttgatcagactcgaacaggtagctgtcaacgcgatcatgctcaatcccaaatcccttaagcttatcaacaaccttgaaattatcatcgtggttgcacggatcatacaccgccagcttcccgtcttcaccaagaacgtacagcaggccaccatggagcaccgggttgctgatcggcgaggcctgaagctgtgctccttcctcgacgttgaactccgtcaggtcccatggcccccactcgccgtcctcgtcttgaatcgcgcgggcgagccgcaccacgaagatcgtgttgacgcagtacatcctccggtcggcgtcgtcgtagacgatgaagttgaaccagtagaacggcatctccggtagctcgtcgacggcgccggtgacgagatcggtttgcaggaccagcttaggcaggcacagcgtgaggcgtcgtccgttggagcagcagagattggcttcgggcggcacgttgagcgtgcagccgtcgacctcgaagctcctgtggaagtacgggctgtagtagctggcgttggcgacgccgacgtcggcggagctgaggaggagcggggtgatccacgccgggtagaacggcgacacggcggagcgccagtggcggcacgtcagggcgaagctcgggtggttggaccagccgagccggtcgacgacgagcacgagcatgtcgaacgggagggacgaccagcgatcgtcccgtcgtcgtccctgcgccgccgtcgtcgcatccgcctccatcttttgctttctcgatcgatcgttcaacaccagcgcactttacggcgtgcaggatcggtcgagaattcgagggagagagctctctctctctgttttttttctctctgttatatatgtgttgcatgccgcgtattattatgctgctttcttttcgtgttttcttcggactcttggtcatgagtcatgaacgtgatccactcatccacatcgatcgtgcatacgctagctcccgtcccatcgtatacgtatttcccgtttttgattcgtctgatgcacatggtgatgggtgtagctatatttatggcgtcatatttttcatcaaaaaatagtcggcatatatttacattgtaagtccctaaattatatatgtaattttagtgtatttacaatgtaagtcccaaaattacatatgtatcgatttggtgctaacgtgccacccaaattaagtcatctcgtgttcgcaccctgtccgcgagcagctggtgtcccatacagatttactactcaaagacatgttcaatacacaagacttaaacagctagctatttccagtttttttcatgcgacttctatatatgatgttacaaaaaaaaatatccgtgcattgcaataggtaaaggtatttttttccagtgataccacgctattttttttaagataatggaatgaaacatcctgacatttgctcaaaagagctacagccaattattacaatctagcactctaaaagaagcactctaaaagagtgtagtctaaaataaagcgaaacacaccaaacctgtagcgcccgttccgtcgtggcgcctagcgggaaaattatctcctaaaaaccctaattgcgaaatttgtttctttgcttgttgtctagtgtccgtgccatctcaagatctcaatccccgatctatcgtcgagttcaattccgaatccaaatccctccaaatcaaattcctccgcaaaagtctattttgcctcccccggggttgatgggccgaaattctctcggcccatcttctcctctcccccggccctctcctctccccggcgcgctctctctctctctctctctcgctctctctcccccggcgcgctccctctctccctctctccctcccctcatcacaaacaaccgcccggtgtgctcgctttcgcccgtatcgccgtggttcgctctgccgctcgccgccgccgcacgccgtccattcgcggctgggtcgtcgtctacctcccgccagcccacgtggcagccacgtaggcgccacgtcggcgccagctcagccgaggtcgggacgggccgaccccggtcagtccctccccgtgcgcgcgttccaccgcgagccgtgaggttgcgcgtgggcccgccgcacctgcgtccaccgcgaaccgcgtgcgtgcaccacgtccatcctccaccctagcgccgcgccgcgtgctcccgccgcacggtgagccgagccgctgacaagcgggtcccacccgggaccgcgcgtggtgagcccggtccaccggactctctctccttcctccgcgcgcgcgcgtcttgggccgctctgggccgcctttttgggccggccggcccgttaagctcggccgagctgccctttctctcgggccgcgccctagccgcccgagggaagtttatattccctccctctccctttttcttctctttatctcttccaaaaaggatttaattaaatcattttcctttagaccaaaaatccaataatcttagaaattcaatatcttccccaccgtaaatccgtttgactccgttcaacttccaaaactccccaaatctcgagatctacctaatggcacgcttagaggtcagtaatagggctttattttcgccgtttgttgagttgtcccgtttcgcgtgtagttccggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcggacctacctagtttgttgcatttgatccttcctttgataattgttataccatgtccccttgtaaccatccagttgcgtctcgatattcgtgcacccagtgcgagtatcgacggacgccttcaaacttaaaatctgaaaaacaacttgggtaaaacttgggttttacaagagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgctgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaagattcagcagctgatgggatcagctaggcccgggtggccgtttgaaaagttgttggcccgggtggccgtttgaaaagctgttggccgggtgccaaccttgtttcaattctaaagactgatacatttgcacatactccgaccggacgagacgctctgtctcatccgagtcgtttgagaagcactcacttagttgttttcagaaaagagttcaaataaaatcaattgcaaaaacaacagccttcccttgaagcctgcattaaacacttaattcccttggcttgctgagtactcccgtactcacccttgctctatataaataatcccccccagttgctgaagaagatgaagcggatccggctgatgaggagttcttccaggagcaagccggctacgatgagttttagggtttcggcctagttcccaagtcgcgcctgtaatgattggtccaagtcctggcttccgctttccttttgtaatgcagttgtgagctcgggatctgtccgcagcccaacatgactgtacttctactctataataaagagacttctgttgctgtgatattctgtctccctgtgataccagcactatttcctgggactggtatcgattaacaggttaatttggagcgtcacgggctagttccggtcggtactagttcggggcgtgacaagagatggtatcagagcacaagcttggccctaggacgaaacccgacgcctaggacgaccctaaggatactaagttcaaaactacttgcgaaaagctaaggtttcttttgttttctttattttcaatagtttgtttctaaaaatggttactgatcctttctccctttttcaaaattgtagatggcagtgaacgccagcttcagctcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgtccacaccacttcaccgtggccaggcccactctccagatcgcgtaccaggacctctcctggactgcgcttcgtcgcctggcccacgactacagccaccgtctcgggggctccgccttccggcagcttccacgccttccttctggccactcagacgccaggtacccttgtccgtacagcgagtctcagccagtgctgactcgcatggttgagctttcggaggctcaggccactcagcacgacctactcctggaggcttaccgctcccttgcccgccgctacgccgccctggaggcccgtctggccgaggagggtgtcacttcagttgacactgtctcttgggactcaggccgcctctgccacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaccgtgttccgttttcactacccagctcccccaccgccagcggcccgtgctgctgccggccctcgacaggttccgccggtcccttcgcgtcagccgatcgacgtttcttcgactgaggagccgaccacagggggcagccaggccgacgaggagtagaggaggcagtcttcagcagccgtccgtgtgttaggcccttttgttccaccgccaactcttttggagtcgtggcgaggtagtgcgtgcgtgtgtttgttgtgggtgttgtttggtagtctggttctcctaggtggtgtgcgcgcagtcaagctcggcgtagctctgtgacttgtccacacccgttgtatcaggtgtctttatgatttgaaaaatccagtttatgcctagtgtgtgctatctgagttgctaattactttgctccttgccctcctaagtgctatctgactcttaccccgccctcttctgggagtttagatggctagccgtccccgccgtgcagctcgtgcaccagcccgctttggttttgaaaatggtagagttgagccagaagaaaatcatgagtcagctaatgagcagtctcaccacagcaaccgttcgcaccgtactgcttcccgcaacgcagaagttgagcaaccccgccgcagcagccgctcgcatcgcacagtttcccgtaatgcagagatggaacagtctcaccgctctcaccgcactgccagtcacaattctggagaagaacgcctcccttccccacctcatgtggaaaacaacatgcaacacttaatggcagttcagacacaaatcttgcaaggattagccgcagccgtagccggttttcagcataatgcgcatggaaatggccaccctcacatgagcaacaatagatccaagctgacagattttctgaggtcacgtccgccagagttctctcagaccgtcgagcccgttgaggctgacgattggctgaaagatgttgatagaaaactcaacttagtgcagtgtactccggtcgagaagacgctctacgcctctcaccagctaagaggacctgctgcagattggtgggagaattactgcaatgcacaccctgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtatgttcaacaagttggctcggtacgcccctgaggaagtgggcacagacaagaagaagatcaggaaattcttgaaaggaatcgcagttggaatgagactccagttgcttgctcatgatttccccacttttcaacatatgatcaacaaggcgcttctacttgaggatgccagaaaagaggctaccgaagaatacaagaaacgcaagtctaaccatcagggaaattcttcccgaggcgcaccttgccctcgctacggtcaacccatgcaataccaccagtcggtcactcaggctaaccgccagccaggctacgcccctcgtcctcagatgaaccgtccggcacctcagccacagcagcgtgcccctagtggcaatactgcgccaaacagtgttacctctttcaagtcaccacagggaccgtcagcagttcagtgtttccggtgcaaccagatgggtcactatgccagacagtgccctcagaatcctaccaacaccagcttaggtcatgctaatggcagcactgccagaactcctactccagcggcagctcagtctcgtcctagctctcaggcaagtggacaaggttctcgtgcatccaacaactttggtcgaggccgggtgaaccacattcaagctgagaccgctcaggatgctccagacgttgtgatgggtatgttctctgtcaactccatacccgcaatagttctgtttgattcgggagcttcccattctttcatatcacaagcttttgtgaaaagaaatggttggaaaacccaaaatttacgtgtaccaatgatagtacattcccctgggaggaatataagggcaactcaagtatgcccggaagttaaccttagaattgaggaagttgacttcctagccaaaccgatagtcctagactcgcaaagcttggacatcatcctagggatggattggttggctaagcacaaaggacagatagattgtgccgaaaagaccatcaccttgcaaggacctggaggaaagcaagtccgctttacctctaacacccctaccgcaagtcggtctatcctaacctgtttacaagtcacctccttggagtcggtgcccatagtctgtgaatatcccgacgtattcccagaaaaattaacaagtatgccaccagaccgagagattgagttcgccatagaactagcgccaagcaccgcaccaattgcaaaaaggccctaccgaatggcagctaatgagttagcagaagttaaaagacaaatcgaagaattagagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttgttcgatcaacttaaaggagcaagagttttctcaaaaattgacttaagatcaggttaccaccaatttaaaatcagatctgaagatattccgaagaccgctttctcaacgcgttatggtctatacgagttcacagtaatgtccttcggactcactaatgctccagcgttcttcatgaacttaatgaacaaaatctttatggaatacctggaccagtttgtcgtggtgttcatcgatgacatcctgatatactccaagaatgaggaagaacatgctgaacacctgcggctgataatggaaaagctcagagatcatcaactattcgctaaattctcgaaatgcaaattctggttagaccgagtagcatttctcggacacgtgatctcctccaatggtgtcgaagtagatcccagcaaggttgaagctgtacttgcttggaacccgcccaagaatgtgtcagagatccgcagcttccttggcttagctggatattatcgaagattcattgaaggattctctaagctagccagacctatgtccgagctgttaaagaagggcaagaaatttcaatggtctgcagcctgtgaacacagctttcaagaaatgaagaaaaggttgaccactgccccagttctcaccttgccagatatccgaaaagatttcgagatcttctgtgatgcatcaagacaaggcgtaggatgtgtcttaatgcaagaacgaaaggttgtggcctatgcatccaggcagctcaggcctcatgaagtcaattatcccacccatgatctcgagttggcagccgtggttcatgctcttaagatctggaggcactatttaatcgggaacagatgcgaagtatacaccgaccacaaaagtcttaagtatatcttcacacagaccgagttaaatatgagacagagaagatggttggaactaatcgaagattacgatcttggaatccattatcatcccggtaaagctaatgtggtcgctgatgcgctaagtcgcaaggcctattgcaatgtagctcaaatacggcctgaccaagatcgcctgtgcagagaattggagaagttgaggctgaccatggtacagtcaggtgtccctgccagcttgacagtatagcctaccctagagtcgcaaatccgggaggctcagaaagacgacgaagggatacaagagttaataaaaagaatacaggagaagaaagacaccaatttctccatggacgaccaaggcacagtttgatgcggtccacgcatctgtgtaccggccaggaaggaattaagagatctcatcctaaaggaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcaccagaggccagctggtatgctacagcccctaccaattcccgagtggaaatgggaagaaatcggaatggatttcatcaccgggttgccaagaacccctagcgggtacgactccatctgggtaatcgtggaccgactcacgaaatcggctcatttcgtgccagtgaaaaccacctatgatggaaagaaactagcagaactctacatgacccatgtcgtatgtagatttggctgtcccaagaagattgtgtcagaccgaggcactcagttcacctcaaggttctggaagcagttgcatgaagctctcggaaccgatctaaattttagtacggcctaccatccgcagaccgatggtcagacagaaagggtaaaccaaatcctagaagacatgctacgtgcgtgtgccctggatttcgaaggcacttgggatcgttgtttgccgtatgctgagttctcatacaacaacagttatcaggccagcattcagatgtcgccgaatgaggctatgttcggaagaaagtgccgcactcccttgtgctggaatgaggcgggcgaagcactagtattcggtcctgacatactcaagacagcagaagaacaagttaagctaatccgagaacgtttaaagacagcgcagaaccgtcagaaaaatttggctgacaatcggagacgtgaccttgagttcgaaaaaggagatcatgtgtacctgcgggtatcacccctccgtggtatgaagaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagctaaagaaatgtcttcgagttccagaagagcaagttcccctgggtaatatcgtactggaaaagaatctgacctacaaggaaagaccgatcaaggttcttgaagaggcagaacgtcagactcgaaggaagaccatcaagttctacaaagtccaatggagcaatcattctgaagatgaggcaacctgggagcgagaagatcttctccgcgccgagtttccggagctgctcccttaggtgctgaatctcggggtcgagattcttgttaggggggttggtctgtagcgcccgttccgtcgtggcgcctagcgggaaaattatctcctaaaaaccctaattgcgaaatttgtttctttgcttgttgtctagtgtctgtgccatctcaagatctcaatccccgatctatcgtcgagttcaattccgaatccaaatccctccaaatcaaattcctccgcaaaagtctattttgcctcccccgtggttgatgggccgaaattctctcggcccatcttctcctctcccccggccctgtcctctccccggcgctctctctctctctctctctctctctctctctctctcgctctctctcccccggcgcgctccctctctccctccgctccgccccgcgccgcgcgcgcgagcgcgcgtcgccgcgccgagtgcccctccctcgcgcgccgcgcgcaagcgcgagagccgcgccctgcgcctctccgctctgcccgcgtgcgtgcgcgtgagccgcccgcgccgagccgaatcttccctctccgctccctcgctgccgctccccgcgctcgttcgcgcgcgcgcccgcgtggttgccgcccgtgtcgcgtcgcgtctgcgccacccggtcccgctgccctgccgcctgcagccgcgcaaccgcgtggccccgcgagccagcgcgcgtgcccgagccgcgccactccatccgccgcgcctcccgttgcaagccgcgcgcacgtgccgtggtggccgaccgcccggtcgccgccgtcgtcagcctctgcacgcgcctgtcgccagtgtcgccgctctgctccaaaccgccccgccgtcatcgccgtcgtcaccgcctcggccccgccactcccgcgctagcctccaagggacggaggcagagcctccctcctccctctgccgcgtcgcccccgctcacctcctcctttttcccgaatcggcaaaggggcaagccccctttctccccctccttttcccctttttcctcctcgccggcgtcatcttccctgtcgccgctttggccgcgaccgccgagcgccagctcgcgcccttgaccgcgcaagtcggttcccaaaccgacattgccgcccatttaaaccccagcctcccctttccctccctcttccattcgcctccgtgccattgccgccgcccccgtgctctgtctcgcctccgccgtccttcgccgagcgccgggagaaccggtgcgttcgaggacgcggaaggggacttcggccgcgccctcttcttcctcttccccggcccgaggccggagagattactcccgcgccgtcggcctctcgtcacagcgccccgacccgcacggtagtgcctctctccgttcttcctcctcgctccatctccccccttagttttcggtagtagctcgagtagcccccccgtagctagccggcaccgccccgacccttgccgtcgctcgccgagtgctcgccgccatcgccgctcgagctccgtagcacccgctcgtcgccgacctggctcggcgtagctccgcccaatccgacgctagcatcggattcccgtggccgcgtagatgctctcgccgccgggaattggcccctcgtgacctcgtcgccgttttccccttttcccgccaccggttgccgccgccacgattcgccgccgtcaagctccctccggcgaatccgagccgttggctcgtctcccctcatcacgaacaaccgcccggtgtgctcgctttcgcccgtatcgccgtggttcgctctgccgctcgcc

SEQ ID NO: 61942 - DNA, 818 bp, Oryza sativa
  unsure (1)..(818): unsure at all n locations
tgtggcacgtggttacacgtgaggaagatgtgtcttgtgggtaaagatgtacacctctaatcagagtataatctattcgaatagccgcgccctcggttatgggcaagccgagtaatgtacccaagttagtgttttaattcttaaaacctgcttaacaactaaaatgtggaatggttggcctgggttggcttgggacgagctgggacccagggtcgggttgccggttcggtctgaatcatcgtaggccttgggttaaggcaggttcatgtgggttcacggccttgataaataatattgcatagttctagaatcgtgtttacaaaatagctttgagcaactaagcatctttaaatgctgtttactgcaaccctaaccctttatattataacccccttgtactcccttgcatttattatgcacttgtgggtgtgtcttgttgagtacggtggttgtactcagtcttgctcaatttttcccaacccagaagaggagcccctggatgatgaaggctttggtgtctagctcgtgcctgccgtcaagcgcctgtggtcgtcgccctagtcttccgctgtttctcggttgtctttgtgtgtgctgggccttcgtcggccatgtaataaattatctatttacgctttcgcttggtgaactctgaattggatcaacttttggtgtaccctgccttctgtgacaaagaattatgcacgcacttanggaacgcccgtgggttattttcgcgtcgtgaaaagtggtattaaaagcccctttgacctaggatgagctggagattcccaagccttaacaatatttttcaaaaa

SEQ ID NO: 61943 - DNA, 12056 bp, Oryza sativa
attaactccttaggtttagcgaagtttaggcataactgcagttcctccggcaagtccctaaactcttgttagatgaagttctgtttgagttattctgctgctactatagaatatttattttctcatcagtcacggtattaacgtttcaatatttctgagtagctgatttgttcattcatctttgtcagatttttgtaactaatcttctttaaatccagttagtatatcgcatagttcatcaaactcttcctttattacacttgcaatactgaatttggcttctgatttcactctgcaggtcaagttctgcatgggatacagtatatggatttcttgtgcttcatttttttattatacattcgaagagtctgcttcctggttgtgaagcttttcatagaaacttattctttgcacagggctggagcacctttgcaatttggataccttagttcttgtttttgtctgctttgtcatgcacaggaagctgtgctttgttactggattaggggctacatgtttctgtggcctcgtaatccattgctggaggattggtggcatcctccttttgttttgtgggtattttgtgactacatgcctgttttgcaaactcaaattaggcttgtaatacgattacatttattgttattgaaagggaaaagaaaaaggtcagaaaaaaacatcatatctcagtcagctgacaacttgaaccatttttgcttcagtatattttgcatgctctatcaggagtatccgaaaacagatcagagctagacatcaagacagtagtacctgctgcacatgcatgacaggctagttgattgtgagagaacatgcatgtgttctctgtcctgcaagaaattttcttcagtggctgctgtaagggcaagttttataataggggtggttaccacatctaattttatccatgtaagataaaagatgatatatagaatacatcacatctacactacctctagcatactaattcaaatgtttttattttatttgtttgtccaatccactctttcttttatcttctttttcttggggtttgtgtgaaggttatcccttatataaggggtggctcaccttctctttcctcacttatttcttccaccttatcatacaatcttacgtggcatgtttaggggcaacacatctagcattatagtacttgccctaagtgaaccaattactccatgattgctccttcattattactgtacatttggaggtacaatgtgtcaggattgggcatgttacttgcaaccgagttttgcaactgctccatatatttgctgcatgatcagaccaagaggccatgggtggttctaccttaagttcagagttctgtgaactgaagaagacgagatgagtgtatcttacaacacatttcgattccactgatagcatgaaaaagatggaacatccatcaagaaatgaaaataaatatcttagtccatgtaatttgagtatataaggcctgggaagcatcggaaatttccacctcagtcaaaccacgtttcgaggtggatgatcaacaagtgtatggaaacattttccttcatgcgaggaaaaagtgtacccacagttccatcgctttcatgggtagcaaaaatgaactactttttgggtgaaacatgaaaatgaacaatgcacggcattgtttggttttgtggggacgggatgattgagtcacttaacagatcgtttgtttgaagaatgctaaactattgggaaaaaaaatagtgtcattcttcaaattttgtaggttgatcttacgatgatcacccattctaaagggttgtttaatccctcgcccaaaagagattagcaagaattaggctatgtttgatagtagtgatcggtaacctttctcctctgcacataatactttagcacatgactaattacatattagcttaaaaactttaaaaattagttaatataatttttatagcaacttttttataggaaaattgtaaaaaatacatcctttatcagttcaataaacatgtgtccgaaaaatgtgggagtagaagttggtaactggtactaaatataaaaatgtgggagtaatatataacacaccctcaggccgcgttattttcagcggttgggtttggatgattagctacacgtaaaacgagaaacgcggttagcatttaattagttaagtattaattattaaaaatttgaaaaataaatttatttgatttcttaaagcatcgtttttatagaaaattttttgtacgaaatacaccgtttaataatttgaaaaacgtgctaacgggaatagctaagctgcattagctgtttagaacgcggagaggggataagttcacatctactgtgggcttagggcatactccctccatcccataaaaaaccaacctaaaaccggatgtgacatatctactacgaatctggacatacatctgttcagattcatcgtactagaatatatcacatatggtcatagatttgttgtttatgggatggatggagtactcttaacaggtccctgccatgtggaccctacctgcagcagcctgagggaaataaaaaaatatccaaagacaaaaacaattcgatccagtagcttgacacccccacccactagtcgacgccctcctctccccgtgcacgaatcacgagactcacgaccaccaccctcgtttcggtttttgaatcgtcctccaccattggaggaaggtgacgcgtcgagggcccccttcccggtgggccccacatggcagcctcacgcccccaaaaccctagcgcacgaggcgagccgccgagccgagccgcgccgcgcgccacccaaacaccgagcccaaaaaccctaaccccccctctattaaagcctccgcgtgaagagaccaaaacaccaccaccaccgcgagacgacgcgagcgcacgcacgcctgcacgcgcggccgcatcggcatctctccctgtccactcctcgcgcacggtctcgaggtagggtttcgagctcagatttgggtgtttctctctctgaatcctcgtctgttcgcgacaaagttttggggggttttgagaattttttttttaaaattgtttgttgcagagatggcggcggcggcggcagtgtgtggaaccgagagggtcgccgaggtgtccgcgtcggcgtcggcggcggcctttgtggccttctctgccgccgcggcggagagattcctggctgtgctcgcgctcgcggttagtgttttcctcttcgcctaacgctgcgattagcttgcgatttttgttgctagtggcgctaattgttgataaatcatgttgtgttatgtgtttcatcgagggtttgacctgaaaatttcaagtaattaagcccgcagatctggagatatgtatacatgccttctctgcagaatttttggatttcgagggggtaattttggtgttctattgcctatctgcggggtagatctaagtagcagatctgagtagttgaaccgagtaagtttctggttggaagtacaaagacagcctagtccatttgtaacaagcttgctagttatgtatttctatgagagcgaaaactgtgtagttgaatggttggaggtacaaagacagggtagtgcatttggaaccatgcttgctagttatagtatgtattactatgaggaaccaaaaactaggagcacctggatgcctgacagcctgagcattcaacacattgttggtgacaattgtaattctaagctgcaatagggacaccatagctaatttcttctaaatagatgtttagttggcatacttgctatatcggtcattctgtagaatatactggaattctattaagagggatactagaaggtatacagggctatttatgctgtatattctactagttgggtgacttaatgggtatgattttagctgtatattctacagtcgggtgactgaatggatatgattttagctgcatattctactagtctggtgacttaaagatacaattttagcgtttccattcatcatgtcagtatgtgatgtttttcctgaagtatcagtatgcatcagtgtgttttgatgctacagaacgttttgactgacgttggcatataggtaagatgctgattggttgcgaactatctgttcaatttgcatctctttcaaaacactaattgtttctaatctagctctgtaaatgaagtttttgaagtaccttattatcaaatcccataagctattctctacagatttctaattcgtagaaagtttatgctgtaatattaaagaacagcttattagggaagcccctcaaaccagcttagtagaagcttccatactgtggcttttggactaactgtggtatatactcacacagatcgttggataatattttgtcgcattgcctgagataattccaattttataattgaacattttggcttttttggactaattatggtatatactcacgcagaccgttggataatatcttgtcatgttgcctgagatcattccaagtttataattgaacgcaatgatgtaatataatattaatgcatttctttctttttggcactttctgacgtaacgggtatctttcttagatggaagcggtaaatggtggagcagatatatttaatgaggaccaacatgcaatctacaagtaagttccctgtcttattatgtaataataatgttttctatgtaatataagatgttctttgttgctgattagtttactttgtaattaaaggctactcggcagaatcaaatctgaatctacccctgagaacaaggatgggtcagatgatgacgacgacgatgatgaagatgacgacgaggatgatgaaggtggtgatgatgatgatgccgaggaggacttctctggcgatgaagggggtgaggatgaagatgatgatgatgatgaccctgaggcaaatggtgacggaggcagcgatgatgaagatgatgatgacgacgatggtggtgacgaagatggtgaggatgatgatgatgaggatgatgatgatgaggaagatgatgatgacgaggaccagccgccttccaagaagaagaaatgagctagcctccttcatcctgcatctgcctcctcaacttgtttcagtctgttgtgctgtttagatgatggaacaggttatgggacctatgtagcttatggtttgggttgtttgggtctctcataggagtaggaaaacatttgacatctgatgttaagccgttctcttgtgttttgcctttgtgcatgtagacgtaaaatgctgcggtgtgttatttattggagatctgattctgtcatgcattcaagtctgattcttgttactttacctttaagtgtgacctctgtgcattgtcatgttgatcttcgaagccgcctccattcagctatggtttggtttgtacaggtccgtaatgttattttgtgcaactggtgaagctgaatttgacgtcactctttggcggcggaaaaaggcttcaactggacaaaaaggaataacagaatcctgcagacttttggcagagcaatgaaaagaacactcaaataagcaaggcactaagccactaaccaccgcaaaagaaaaaaaacgaaaacactaactttatccataatatcgaactggcaagaattcactaaatacatggtcaaggatcacgtcgtaatgaactccatcaatcatcacatatacccaaagatgtcatatgatacaacaaatttacttcttctaccgttacctgggatactactgcagaaaacaacgcaactccccgtaatggaaaaggaaatcgtgtcagaacgtgaaatgacactcgctacacaaaagcctaaactaaaattggccaaaaatttgccaatatccaatgagctgtattctcctgtccaatgtccaaaaatccaacgctttgccagggaaactacatctgacaaaattcttcctgaactgatcccctctgggaactgtatatactatttgccatccaagtcatgactcacgacgactccggttctgacttcgaaaactcctgaggctcactgctggcaaatgctagccagacagcagtacccgtcaggtaaaaaaatatcgaaggtgcgaaaagtgatatctgcacataaaagagaactatgagattagaacagttcataatgaaaaactataggttatgaagatggattagactgtgatgatgacatacactccaagaatgagttgtatcaagaagatagcctgttagtgcaacgccaactattccaggtacagcacctacagtgtttgtgatgccctgaaacacaagaaacaagttagagcagccatctgagactaagtacagtgctgcagctaatatcaagtacaaataaaagaactaaaacaaatgaatctgtcgagctttaagcacacacactgtgaaggattgctcttatttttcaattccttttcaagaatacaaatgaagaaaaaatgagaggacagactgatgctgccttaccagcagaatgcttgcatactcacgagaaatatcttgatgggtgcaataaagacctgtttatcaaccagaatatttagctttagatcttgcaaacacagaaaatggtatgctcatgggaagcttaacaacatgacctgacaatgcgaagctggagagtgccagaccacttgtaagaaaagcaacaatttcccacggtggcacaccaagatccacagaggaaagcatcatgaaagttgcaggtgacagaaatgcaattgtttgacatatctttcgtacctatagaaaaaatttaacagatatagatactttaatttcccgcaatagatagctcactttccagttctccacaagaaaacagaacatcctgtcaggatacagaatataacacaggcacccctgacaagtttactattctggcctttacaaatgattcctagaattatttacagaaccacttcctatttcctaaagtaaatataaataaaataaagagaaaaatcattttatcatcagcacaaaattaagaaagtaaaggcctgacctttgtggtgtctactccatttgatatcaagttgtctgcaaaaggtgcagcaatagatgtaatgatcattgagcccaaaggaggaaggactgacacctacagcaaatatgtaaaaccataagctctcatgacagaaattgcattcatcaatgaaaaataagggaaaacagactttccctagtgaggaggaaatgaagcattgaatagaagaatctcactacaattttaaggaagcatgtacatacccatgctgcttcagtcaaattcaggtccagctcctcactgcatatcatttgaacagtaatgaattgcaagaacaaaaacatgttatcggcataaacttggcattatgtattgtacaaatagcaaatgatcagaccatgatctttaaaaaccagtttttttttttggaaaaatcaaatgcaaaattctaaaccatctattttttgtttggtcctattttcgtagtcaaaccattttcataaaactgaatcccaaaacaacatgtatggacatttaagaaaatgactgaaatgaaagagaaaacatggtcaatgaaactaagcacttcactctccacagcagcactaagttgatagctgctatccaactatgcactactcatttaaacaaaatagagacaattaatctacactgagccaaaaagtaagagaaacaaaatgtcaagacctgtgtaaaacaccaaagaccatacctaaagaatgttggtagccaagacaagcaagtatagtgcccccagcttccacaaaagtgagcatatatcattgcccacactgccttgcttttgaaaaattctctccaaggaacatcctaaagaaaaagaaagttgcaatgttggccgcataatcacatgtataaagaactctacttcaagatttgtctagagataataatgcactaaaaaattttcctggtcatattgcaaaccatatttgtttatttgggaatgatcacatctgcaacaggtgaggtgaatagaatctcgaaccattcgaactagtagttattcagtttggtatattttatgaacaatagagcatcaaatcacatagtccccatgccatgattttgatactttgacttcacaaatgacccaacttgagaacagtcttgtaacttaatccatcaatatacttctaggtcataacagagattatggcagaactatttcatctggtgaaaaatagaacctttagtgaattcatcagctctcccaatgatgactccgatgattttggagacacagaggacgagatgaggtcacttgatccagaaggactctgccccaaatcttgtattacttgtatatcttcattgccccttaactgttgttctttaagagattgaaaccctagacacctatgaaaaaaatgaatgggaagttaaacagaataaataatatttcatctgcttattagagatgtttcctcaccaaataattccaagaagtccaaatatgtaaaagacagattcccagccaaggttctgaataataggtggggcgaacaatagtctgtaatgccaaacaatgtatatggaattaactatctggcagaattgtgaacaagcgtgcatatgtaccacaaaatacctgaaaacacataccctaatacgcttccaaagctcaaaccaccaaacacaacagcaactgctcttgatcgttcttgaacagggatggacctgtatgggcagccataacagttaaaagttatgaaacaatagtccatgaggatccaaaaggtcataacagtttggtgtttttgttctatttttatttttcagttagggatcaggcacaattgtacttactacattatgtttaatataattaacatctcagcaggaagaagagtcaaatttctatgggattcctgttatgcatacaagtaatacaaagttccttaataaaaatctcaaatatagaaagccaatgacaactggactactattgtgaaatgtacgtacgaatcactgtgagaaatccataagaactaagaagcaggaaatattatttttatgtatcattcaacagctgaaagtaaaaaaaaaatgtaaccaccacttgctattctgcacagttagctacaaaataattcatctgaacaactaaaatttcaaacaatagtcatgaaaaatgaagacacattagttggttacatcagattttacaaaccacaaaatttaccatcatacaaaaaacacagggcggcactctaataaaaaatctaataagcatatgtccagatgattagatattttagatggctaccaaattagcactaagaaaatgaaaatggtaaggatgtttttaaggaaaaatgtttactcaatcttgccttgcaatcaaatctgtagcagctgatggtgatacaccttctccaatacctacctagcagaacaacacaatttaaatagaatatatgttatataatgcaaacataagaaatacattgtattttttttattacgagtcaggaacactcctatggtactgaactgaaaacgtggcaaaaaaactagttaatctcatctatatggagtgacatattgcactggctgttttattttggtttgctctgcaccacaactgtttatatccattattctagttcatcagcaatccgccacctcgaagttttcattgtctgataatatagtcagtagtcacatgcatgtttatgaatttattttttcatagagaacccaatttctcctaattgcatgatgagtggcttctcaaactagcagccctcactgtcttgcatatgctttcctcagacatggacaaattataatgtatcacaacttttcagatcaacaaattataggatagagagattaattaataagtagaggtataccagaatccttgacaacacaagccctggcataaaccctgctacagcagggataatggcagttgccaaagaccaagccacaactccaatctcaagtactctcctacagttagcacatgagataacaataattaattattacaagaaaacaatacatagatgaacactaagaacctttggagtgagataagataatgagaaagaacaagggataaaattataggaagtgcctctgagctatgcaagataggcagaatgattctcctgaagtttaaaattgctatatggttcttctagtttatttgaattgattactgctgctattaaatcattgtaactaggaatttactcaaatttatagttaaaataaacaattgggagtaaggaaaagggtaaaataaatgaagatatgtaccatccaaaaaaaattatgacctcgtactgctatttgcaattttgcttactaccaacttaacggatcattctttcccataaaggtacacaaaaaaatccgtaagatatcctaattcctaacaagatgggttgcagaaagaaatagccattatcatcatttgcatttattattggaaacatgcttatcccggaagcaacagcaaccaccaaaaaaaagcattgctaagatattaaaacacccatgcagatggagaatcataggtagcttttgtatttgtctatgcacaaggggggttttgttaccgcaaacaaaccttccgccaaacaattttgctagccatccacctggcagttgactcaaagcataaccccaaaagaatgacgattggactaatccagcagtcgatgagttccaaccatactggtgtgacattggtataattgcaacactcaagttaacctgaaaactggagtgtttgcaattagcaaatattcctaaggaaagaaaaatgaactgtccatatggactaatgcagaagtgaagtgtatatcaagaccaactaaaaacttcaagagatcatgtaactacgagtgagaaaatgacatcggcctagttagtagtacaaacgactgctagaatgaatcttgccaaatgtattgtcatgtttaatacaacagttatcacctgtcactaagcaagtaagaagactgttttcagctgaggtgcaccatgcatactaataagttctctgcttgcatatggcacatttaacataccgatggacaacttctaagtggtaatagcaatacatgctgaagatccactgtcacgctttcttcattatttatgatgcctagttgcctactaactgcctaccaccaaatggtgctgttctattttgttttctcttatgagtataacttagtaaaacaagactagaagcctagaacaacaacccagcggtctcactccaattcgagtctccatattccttttcctgaaaacagagctacactctcactctcaagtagcaaatttacaacgttgtgccatgctcagattatggacttattgttttctgcttcgaggatgactcacatattcattactactacagtgagagcagacatcacctacggaaaattaagcacagaatttcaaacaaggttggagactgggggagtacgaccacgcgcaccttgtccatgttacaaatgacgaaagcgagcgaggtggcgccgatgagcttgtaccgctcggccagtccctcccacggcggccacctcatctccaacgccgccgccgccgccacatccccctccccctcctctaccaccttcgctcccctctcctccccatcctcctcctccgccaccacccccataaccggacgcttctccagggcgcccgcgagaccaccaccaccaccacctccgcctccgcctcccccgccttcgccgggagaggccctcacggccgggggccatcggcggcgacgccggtgcgggagaaggagcagagccggcggcgcgtgcagtggcgggggcatgcggagggggagccggtgccgccggggccccgccccgaccccgacgaggaggcaccgctcggcctgcagcgccgacgccgacgccgacgccgccatgctcgctcgcgtcgctcctgctcggcttggaaccgagctaatcgagcgagcgagagagagagatgaggagtgtggacttgggaattttcc

SEQ ID NO: 61944 - DNA, 722 bp, Oryza sativa
  unsure (1)..(722): unsure at all n locations
cggtgtccatgatctctgtgctctgtgtctgtctcaacctcagaatccattgtggtgagagcgtccacgtagatgtcaacttcagagttgtatcccttgctgcttcctgcagaccgagcatccgaagaacgcgatagtgcttcttctgataacaatctgttcttgccagccatcacgtagttgttttccttgcctttgtccatgctgctgaatgtgtctaccatgatgtccctctcttcagtgtttgtgtcaggtgagtcagtgaaagatatctgcacttctgaatggttcatggagcagggcttcnnnnnnnnnnnnnnnnnnnnnnnnagattctgcatctgtggcctgaagcttcggaacacagatccatttagttgtcggtacttcagttgccggcgccttgttgggacttcatccaaagcttcaccagacaaatctgtctccaatctacaaaaaagaaattgccgtttgtctgagattaaaacagaagagaaaattctgggtggtatgagatgattatagtgggtgctacttggagtcattgttggctgcattaggtggtctgaaaatctcagaattttgcaaggtcggcctgatctcctggaagaaatggaaaagaaatgacaagcactcaatctattaggttcagtcaaataggatcattctaccgaagaaatctactgttttcagtttcattaccatagctctaagaggtcttc

SEQ ID NO: 61945 - DNA, 20662 bp, Oryza sativa
  unsure (1)..(20662): unsure at all n locations
gccgccgccgccacaagcagcagccgcattataagtaggagggcgatgacgattagtgatatgaaacggttgggtaaagctcgcttcaaattcagtttatgcatgctatttatgcttgtgcttaattaggaagctcatcacaagcgcgtggcctacctaattaaatcaagctgatcatcaatcacttaattaatttaattcagagatatatccggatgtttaatactcctagttgcttcattgcggcaagaaaatggatcctcctcgacgtccgcgccttcatcgccgatcgccggaacgccatcaccacggccaccgagctgagctcagcaggagctccattgaggagggcactgacgagacgaggccatcggctctgaactttagggatcactgatctcacgcgatataaaacttaaattggtcctagggagatcacgaatgtgttcatttcgcgttaagattataagtaggtcaaccagcgaaccaattataggcaacctcatttccttgttgttttgtgcttaacaccatattatgaaactttcatcatttctccaatccttcttatccacggctcatttcaatgcaacttctaatgtttcttagccatgttgcttcttttgtttaaaggacaaagtctgttttactcccataactatcagccgagtaagaggttttagtactcaactataaaatcggatattgtatagacctcgcaatgcaactgtccaaaaatcgaacaagttcccctcgaatggcaataaggttgtttttgcaaagttggcatccaaataaattactaatatacttttcactaacatgtcacgtaatttcaataagcaagatagtaataataagtaaaagacacagtaatccatcccgttccagatgggctgaaaataaaactttaactggcgggccgttcgacttatgggccgattatcgttgggcctggacggcccatggataaggacgatccccatctctccggattccttctttccttccttattggggaaaaataaaaaagaaaaaaaaagatatggtacaacaaccgagagctcgctagtcgtcgtcctcgaaacgctcgcggcgactccggtggctgccgcgccgccgcctccggccgccgtaccagcctcacctcgcttcggtaatccctcgcctcactccatccatccccattccccaatctctccggctcctgcttgcagtagtccgctactcctacgaattcgccgccctcctctacttgttgatttggcctcttggtatggaattgagatcgcgaaatggtgcctccatccttgctggctgggcttgggtggtcgatttttttggggtgcttggtggttgatttggtggtaggatttcgtggtggggggcttaggtcattcacggtcaatttcgcatcggcgatgcgtttttcagttgatccagtagtttgtttcctctactggcgaatcgtgacaaatgtgtgacttgtttgggatatgctacggcaactcgaacctttagtcggtttgaacgctggtccgctaatccacttctcagtttcttttttctttttaatttttgggtctgtttttgtggatcagtttctactgattaggcagatctgaaccttgctttgagaccaagctaaagtttttctctttggacggattggcgcagagaaattagttatcttgtttctttttctttgccaaatgttaattaaccgcagtgaaggattagcctagtaacagtatcccatgaatgattaagtgcatgacttaatgacaaaatattttggtgctgttattttgttcttgtaaagcatgatgtttagaatagccatccattcctgttctatatcctatgctgtcacgtagacatgatatgttctccttccctgctgaaaaataggcttgcaatcagttagtatttgcctgatgcttgtttgtttctttcagatggaggatggagtgtctacttatactgttgatgaggctcttatttccatggggtttgggaaatttcaagcatttgtgcttgcgtactccggaatggccaagatatctgaggcaatggaaatgatgcttttgtcatttgttggacagtcggttcaagctgaatgggagctttctgcgcaggcagaatctctcatcacaagtgttgtttttgtaggtatgcttgtaggagcatattcttggggcatagtctcagacaactatgggagaaggcaggtcctttactatttacattccactgtttgtcagatttatttgaaatcttcattacaaatctctctccctaacaatatacagctattcctattactgttaattattgcatatttatcttctaatagaaaatctaggtattggcattttaatgagtcatggtgctcttgaatgatatcaaatccgtattatagatatgatagtacaactcttcaccctatggctttactaaatacgatgtcttctgggatagtcagattaatgtaacccttgctagagcttctttgagagactgagagcctgagagacaagagcttgtgtggagtttggatgtaggcctgcaaatccccatatactagactgttcccacttttcagtgacaatgagtgctacaacccagctgattaaccatatagcaaattgacagagacaatatcatggttaggaggaaaatgtgcatgacactagatgacaatctgaaattcattttacttggggattcttctggccttccagtttttctaaaaaagttccaagatactccttttaaattttctgttcatgcaataacaagaaaattacttggatttcataaggatcactcacagaagccctctacagtacttaatcaccttgagatgatgttttcatacattgctggtgataattttaatagccagttctctcattaatctaaaagtatactaaaaatacgcattttacaggatgtaactttatttttctgactgtattcccttgatacttttccagggttgggttcaatttcacagcccttgtaactggtggggctggtcttcttagtgcatttgcaccaaattacctttctttgatcgtgctgaggtttatggttggtgttggactgggtggtggaccagttttatcttcctggtttttggaattcattcctgctcctaaccgaggaacttggatggttattttctcagcattttggaccattggcacaataatggaagcttcactagcttgggtaaatttctacattttgccaaagtaatactactgtttgcaatctgccttgggtcatagtggttcaactgatcatacaagtcagttaaacagaacgatgcaacatatgattttaaaacagtcgctatatttattaaaacagtggagattgatgtaattgaatttctttggttctgcactgcagcttcgatgcatgtgtttctgctaccctgagtaaatttaacagtgataaaatattagaatagatcagatcccatggaacagaataatgagcttgcatttggttagtcagtgatgatttatgcatttcatataatgtaatggaaactgcaatgaacaatatgttgccttctagtatgtactgatgtatgctccaaactgtcattctaattttgtaggaacttattatttgtttaattttcaggctgtaatgccaagtttgggctggaggtggctgctagcgttctcatcgttgccatcatttgctctactactgttctatccactgacactggaatcaccaagatacttatgcatgaagggcagaactgctgatgcggtgcaggttttggaaacaatggcacgattaaaccgtgtagctctcccttctggccatcttatgtctggccatcgaatggagctccatgagttgacagattcctcagagacatcacagttgctttctgctaagaaaaccaaccctgctgctcattctagcaaaaccgagattgggggccgcaatgcgattttaaagcttctgtccccaaatttaattagatctagtcttcttctttggactgtctttcttggtcatgccttcttatactacggtcttgttctactaacctcggaattgagtcatggaaataagatttgtggatcagaggggatagtaacaatgcaaacaaaccactcaaacgatgctaatctgtacagaaacgtgttcatcactagctttggaggtacatgtgtttcccccttaggctttaccatatttcttgagaatgttctacttcatgtaatcacattcatatcacactgttgcagaggttcctggccttatactatctgcggcaatagtggacaagattgggcgcaaactctcaatgtcctctatgctttatatcagttgcctgtgcatagctccccttatggtccctcaaacagagtccctgacaactatcttcctgttcggtgcacgcatttgcatctccgcaagcttcattgtcttgcacatctatgctcctgaggtttgcttgatcactcccaacatccccaatacttggttacatcgcttgcaacaataaaaagggaaataaaatcacaaaccattgcctcatgtattatcttctttccttgcagatatacccaaccgcagtcagggctaccggagtcgggtttgcgagctcaatcgctcgtttcggtgggatcttgtgccctcttgtggccgttggtttggtgcacgcgtgccatcagactgcagccatcctgatattcatcacggtgatgctcgtctcaggtgttgcagtctcatactttcccctggaaacaagcggccggaaattgagtgaccacatcgcggcgtaagagctaagttgcgagcagaatctgacagtgttgcaagtgctagtttctttagctatacaaaattacaggattgagctcctagaggccattcagattttttttttctttcagttcgtttaaagatcatatatatagaatagaaatgaaagatggtggatttcagattttaaatgtcattacattgttttaaccagacatatgtaaactgccaaatcgagatgcttgctttgctctcttgaaatgggatgatcaatatgttttgaaggaattatagtgcgtcgatcccccttacgcctcttttctttttgcaacagtactgtatagttttacatggcttataatattatagttcaaaaaaaaattcctcgctagaaataaaaagtgttgttcagaaaacgttcggtacactacaggcaatagggggaaaataccagtaaaaaagtggtattgtactatttttttcttttcttttttattttggctgctgcttaattaatgggccgtgttgggccggcccactgacagttggcacggccccacgcgaggaccagatttccaaatttcgttgaaacgaaacgaacggcttcccgccactctcggcttcctcttcacgttgctttctcccccaacctctctcctccctttttccccaattagccatgagagagagagaggggaattggtgaggtgatgctgcgtgtgggggatgatcctctcccagctgggaggctcctccgtccgtgctcccctcgctgcgccgccatggctcgccggtggccgccactggtggtcggcctcgctctcctcctcctcctctccgtcgcggcctcctccgtggtggccaagaccgaccagcctgacggtgagccaagttttttctgcaatttttgttttcagatttttcattcggtttcctctctttcaatcgatgatattcatggattggattctgaaagatgtggtttcctgactgtttgccttctctgtttcagttgctgctctgaacgtgatgtttgagagcatgaacaaaccgtctgaattgttgggttggaaagcgagcggcggtgatccgtgtggtgatgacgacgagtggaaagggatcgaatgcagcgattcatctgtcacagagatgtaattcactgcagcactttttacctttgggattcttgatttgcttgttttttttctttaaaaaaagacggatgaacaggcgcacttctgaagaacttttctctttttcatacaagatgttcacttcagtttgctaatcgcgttgcatttgcatagagcagcaacttgtcggggcttggattaagcggcacgctaggttatcagctatcgagcttgaaatcagtaaccaaattgtgagttgcccctgtgatttcctgtactgatcatcctagttatgcaacttagtgaattttttctctttcatagtacagcgatgtcagcaagaacaatttaaatggtgaaatcccataccagcttccaccaaatgtggttcagttgtaagtttctggatttgtccatacgtacttgctgttttcatgggtaatacaagtgtttttttctctagcacttttttaaagggttttcttatattctcttttctctaatacagaaatcttcgaggaaatgccttcagcggtggtgttccttattcgatatctcagatgactgatctggaaacgctgtaggaacttttcattcataccactatattagtattttcagttgttttgttttcctgtacttacgcatgattctgatatctgttttgttgataacttgaaatcttttttccccatggattacagaaatcttggtaagaatcaattgagcgggcagttgacagatatgttttctcagctgccaaagcttacaacaatgtaagcatgatttataagtttttccacacaccaaagaaagaaaaaaataagagttctctgtactttttctattacatacctacataattgtaatttcgcgcaatgcaaagtaatcatggtgccaattctcatgttacttctattgcccaaatcttatatatcagttgtgtcttcagggatttgtcattcaatagcttctcaggtaacctgcctccgagttttcaatacctcaagaacctcaaaacactgtaagaaactgaattttatgaactatagtaattcatcgataagttattttggatgctcaattgactgccattgtttccaaaatatatacagagatgtggagagcaaccaattcagtggtcatataaatgtgctggccaaactttctcttgaggatctgtaagtgctattcaagtgaaaactgcatccggaactactcttatcattgtccttcaaaatatattattcctaaatggctcacagcggcaataccgaagtattgatgttatcaaatatcaagagctgttaataaaatttatttttttaggcacaatgcaatcgttatttgttttctatagcttaactacattacttaaaactcataagtacaatctcaaacgtatgaattttcttaagcacatcagttaggaactaatctagaatggttttcctccttttgttcccaaggaatgtgaagaacaacaagttcactgggtggatcccaagtaaactgaagagcattgacaatttagagtaagtgggacatccagtcaatatgcctatttttgttgcacttgtgaaatctgatagttctggtcacatgatgaaggactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggtcagaaccaaccatttaccccgctagttgatgactcgagaagtatttatgcacactgtatctcttgaattatagaaaactacgtgggttcctttcagccgtgcatcattttgtgatgtgtagggaactacgaataattaatgtgatatgtgattctggtaatttaagtttgagacgtgcactaagagttctcatcttgcttcattttctaggccgtaggaattcttcagcagtcaacatgaagtcactggagcattccccatcgatgggctgtaagacaccgcctgctgttcctcgcaagtcgatgagtgacaatgagtttgagaacaaactgaatcattcgaggcgaagcacagaccccatcagcttgatgaatcattcatcatcagacctacaagcagctactggcaacttctctagtaacagacaactaggtcaggggacaaccggttgcgttttcagggcaaaatatgctgatggacgggtaggctcctactgtttgctttctaagatctttccaaataaacttgtttacaggctcaattcaggtaatcatctgagtaaaaattgaagtgacacaaagatcatgtcaaatatgcatgtaaaacacattgcagtaaccaaattattaaactgaactagatactaaggtctcaaagaagaatgcttgaagagttcaaagaggtcatataccttgaattatgtgtgtactagctcatcaattaccatgaacaaatttcaggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtaagttgacaagtaggagtaacattgaatcctagaatccaaaaatacatcaatttgaattcatgtgtaagattgtatccctttcttgtcattcattcaggtacctacatgaggtctgttcacctccagtgctccacaaaaacataaagtcttcaaatgtcttgcttgatgctgatctcaaccctcacctctcggattgcggcctttcattcttctatgaggtttgcatgcagagtggctcttctttaacaattgatgaacaaagtataataattgtaagaacaatgtggtctaacggtagggaaatctctacaggacgcaagtgagaacttgggacctgggtacagtgctccagagtgctcaagaccatcagcttacgtgatgaagagcgatgtctacagcttcggagtcatcatgctggagctactaaccggccgaaagccttatgataggtgaattaagggggcaaaaagataaaaccttgaaattcactactgatatccataatgtgatgcatcatctaatgtctgcactctgcacattatgcttactttctctatgtggctgtctgatggttctacagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggtgagctccttattgtcgaagagatatccccatcaatgtgctccatgtctgaactctgaagtaatttcagacatagtatgctatgtcattcaacctgagtagcaccccaaggtccttagttcaaatctatatatgagcgaatttcatattggttatttgagggctaagttcctaactttataaaggctgtatatatccggttgaatgtagagtctaggtaaaaaaaaaaccttctattaaaaaaataaaaaaaaaggtctgaactctcaagtcatttcagacatactatgaagctagtagtctgaactctcaagtaacttcagtacagtatgaagctatgtctgagctctgtactgtactgataatgggaaatggggggtgggattgggattgggaaatgaatgaagggttaggattaaatagaagagggagaatgaatggttaggatttaaagatgggtgggaaatcatttccctttcccatttgccaaacactacctgaagttactgaatttggtcttgttggtggtgatgcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctgaagcaaaactgcccgtcaagtcgttcgtgccattgtacaaaaagaaacggctttgaggttaagagtaatcaaattggttaatttttagagaagacggcaagaatgcgttattgtattctacttgtagtgtatattgtactgatttgttcttccccctttgttttgtttttatcgctctaaggagcacatgtaaaagtctgatactggagtagatagttagtaaatgaatacacatgtaaaaggcctctctacctagccacctaggtaacagcaagttcagtaacaggcattgctgacatagcatgaattcccttttgtaagatgacaaaacatgaattcacaagctcaatgatcactacttatgagaccaaatctcacaacacagctaaaaacagccgtttcctagcaacagaagatccaagcttaactagcaaactatagatgaatttgcagaactcatctagtcttgcacatagtacccaaaccgagtatacattgtcacacagattacagggctacaacaaaatgaaatgggtgcactcaatcactgcagcatgacattgaagtttgaacatacactagggggtacattgctaggggaagtatttcacatcgcagtggccatgatagtttcatttcctctgcacactctactcaaaactttcctacaggagagaaaagatgttcaaattaagtaacagaacagatgagatgcatccaggcattttcaatggacaatgtagattacctgcatggtgcaacctcacagacttttgtcagtttaaatgcaagctgtgcaatggcaattctgattgctggctctgtagatccacttttgcagcttcctccaataaagcaaggaactccttctgtgctctcacagacacaaaaagttgacttggcttataaatcatgctcaaatccgctacctaggacaacaataaaacccacaatatgaataaagcgtataagctttcttggcattagcagttattgcgaaacataaatagactacaagtgaactacctgttgaagccaaggcaatgccaaatcaaacatttttttattcagaaactggccagctataaccctcaaaagttcacttgttgtttcacgtgacaatttctcaagaacaggtccagttctatccattacgtcaatcagataatcacagtcaccactgttcagggcttctacatatgcagacgccatgtcatcattaccatcaaattctttagaagcacnnnnnnnnnnnnnnnnnnnnggctgctcacaggaattggtaagtgaaactggaaagtttcccttaacccctgatgctcgagtccttgctgagcttggaacatatcttcccagagcactttccgatctcacaaccccaggctttctagttttgtcatgagtatgactctttagaaattccccctcttttacacccatgtttaagccctttgatggttgatcttgcatccactttttctcttgtttcaaatgaggaattggtggtggcttatagttagcatccacagatgatctaggtgtagaagtagaaaccctcggtgaagaagtggcactttggttcttaataaacttggaaccaggaaggtgatagcggctttcactttgagtaattgtatacacagttttgtctacagcattctccaaattatgcactttcatgcttaatactgacatgttctccactgagttagacatgaattcctgcacagtgaaagaaagtaagcaattaggacaatatttaggacccccccccccctatactttcattacataattgacttgtgcagtgctctttcctacacgatattatggaggatagcaaaagacaatcactggtatgagttgaagatcatgatgcctattgtcattatcaatttccctttttgtttaatctggcaatggacttatatatataggtaactgaaatgcacagagcttattgattttcaaacaatataatttccctcataactttaatcaaaaccttgctattacattctgaagaaaaaccattgctgaacttaacaatcagatcacatatataaacatttttccagaaacaaccaaactatagagagtagaataaaaaaaacaacacaaaataacaagaattacctgcaacatatcaaagatatttgcttgcttcctctccatctcttgaagctgcttcctgatatgagatagttctttcattgcacccaaacagcaagtatgtgtcccatgtgaagtgatatctgtaacagtggagtctatgctcttactcttttgagccctggggaattgctcaatgtctcttgcagaatcacaatcctcaacgcattcctgagcagaagtgacatgctttgtctcacaactcctgctggctacttctgacatagaggagcaatcttgtttatcatccatggggtcatactcatacttgctgtcattgtctacgatttcatatggacttctatttgaaccctttagcatggaaccattgccagacaccttttcttcaaaatcaactaatggtatcatattctgcttaggaacagatatctcaacatgccaatcgctcaacttcgagcgttgctgatttgcagcattattcagggctattttattgatagacagaggagatctcttctttgatgaagtaatagaattgccactgattgcagaaacagaagatgcaggatcaactctcctgaaagaagtgtctcgtgatccaccatcatttatacttctaccatcatgatggtcaccaaagaagttttctgccataaatgaaatcaataaacaaaaaagggagaaatttatgtggctgctgtaaacttcaaacagattctatgttaagctcgtaaaggactaacaagaaaatttaagaaaagagaccatagagatctggaaatctggggaaaaaaatcctgatccttggacagacctaagcagtagatagacttggcatgcaacaagcaacattgaatagcaaatcattgataaaccccttatcttttggggtcaatgcactagttctcaagaaactaaaaagtattatgagagtacaaattgctaaaaaaaacaaagggattagtattgtcaacaagcttcagaaagtagtatccaatctcttcttttaatttgcagaagtcagaagatcacaccaggccaaaaatctacttataaggattgtaataccttttgtggatgatccagcttctgatggctcgggagtatcagaccctggaataaccttccacaactgaatggcttgggtaattgcatcacgcactggtttgacctgtgacagaagtcagaaaaataagtgtagcatatgcaagaaaatattacagcatgaatgtttagtatgctgaccttgtcaaatttagaacgttcaagggagcgaaggcaggaagttctaaaggaggcaaccagatatccagaactgagagcaatactagatagagctattgaagctgctttccttgtagtccaatcactactcttcagggcatccataatacttgttagagcagatgttaaagactgctctgtagaagcaccttcagcctgaaaagtgggacagcagaaaaataagaaatgttataaaagatcaatctcctgttttggctaacacttgtaggacgaaatcaaaggatgaatatgactaatctacttccaagaaggaaaatttgatctatgacaccaaaaggatgaacatagctaacacaattatcctgacaattgtattgctgaaaatccatagaaagagacagccatattaacagtctcaagatgaaactagaagtttgaaataaaaatagacactcgactttttgagaactcctttttttatgtgaaactgactgagcagtcatataataaagtactcctggctcattatactaattactccattgcaattacttatgctaagctacttaaacaaccaccagagataagcatggaatgcaatcaccttaaaatactgaaagcacattaattaggtactactagataagcttgaagcgaatggtgttgatgatgcaagagcaaaattcagacctgaataatacttctgatcaactcaatcactgcaggctttgccatgaaatggggattcttgagcagtttaacaacacgaacaagcatctgcggcagaacagggccagggaagtaattgctctcgtcaataaccttggccaagcaagacgctgccccagcctgaacatacctattctgctcaccaagtgattcaaacaagggccgcaccaacgcaaccaatgcagcgccaccatccccatagcctctagcacacaatgcgagggtaccacaggtatcaacacaggcgtccctcacaacagagtcagcatccttgaggcgcttgacaatgctggtcaccatcttcgtcatgtgaggtgccactaggcttccatgggaccgagccaatgtgccaatcaccttgatgcactccttcctcaccgcactcttctgctcggcatcggtgtcaaccacgcaagacaagaagggaccaaccatgtcaggaggcaaggtgtcagcggccttctcaagctcatccaatccaatctggtaggtgtccctgtctgcaatcttgttgatggcctggaccagcctgtgcttcagctcgaacacggccttgcctttggaggtaaccgcattggacttcatcttggcagcctagaaggctagaacactcttgctgcaagatacacagctgaggcaccaacttagcagagagctcagtagctcagagtaacatggatactgaggggaacagtggcttctcccattggggaatggaggtcgtgtttcctgtagattccccacccatcacctgatctctgaaagaacacgtacatgaatgtgaatgaaggaaccacatacagttgatgaacaaatttgaaattggagcaatcaatattagaatgagaaatttggagctgtcaaaattttgaaatcgtacacagtaagattcagaaagctaaccaaatcaggaggaaatgaacttagcccaaatcaatcaagggaaaccaaataatgcaccaaattcgagatgaatagctattgcggcaaggctttcacgcatcaatctcaagcttatacttaattagacgcatcgcactatgatcatttgaacagttaaaccctagacatcggtgcgcaacccaaacccctccgccgagctccaaagctactggctaacggagcatataattttggagcaaattaacataatcacccgacgcgttctcaccaccaaataaaaaatttgcacgaaaacaaatcgaacaaccaccgaaaatgccataaaattcgaatcctccccttccctcccaactcccacatcacagagcacattagcacacacataaaaacaaacccaaaaaagaagtaataaacgaaccaacgagcaaagctcaattcaaacatgaaccaaaaacaccagagggctcgcgaacgaactgtacgtacggttggagcagtgggatctccttgctcgagtcggaagcctcgcctcgcgctcgcggccgtcgcctcctctcctcgcctcgcctatccagaggggagagcgatctgctcctggaagaagtagagagattttgaattcgaatcgcaacttgaggtaaacaagtggggggagtaaaatggcagcttttttttttcttttactcctccctaccttctctctccacgccgaggagaggaggacgccgagagcgccaattccgaggcaactgcgagtagtagtacaagtctttgctccctctctgaccacgacgttttcaaagcggtgtccacgccttgccgtaccggccccaccgggaccacatgtcagtcagtgtgtagttggtgagtggattaacgaaaggtaggtgggcccacattgcatcttgaggcgcttttgggtgccgggattcgaatttcgacggcttggatcggggccaggcgttgatctacgcgccgtcggatggacaaaccacgcacgccgtcggcgtgtcagtttgaatctgacgcacccacactgttacgctccgacgaccttgccggatattcgcacgcacaccatgaaattgacatgtgggccggaatgcattggcccacgctcttgctaccgtccaggtgcaggagccttgcgggcttggcgtatgtggatgacgcgggcccacgtcaaagcgacacatttttgaagtggtacacgccaacgaactgggcgggaccgcgggaagaggcttaggccctgtatagatggggctaaaatttttaagtccctatcacattggatgtttagaaattaattataaatattaaacgtagactattaataaaactcatccataatcttggactaattcgcgagacgaatctattgagcctaattaatccatgattagcctatgtgatgctacagtaaacattctctaattatggattaattaggcttaaaaaaattgtctcgtgaattagctttcatttatgtaattagttttataagtagtctatatttaatactataaattagtgtctaaatatagggactaaagttaagtccctggatccaaacaccacattagctaagttatcgtcacctaataatttgacggttatcatatttaccataaaaaccatatagttatcgtgatgtatactgcaatttcaaaaaccgagaaggttattgcatgtgataatcatgataacctcacgattttgtaaaccctgtaggtgccatgtcacattgtatctcgatatcagctatatgcatggccaacttacatggcctttaacttaacagcgatttcaatttttacccttcaaccgaaataccagatacaatgaattattcaagtgtcaaaaccggtgcaatataggtaatgatggtataatagcgggtggttttatccaacgtgacaatttgatctaagtcaacagcgctaagtcggtgtagaatacgagaggcagaaggcggatgcttacagggagattgacgccggcgacgccactcgacgacctcgacagcacgaaccctagcggcgcagtacaagcgtccttgaaagctcgggggacagacaggacaggaagagggagaataaacaaactttcttgcttagaacttggacacgacacggctccggcacaatgtatatgggccgcacctagaccataatcccgtttcgaatgggctgcaaactcgaatgggctgcaaacttgaacgggccaccctatctatgggccgattgtcgttgggaaatgggcttacacgataatgggccttgacggcccatagagaaggcccatagagaaggaatggctcgcgggaaaggctcgggctctccgctctcctcatcttcatctcctccggccatccccttctcccctcatccgccgcggccatggccaccgccaccgccaccgccgcgctcgcgctcctctctcctccgctccccgcctccccgacccctcctcctcctcctccactccgcgccattctcctcaagcagcctttcctccgcccgatacgccagcggcggcgtctgtctccgcgtcctctcctgcgccgccgcgaccccgtcgccgcctgcgcacccaccgccgatgcagagaccgcctccacctcgcgttcctacgacgcgctggaggccgagcgcgccgtcgcggagctcctccgcgagcacggcgcctccccggctgatgcggcttccatcgccgcgcgcgcgccggggtacgccgccatgctcgccgacggcgtccgcgagctcgacgagctcgggctctgggagtcgtggagctccggggcgggggcgggccgcgaggtggagatggccgggctcgggttcgggaggaaggtgtactacatggggaaggcgaagagcaggcgcgaccgcggcgtggtgccgctgctcgagagcgtcggggtgcggctctcctccgcgaagctcatcgcgccgtatgtttcggcggctggtctcccggtgctgatcgatagggtgagatctaccacttcattttgagctcaatttgcttcaataaatttttgtgtgagtgcatttgatgatcatttctgcccagtacaaactgcatagtatgagtggtgaaattcggtgacattacctttactgacatgactgaatcgttttggatgtgattggccagacaatgcactctagctcttgcctttcactctagtttaattgctcaaatagtatagtccttagctgtaatcctgcatcttagttcagcaaacttttagaagagtgaagagcttgatctcaagcatgtgaactactcctacctctcttcattcttgccacaaaccacaagagtactttcatctctttttacgttatggcaaagtatttacagggtaacttactgataattgacatagggatacacacaggaatttatcattgaacacttaactctaaaatgtgatgatgtcaaaaatatatgtgatattttttcccaggatagcggtatttatgtttttaacagttgtcatttcgctagatagttcactaggtatctgactaactgtattcattgcttatggtttgtttatatacagatcaagtttttgaaggaaattctattttcaagcaatgtctatgaaacattaataagtagaaatgctaaacgcatgatgatgcacttatcaatacctgcagatgagtcactccaaagtactttatcatttttcgaaaaagtaagtatcacagccctattagttgtttcttgcaccagcttccttgcatcttaagcacctacaaaaattgcatcttttattgcagatggaggccaggtatggcggtcttaatatgttgggacatggagatgtgtcgtttccctatctcattgaatcatttccaatgcttcttctctgctcagagaacaatcatcttaaaccattaattgattttcttcagtacattggaattcccaagccaaggattgcatctgtgctgctgtcatttcctcctatcatcctttctgatgttgaaaatgatatcaaaccaaggattaatgcatgggaaaaggtatacctagaggatatattatgtttgtcttatcttttggagcctgcggtataggtgttgacctgataataagtgagtcatacaatattaccacattccaaaattttctaggttggcattgaacaagaatatattggtaggatgttgctgaagtatccatggattctttcaacatgtgtgctagaaaactatggccaaatgttaatgttcttccaaagaagaaaggtaactgacaaaagagttctcctactaacttggcttaagatcctgttcatttgaggacactgtccattgtgtttgttgttacctgaaatggtaatgaggttcttgttttcagatttccagtacagtccttggtgttgcgatgagaagttggccccatattctgggttgctcaacaaaaagaatgaactcaattgtggagctgtttgatgatctgggtatcagtaagaaaatgttggttccagttgttacatcaagtccacagttgttgctgagaaaaccaaatgaggttatgcaggttgtacctgttcttatgatttcttctaatgtataaactccactggaatggagaagctatattactttgttttagaaaactggaactgactattcttccttgtatctcagattattctctttttcaaagatatgggtcttgataagaaaacagtggcaaagattttgtgtcgttctccagaaatatttgcttcaagtgtggagaatacccttaagaagaaaataaactttcttattgactttggtgttcccaagcattatctccctcgcatcattaggaagtatccggagcttttattgttggacataaatcgcacaatgctccccaggtatgactgcagctccttctataattatttactacaaatggcttattacatgtttatactttatagttcttgtgaacatgtaactgactttaactcatctatggtaagtagtttatactggtcagccgagctacaaaacccttgggtaatgtaatgtatatctgttggggccctcataattttcacctatgcttgggaaaatcttatgcatctcttgcccttaaacacatagtttcacaaatactccttcaaacataaggaccaaaaattgataagtttactgggcacttaaacccaaccagaactgacaggttcaaacttcaacatgttggctatcactagtattgaccaagaaagtgtgtcgttagcacattactatgcattagaatatgacatgtttcatatgatctgttgtgccatgataggcttaagtggaaaatgcagcacgacattggcaacgctatgtgcttcttagttatgttatgctacttccaattcttctgcaagatgcaatgtgttattgg

SEQ ID NO: 61946 - DNA, 1584 bp, Oryza sativa
  unsure (1)..(1584): unsure at all n locations
aaaaataggcgaaaaaagatcgatcggccgaaaacgtttaagtgttggtgaagaagacgagggcgcaccgggaatatatatacccctggatctttactcccgattgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaagattaatgacaattacttcgaaaaattatttttgtctgtaataaattaagtggataaatcgtaataagcaaataaaattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgatagggggttgcccatccaactgaaagggggttgcccatccaactgaccgtaatcctcgtcagtcttgtcctcaactccgacgattttttttttgcctgggagaaccacttgacgcttaggcttatcaggccctctgcccttttttcctttgtagacatgtccttcacgaaaaagacttgcgttacatcattggcaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcaccgtaatacgtggcagttgttccntcgtgtcccttgggtgcagagtgtcatctaacngncacac

SEQ ID NO: 61947 - DNA, 2259 bp, Oryza sativa
  unsure (1)..(2259): unsure at all n locations
ttaaaatgtggacccattgttctcatatcccctggaatgtcgcgatcgacccaacgggtccccctcgccagaaaggcaagttgttgtttgatcgactcgttacccataagatgttgtcgtagccacgcggggaaagtatcaatgtgatgccgtgtagtccatgcatcggacttaccgatgttcctggcgcgaactagagccaagtgctcctcgatgtaagaagctaccaatgaagagtgttgcagaacagtgaaatgggctttacggaataaattgttgtgtaccgtcgttattgctttccttccgagagttccctttccccgtagtctctcttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttgtgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacgatacctttatgctctccaagcattcaaacatactttccttctctgccttgctaagagtgtagctggctggactcaagtaatggctttctttctcctttggttccgggtgaaggtcgccgcgttgttccatatgcttcagatcgttacgtgcttccagtgtatctttcgacattccgtatacacctaggaagccaagaaggtttatgcaaaggttcttagtgaggtgcatcacgtcgattgcgtggcgtacgtccaagaattcccaatatggtaactcccaaaatatagagttctttttccacatcgccacgtgaccatcttcgctctctatatgctggcttccaggcccctttccgaacactactttaagatctttaaccatatcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtacctcttgttggactgtccggataggttgctaagtgcaggccaatcgttgatggttacgaacagcagcgctcgtaggttaaactcctcctgtttgtcctcgtcccacacggggacaccttcttttttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttacctgcccgtcaacttctcctggatcgtcccgtctaatcttgtatcgtagtgctttgcaaacagggcatgcttttaggttttcatactcctcaccgcgatataggatacaatcgttcggacattcgctgacgggtggggcccacccatcatccccttcctaacgccgctcccgccgcctcgcccgtgccctagcgccgccgccgccgcaaatcccgccgctcccgtccgccccacgtgcnntcnggagggtncgaagtagcagtcaacaccct

SEQ ID NO: 61948 - DNA, 21626 bp, Oryza sativa
tcaattcaaattatttcatgtgatttttttacacagaaaaggttgggttacctgtgggaacgactgctccggtcatttagtgcagtggcgccgactgcacggttcttctgcccaacattcatcaattccatcacgtccattgttgatgcgacacagacaaggcttgcatccggcacattaagtccattctgagaattatttcgaatctctaatgtatatacttgttaaggaagactatttacttcagcagtacaaaataatttacttgtgaaagcaatttataacacaaataaagtggcacaatttgatagaaacatgctgttgtgaggatatcttttgttcagaccatcattgacaaggaggtccctgacttgctcattataaatctctatcatttgcacagcaatatcataaatgaatgctcctttcctttgttcggcaagcttaaatagatcacttagtgcccgataatttacaccctgggtttgctcagtcatgttcttgggcccactctacataaaagaaatagagaagatgttaatggtacatgaagggaatccatggtagtatatgctttagaaacactattaattgatatcagtcatatatattgaccaaatattgttactgtactcaccattgtatatgtcttccctgaaccggtctggccataagcaaagatgcaaacgttgtatccatcaagtactgagcgaataaggggctgggtatctaagaacacctcatctgcacgacaaaaaaccattcgatcttcttccattcaagagctcgaaaaaaaattgagaaatggacaggtagaaaaccttgtgttgctgaagggccaaacaccttgttgaagctaaaagtctttcgaccttcctttccagacttggaaggagtgatgatggttatattgccctcatcaattgaacccacagcacaagaacttacttgtccaggtaaaaagggtcgtactctacaatataccctgatactccctataaacatggaaaataatcaaaatacatgctttctttctgcttctcacagcacatttttatccttaattggtccagaaacacttggcatgaatattcgatataacaagcatacctttaagatcttgcacttggttgtacagcttgcgattttcttcaagaactatatgataacctgaggcagcatgtgcaaggctaaacagatgccttcctggaataaaatttgcaaatgcatactttgtttattagcgttatattaaaatagttagtttaattaagcacctcgggcatgcccattttacctaagatgttgatgtcctcggagtacttcatttgcataaactccatgccagcttttgtagctctaatatcagccttgagttcctaaagaaaagaaccacaagcagtaatataaatatttaatcaccaccaagacaatgaaaaataaaatgaataattaaaataatacctcaacatgctttgactgtagttgtagcattgaatattgcttcagtgtaacttctccatatgcttcctttttggtttgtctatgtttggagtaaacctctatcgtatccatctatagaggaagcaaaagaaatgttggttggaaactaaaaatagtagctgctagcaacctacacctatctatttttgtgattgcaacagagattcctacagcggttgaaaacaaatattttgaacatactaaataagagcaaatttatagcttgcctttttctcattagaatttggggtggcttcaaccagaacctttgatttcgagaaggatttggtgccatctgtaccatttttcagagccgccttcacctgttccaatgaattaaaaatttgattgtttatatcatttccaggcggcccagtctacatattgccatatgtcacgcagaaaacgatttcaaaaacaacagataagaagtgtacaaagatgatatctaccaattcatgttggctagtcaatcgattctcgaattcctcgacgagtttactcagcatggactccaagagctgcaggcaaacaatagcataaaaactccaaggaaccggtaaagcatcacatgaaagggaaagctgcttgcatgtatcccattgaaccagtaaacagcttactaaaaaatggggaacctgattggcctacctgtggaacttcgtcgggcctcttgtcggacaaaactgcactaaccaacattttcaaagggcgtgacgtcgactgcacgaagcattaaccgtttagccgcatatcgtctagcaaaacaagacaaatacaaagcagcttcaaaattgaagcacggagctaaccatgtcaccggaatcaagatgataatcaccgctgaatccagcctcctcgtaaggcacctcgccctcgttcatcgattggcacctccggaatggctcggagttcttcctcacgaacgacttgccggaagccgacggcttcaaattccccccgtatttccatggcccggtgccaccacattgtttccagtcaccgtacgacttcaatgccagtacgcagttcaccaccctggcgctcttccctccctgcgcccagaaaggcaaaaaaaaggcgcgcgtcaaaatcacaggctccacaagagagtgtgcctaaagcaatcgacgatgagggtgatggccgctttgctgcagctgcaagcaacggcgcatgggggccgggtggcgcgctccgacacgaacctgctccaaatcggaggcctcgaaacacggcaggccgatctcctgcgccgccacgaggaagttgcgcacgttctcgaagtactggaacgccgacagcgccgcgccgtccggctgcagcacggagtccgccgccgtgttcaccaccacctgcggggcgcgcgcgcgcgcaacatcacagcaaccaaccatcacgctacagtggcaaacagcgcagcgggagcgaatcaaattaacgaacacaacgtgtgcgcatgccttggggacggcgcccgggtggaccctgttgagcgcgccgcagaggatctggccgttgcggaggccgagccggaactcctcctccgacggctcctccggcaggtcgcgcgcggccaccgcccccaccgtgcggcgcagccaccccgccgcctcgttccgcctcgccgctgcacggaaccaaacaatgtcgcgtgagcgagcgaagccagccgatagcgggtggcaaattggcaaaagaccaccacgattccacgcagaacacgcgaagcgacacgacacgacacgacacacgcaccggcttcctccgccctgcgggaggcgaggtcgcggtcgctgaggcggcacccgtgctgccgcagcacgtcctccaccacggcggccgcggagagcgagaagagcgccgccgcctccgccatccgtggctcgcgcgcggtgccgcctcgccgctgcagctgctccgctccgctccgctggtctgtctggtttgaaatggacggtggaattagggaggtggcgagtccattaatggggcgatgcgtggtggttttgtgggggtggttataatggaggggggaggagacggagaggtgggagctttgtggttagctgcaatgcattgcgattttgcgatgcgccaatgcctgcgctgcgtgtatgcgcgcttttctttcggctgcttcgggcttaaaaattgtggttagtggaagtggatttcagttttcatttcctccccttttttgtcttctcatcttctgctcttttttctttgttttcgccgctctggcgttttgtttgagtaaagtgtactctgctccggtgctccctaactacagtacggcggccgcttgtttttttttctgttgttaattttttttcataacgaaatgataaagattggtccacgctgcacatggtattttcttttttaaaatacaattatgtgctttattcaaatataacattgatcactatgaaacttaaggcttggtttagactacgtggagcaactaagacgtgaaaataatcggtgaagtagctaaaaacaatgcaaaaatattttagagataaaccgtgttcgtttcggcattttggtgattagccgcttagcttatcaggaaagacactcaattagtatacgattaactaactgctagctagtacaaagttaaaattttgagttgttttaatcttttaatacgaaaagtttttcttaaaaaatgcaccatttggtgaaatgtgttatgtatatgtgtttgattattttatttttttgagaaacacaatacaaaacagagcgttttgtttgagtaaagtgtactctgctccggtgctccctaactacagtacgggccgcttgtttttttttctgttgttaatttttttttcataacgaaatgataaagattggtccacgctgcacatggtattttcttttttaaaatacaattatgtgctttattcaaatatagcattgatcactatgaaacttaaggtttggtttagactacgtggagcaactaagacgtgaaaataatcggtgaagtagctaaaaacaatgcaaaaatattttagagataaaccgcgttcgtttcggcattttggtgattagccgcttagcttatcaggaaagacactcaattagtatacgattaactaactgctagctagtacaaagttaaaattttgagttgttttaatcttttaatacgaaaagtttttcttaaaaaatgcaccatttggtgaaatgtgttatgtatatgtgtttgattattttatttttttagaaacacaatacaaaacgcaggcactcacaaggccggcacccgtctaggatttgaacccaggtgggctggttccaccacaaggaacctaaccagtcaagctatgctcacttcgcatatgtgtttgattattgctgtactagtatattttatattggaaaatgtccatataccacttctaaactttagctttaagttaataatctaatcaccataaactttaaaaatgtccatttaactctctaaactttacaatattgttcatattttctaaagacaatggaagctttattgaatttaaccaattacatttgttcatatagcctcctaagaggattttgcaaggtattatagttcctgaaaacatatatgtcatcttgtagtgaatcatacttatacgtacaaatgtaggcgctcaaacaggtgtataccacccatataaacgcacacatgtacattctaccactatgagcacttttcaaaagactgcaccgttatattttgagatttacgctatgagcacctcctagcaaatcatacttatacggtataaacacaaacactcaaacatgcgtacactcacaccctgtctctacgagcacttctaaaatattgtgccaggatatcttgagattgacaaagtcaccacagatgtctcgctatcgataggtacgttacatgccactaaaagaataattagttgtaaacttgaacccaggtgagcagatcccactgtaacccatccaatttagctaatctcacttcacatacttgcaggtgtaaaactaaaatagcctagtattaaagtagaattgctagtggattttaaagagactagcgtgggaatgtttttttctaaaaaaaaatcgagtgcattcaatttcagcatttcttcaaacttataataagttcttttttttttacctttttatctgctattatgtgtgaaactactccgtcatttccgctaactccaacattcatgcattctctgaaaacgactgtctcaaatgacaaggggtcgtgaaggttatgcacagaacgatgtttttggcaagtaaagtgactccatattgatattactggtttggagggaaaaaaagaagagaggtgaaatgttccattcagccgtacctacgtggtcatcactaactaactttgttgtacaatttgtctcgggatcaccaactcaccatgtttgaccttgccttgatccaccaggccacccccacacagtagtgcatattgccacttctctttctgtaacaccggtttttcttcttttttttctttttgtttggtaatgaatattcctagatactggagtagtagtagtagtagtagtacctgcatgttgtatgttttggtgaattttcgttcgtcctgtcaactaacaacattaacagttcagtacaaggagttcgattaattcatgtaacaaccaacggagtgcaaatttcttcggacacattgcaaatttgtcttgacccatcagctttaaaaacgaagtgtatcggttcacaacatttcttcgccgataggtcaagtgtcagtgtgtcacggacttctcatgtactttgccttaaatttcaagcatgatctgaagtgaagtactgcatttataagatgggatcatgggacgttgtcccaataaaggactagctaatgcctagtatatgtgatcaaattaagtggagtactataggttgcaatagtaattgttacatatagcatgttttttaccgaacttttttccattttcttcttagggcttctttgaaaaaaataatcagtactattgtttgttccaaagaaaaacagattttttgccgtttgcaatatgttgtgatgagaaaaccatcaatgggagacactagggatgtttttgttacttgaacattgtaataagagtaaaattcttagttctgtcggtaaatacaatacccgttttgttggtaaatatcagttatgtaaaaaatgacaaatgtttgtgaatatataacaatacgagttattgccttacacttactactattactgaatataaaacattagtaccaactttcacggtacaatatatttacatgttgtgttgtatactgtaggaaactgcgctaaggcatgcaagtggcaggaatgaagggccattttggattggtaccaaaatgtgccttaccaattttattggtaccttgaatagtaatagtatgggtttgtattgaagccaaattattggtaatgtcaatgattaatttgtcactaatttagaaccttcttctctatatcatcaatatttggcatcatattggtagtaatccaaatatgtataataaatctctaccctaccaaaaaaaattgtagtaccaaaacatgtcaaaagtttgctactaccagtgttttggtaaggtagagaatcaaacagccccgaaaatatttttataaagaaaaaccaggagaagtatttagattgcactcggtcaaatttgtaacccaaaagctccaaaacgggggagtagtcgaatccccgtcggacctgatcgcctgcggccccacgcacgctctcgctccgctaatctcctctccaacggtcgcccacaatttaaaccggggctcgcatcgcacggcacggcacgctcccactcccactccgccgcccgctcggcttggctccgcttccgccgcgggcccgcgcgacgaaagcgatggccccaccacagagatcggccccagccggcgcgcgtctttgggagggaggccggcctccgtgagccggaggtaaggagaaaaaatgggaggcgaggtggttgccgtcccatgaaagctaccggcggtggtggtggcgggcgtggggcccgccgtgtcagagcgcatggtgggagcttcggatcttcttcttcctgtagcgacttgcgacgcgtggtgaactggtgaatggtggtctggacttgtgtgggtaaacaacaacagtagtgggtcaaggggccgagagcaatcgagcgtccagtagaaagcaatgaaaagcatctatacaaagaaaaggaaagaaaaatgtaaaggacatggtaaacaaggtgtccgacctggaaatgggcatttctctaatcatgtccaaagctgggattggttagtcctagtactgaaccaccgatgactttaacaatgagtagcaacataaccaggtgaatttgacacggcagaccgtaaaagaagattgctcttgaaaaaaactatgaggtcctgattggtagtagttggaacttggaagaaggcggaattttttttccccacctagtagaaccaaaaaattataaactgcttttgataatcgtccaacccgcatactctgttcatatgcgaagaaccgaggacagcgaaaacgtaaaaacctagggcaactccttgatttttttttctgttcatttttctttagatgtaacaacccccaaactaattaatagtgtgctacaagcctatacccataatgttgtttcctatgaatcatttgttggcatagcatcgtgcctaaaagtgcactactggcaatggtcgccgtcccttttaatttgttctcaatttccggcgttaggtgcagattatgggggtccatttcgtccgaaacttggagcgtgtcatatggaccgtgcgtcaccacgtcccgcctgggttgctgtcacgctatgaacaaatctgctaatgtacgtaggacacagaagataatatatcaattaatttcgcaagcttgtactttaccaaatccattttgtatcccgtggtcacgacaaaatctaaaatgcttcctcatttttggaaaataataaaagcatttttcgtcaacagtttaacaaactatttgaagaattttgcaggaattatttcgccaccgtttccggatgattgatatactctctgtccaatcacttagcttgcactgtaatataatgcgttgttgcaacattcaggggtaagcaataggacaggttaattatagtactgtggttagtactacccattaagagtaagtcttctatctgacagcaacaaatactctgcactctactactctaggactgttttgattgccaaattaaattgaccctggattatccagaagctaacacattacttagcttaataataattccacgggtacgagacacgtctcttgcactaaactgaagaaaagctcagtagtgctgagcgttgtgtagcacaaagtaagcagcaacaaccaccggccttacagctaaagcgaggaattcccttagctccaaatccaccgttctaacgccaaagcctttttattcagtgtcgatggatcaaagcttgacgaggaagagatctcgctccagaaagaaaattattggtaaggttgttgttaggtcgtagaggtgatcggtagttccctgtgatcatggcatgatccatcttgaatccttgcttgccatcaacaacagctactctacctgttatgtgttacttacatctgcagctagcttcatctggcaaagagagatacgagcacaaaaggaacaagctatatgtgcaacctaagaacgactaagaacgatctgcttacatctgcagactgcagctagcttcatctggtacagatatggcagaaaaggaaccagcataagaacaatctgctttatgcctgacaacacggtattctgagctctgatgaaatgtgggttcagaatcttcagctatatctgtctacaacctatggcaagccaggtcaaaatggaaaatgctggttcttcttccatgggtaacacaagaaacagagaggatcaatgcctcactggaagcgtccaaagcctagtccactttaagcagctacttgcaatgcagtgtcgggcagagggaaaatcatggggggaaaagcgtctgccccggcggccatgaaaatggcctgcctgcctgtactcaagttaaacgcaatcatcgtccttgctttcactggattgaataatggtccatgcttacttagcaacagtccagattagaaattttctactgaatcatgcactcgctaaccactttaggaatcctgccattttgtgattgctctcgtcttttccccgtacgccaacttggagagcaaataggaacaaaacatatggtcctgcgcctatcggtgcgttcttctcttcagcccaagcctacaaaactgaagtacatttcagtgacagtttctcaatttctgccccaattttgtttcgttttgggtgattaatttgcagggaattttaactgctatgaagtgggtagttaacagaacttaccgacagttccaattttcttctgaaaaatggatataaaaagtggagtaaaatggaaagggaaaagaagatggtccaaaggtggctccttttcgctgggtgtggagctggctggctctgagatgcacatgacatagggctcaagcaacactcaaaagaaacatatgccaatatccttccattgccttttccccctctaccctgatgagcaaggactgtacaactctctctgcccggtctgcttgagccattggaaacatctctgtgcagcaatcaagatggccaggtaggccttgaagagctttggggtgcatcattgtctcagcaccgtaaaggagaggaggagggcgattggtggcaggcagcttggcaatgcgattatccaaatgcacacatagcctcttgacaactcatttcacggcgaaagctgcctccaaagactcaacgatgtgttggcaccgagaaagatgttacgactactaatttagggaaattgcagcggctaagtaggagttgcacttacgtgtcatgttcttttttttcccctgaacatacaacatgaaactatcaaaatgcctatgcactgccgacactgcgatcctgcctgtacatttgaagctttgctcatcgtggagagctatgttggaatttggatcccttgcgtattctgctgggggaatcatggcctgtgcttgcatgtgatgttttcagagactaaaatctactagctcggttcgtatattcagaaagctcaaatgattgactgctaaagtttctcctttccaatttattttagagattttttttctaaatttttcaattcttgtatgaacatttcaagataaactattgatcatgcagcaatgttgtaatattaacttcgagacccgagagcatctttcattagataagataagcaaccaaaggaaatcattgcgggagcagcttgctgagtatatgtatctcaaaaggcaggggaaacgaaatgaaaatgcaatggaaagtgttcttggatgtatagattacttcactgattggcacgggttatgatcaaacagcgctacgataagctaatgcaaaattaaacatgaccaggctacctaatctaaggggatcttaatgtaagaatcagtgggcgatgccatcattgcacaggattgagagaatggcttccagctcactcggggtttccaatcagtaagtatatggccatgatttctcggggtctcgttctcgccgggtcgtctcgatatgatagtctgcttccttgcaatatgatttctagagaatcacgcgtgctaatccaaatggttttatcgtggcaaaattctactcacgcataaccggagagataaattctactcacgcagtggcccaattcacggccttctcaggaccgagagaacttggcccagatagcaatactgggaggaaaaagtacaacgaaggtccctcaacttgtcatccagtcacaaaatcgtcccccaaccaagaacaaatatccggcgtctcttaactaatcaaaataggttaaaataggtacttcgatgattttaacccggttttatcctatgtaacagctgagtcagcatccatatgtcaggatgccgcatcagcgcacactctctctttcccctcgtctcccttcctctctcctttttcccctgggcgttgtggatggcgacagcttcatcgacgcagcggggaggaggtcaggaggcctgtcgtggccggcggctggcgagggacgactgcggcggtcgtctgccttccctcctcctcctccgcgtgccgtgcggcgccattgccgtggtcgagagagcggagcgggggcggtgacggcgggccgagccgtcgggctggacaaggctgtagagctcaccgatgcggtcttccttacctcctcttcctcctccagctgcgccggcgccgccgcggatgccgccgctactccgctccgctccaccgcccgagtgctcgcctgccgccgccgctctgctccgccgcctgcccgcccgcccactgtagcgctcgcccgctgcgcgctcgcggccgctcactagcctgccgctgccgctctggttctccaactctgcatacatatacctctctgtctccttcatctagatgctcaaggcattcatgcccgtcgccgtctactccctcatcgtctccttccacaccgactccttccgccgcgcctccatgctcaacatgctcggcatctccgcgggcgtcgccgtcgccgtcgccgcctacggcgaggcgcggttcgacgcgttcggcgtcatgctacagctcaccgccgtcgccgccgaggccacgtggctcgtgctcatccagatactggtcacctccaatggcaagtcgctgaacccccatcacctcgctctactatatcgcgccgtgctgtctcgtgttctagacgctgccatggtacttcgtcgagctgcggatgccgccgccgctccgctccactccactgcccgctcgctcgccgccgctctgctccactggtcgcgcgctcgcccgctgccgctccactcccctccatcggctgccgcgtgctcacccgcctcctcgggtcgtcttcatcgacctcctgctgctcaccgtctcggcgcaggcgaaggcggcgccgccgtggctggccgcgaacgacgtcgtcaccgctgtcaccgccgccggccgccggctgccgacaccctcctctctcgtcggcctcctccccacactgactagcctgcgcaaagagatgagagagaggaggaagggagagaagaagaggaagagcaaggggtgtgacatggaaaccctgacatgtagggctcatatggtcgcacgctgactcaatcgtcgcgtcatgggtcccacgctgactcaaccgtcagatggttttataagttaagagatattctatatctggtattatggttgaggacgattacgtaactcaattacaagttgaggatcttcggtgtactttttttcatactgggaggaggcatgtgggattgtgggccatccacatggttgcgagttgcgacccacagcaatggcagcagtctgacaccattgtcggtggtcgaggtggcattaccgacagagcagaacagaagatgagaaagaggggaaaacgaacaaagatagcgatacatcaactcagggttagtacattgtcaagtctaagctttgtgtcgtacaaaaacacaaaacgctcacgaactccgcggcacacaggctgcgacgagacgacgactcaaagtgatcgccgggtttcccagcgaaacgcccattcctctaccacgctatagccagcgtcgcacacggaaacaaccgcacataacacattcgcgcgcgcgccagcgccatggtcaccgccgcaggctccccctcctcctcctcagcccgcaagccagcctcccgcccgcggctgccatgccgcgacatcctcgtccacatcgaggcctacctctcccgccgcgacggcgtcgacaacctcctcaaggtctccctctacgccgcccgcctcgccctcgccctcgccgccgggcagccgccgctgccccacgccgccaccgcccgcctcaggtccttcgagtccagcgtcggcctcagccgcaaggccttccgcctcggcaagttcgtccagtccatcaacgccctccgcgccgccgcctaccacccccacccccacgtgcacccgctcctcgtcctcctcgcgtacggcggccagggcgtctacaacttcctcgagcagttcgcgtggctggccaaggccggcctcctgcccgcgcgcctcctcccccgccgcctccatcgcatcggcgtctgggcgcagctgctggcgcacgtcggctccatcgcgatcaagctggaggaggtggcagagctggagtgtggcgtcgaggcgcggctcgaggaaggttgcggagaggagagcgaggtggtgagaacgctgagccggaagctgctgctcaagctgatgtcccttgtgcaggacatggtggattccgcgatgacggtaggggacgtgaccggccggaagggtttgctcggcagctcgacgctaatggcgtccgccggcttgctgtccgcgctgatcagcgttcacaagaactggaattcgtgctgaactgaaagcccaccaaaggtacatgttataaaacatgatgtaattgaacaataattaaatcttaaagtggtgagagtttgaattagtaaatcaaattactcctggactctggatgtcggggtataaattaatcaaaaggtggtgctggtgcatttgagcggatacaaaaactgggctttctccgccatggtgatcattcaattttttgctcatgcttctccttattaacaagtgtatatcaacaaagccgattaatatgtttcctcataattttttatttctttctggaactatagcctgtataaacttttttaagatatataaactgtttacactgtaaggctgctgtaatactaacttcaaaagcatctttcgttagataagcaaccaaaagtaaataatcgtggagctgcttaccaagtatataggagtatgtctcaaaaattaaagcagagggaaaatgaaaatgcaacggaaagtgttcttagatgtactagtatcccctgattttttagattacttcattaattggcacggcttgtgatcaaacaatgtatgctatcccaagctaatgcgaaattaaacacgatcatgctactaatccaaggagatattaacgcagtaagaatcaatgggcgatgccatcatgcattcttcaaagaaaagagtggcctccacatcctctgaagtctgaattccgaagccaggctttccggtcagtgccagtataaataaacatgatttatcgatatgataggctacttaatttcatgtgatatttactatgcatccaaaatcacaaatggtaggtgcgttgtgagcgtctatatttgtactgtgtttctagaaaaaatcacagatgattttgttgtgacagaattctatgtatacataacaagaaaatcccaacaaagtgggtcaggaaacactgggcttaaaagcaaaggtccagaaagatgataaagcggcccaagaaggtccaatgtaagagtttaaggcccatttgctaggctgacgcatgggacccatattgcggttcggcccaatgacacgtcacccttcgtcaagtccaagttccaaacccgtacgaaacgcccactcccctaccacgaccagcccgcaccgcacacgcaaccaccgcccaactcgcgcgcacccaacgacggcgccgccgctccgcctctctcttccacgcagcaaccggccgccatggccgccgccgccgccgccgcgggctcctccgattcccgcaagccagccgctcacccgccgccccgcgacttcctcgtccacgtcgaggcctacctctcccgccgcgacggcgtcgacaagctcctcaagatctcccgctacgccgcccgcctcgccctcgccgcgggcccgctgccccccgccgcctccgcccgcctcaagtcgttcgagtccagcgtcggcctcagccgcaaggccttccgcctcggcaagttcgtccagaacgtcaacgccctccgcgcccatccccatccgcccccggccgtcgcgctcctcgcctacggcggggagggcgtctactacttcctcgaacagttcgtgtggctggccaaggccggcctcctgcccgcgcacctcctcccacgcctccagcgactcagcgcctgggccgagctgctgggatacgttggttccatcacgattaagctggaagagatcggcaaactggagtcttccgtcaagatgcggctgaaggaaggttgcagggaggagagcgatgtggtgaggacgctacgggtgaagctgctgctcaagcggatgtccgttgtgcaggacgttgcggacgccgtgatggcgctaggggacgtgaccgacgggaagggtttgctcggcagctcgacgctcatggcgtccgccggcttactgtccgcgttgatcagcgctcacaagaattggaattcgtgctgaagcccaaaggtatatatatatgttgtaaaacacgatgagatgaaataataaagctcaaactggagcaaaattaaaacaataaacaaaagttgtccctggattatggatgttggggggtataaatcaaaagcgtggctttatcaccatggttgttattcaatgttttatttgtgcttctccttaaaaagggtaatggttctcatcaaaaccgaaaaccgattaatatgtttccatatacctttctcctttatgtaataaagagtttgtgttctttcaactataggtttaggtttatgtaaaaggtacaatttgtagttagaattaaaaaagagaaaagctaaagacactctggcggtgacttcttctcaatgtcttgtatacatagccatgccaatgaaaattactttgcactttgcagcactatattttcgtatatcaatttagtgattggtcagcaactcactataatatggcctgcatgcacaatgtacatgttagtagaaagatacttcaaaatattggatatttaaatcgtcaccgttttatccttttttctcctctctgttcatatcaaagagaccaaggaaaacttgccgagttgaacagcataaacaaaaactatgaacagcatgattaaagcctgatacaccatggaactgaactctgtagcataattatgtgaagtggatgaatacaagctgaaaccatgaatgaacttgacaataagatgaaatccaagcctgattatagttcaatacagttctagtatccagtccctcagtctgtgattctttgttttgcagaatcataaatcaatagtacatggaattgttaacttgatctagaaactttgcctaacatggatttgatacatttgctattatgcttgattgctacctactactaaattagtttaactcaacatgcaactatgcatagttggtaaccacctgcatcttttactagtataaaacgtaccaaactatctaattggcatgtattcatagattccctgagttacatagtgaacacatcaggattggtgagagtgttgcaactcttatgtggaatatactataataagggcaccgattgtctggtattgtgttgtgcttgtacttgctgttttttttttccagtatgtagtccacaacaatttgaatgagccatttcggattttcctttttatgaaaaccttctttgtttagttcattacttccaaattctaccaagagttgccctgcagagcttacaggcggtcaggtagttgcttcttatgttccttccaacagtattggccccctggtgtataaagttctactgtactttctgtgagcactgaagatcacttaaaattcactcttctattgaaccggtgatgatggagggctccggcactctactgaggtaagcagttgaaatctccagagggcagagatcactggtctgcactaacatatttgtgtctgttaagcaccattgacactcaaatgtctgagcaatcgttaagcatcttagattggtatttcagccacgttttggattaagaggctgcatatgaagaattgattgtcgagctaagaaaattgcatatatggcaacacaactctggttactttgattgtagtaatgtcagtttaattactcgctgttctggcattcagcaacggctgacaggctgagtaggtgctgtaatttaaattcatttaatcatttcttcaattgctcaaagaaaagagaagaagccacaatatagctattaatattaggattgaaacagcaggatggtattattaacctattagcagttgacataaaaatgtatcctatgattcgatgcagcaagttacttctatttctgtcgaatttgatttgttcaatgcctgctgaaaaaactcgatttctaatgcctgcttataatttgactggtaggaaagaaattattctgggtcgtgatgaattgccttttgggcgctgtttgacagtttgagacggcatgattttggcaaatcatagctgctgtgattccccttggtgtgccccttcactgaaatcacgaaatgccatagttgtctctaacctagatggaagaaactctcattaatcttttgcacccagaccacgacatgaaaacagatttctgttttaatagcaatacctgccaaggcgaccaatcatctgattcctactagtgctgcagcctgcaggctcgagtcctgccctgtccatggagcaggtaaagctactgcaactctgcgagtactcgggtcgggcacaaggcgatgccgtcagattccagcaagggaagggagaaaaaacgagggccggccgatgcgctccgaaacgaagcaatccgcgcgtctccttttccggctccccgacgagtcacgtacacgtcagtctccaccaccaccggcacggcacggcacgacactgccccccaccgctggcgcacccagcgcgcgcgcgggcacacggccgaaacccaccaaaaaaccgatggaaaaacacgccccgcccgaaacaccaatcatccgcacagctgcacaggcatagcagcacgtgagaaaaccgggctgcagcgtgtgtacgttcgccatcgataccgcggcgagcggggcgggggcgactagtccaactccagcaacgggccaaccaaccactagtagctagggagccggagccaggaggaagccaccagcccggccaagccagccagccacccctaccaacgcgtcccgtgcgaggagagagaggttgcaagcgaggataaagcgcccgcacctcgccgtactccgatccgatgcttcccccctccgtcccctcgtagcctccgcgttcccccgtccccgtcccggcgcgcgcacgctcgcccccctttccgttttcgagccgagctcctcgccgccgccttctctgacctgcgcgtggtcgtatatattaaaccgattcaaacccacggggtaaccactaggcgctggaaagggaaaccaccagataagctctggagctggtattggattagtgggtggtggtggtggtggtggtgcgaggccgtcgctgggcggtgctggttttctcgcgcggctggtgcgatcggagaggtgggtgtgtgcttgtttcggcgtgtgatttgggcggagggatccggcgatctggttctgattcgttgttttttttcttcctcttggtgtgtagggatggggaagggaggggaaggggcggttcccgtgggggagagcggcgggcggcggcggaggaggccgggcgaggacggaggcgacgacgacgacgaggagtatgtggtggaggaggatgaggaggaagagtgcgacgaggatctgtctgcctcgagcgccggcgagggaggagagggcacagacgaggaatacgaagagggtgatgaggacgaagaggaggatgagaccccgcggccgaggcagcctgtcaagagccgcgagaatgggcggaaggggaaggcagacccacccgttgcgcgatctcgtcgacgtaagtacgaggatgacgatgactactcggaagaagaagacgatcgggtcgacgagtacggcgaggatcttgaggaggaggaagaggatcttgaggaggaggaagaggaggacgatgaggcgccacgatccaagcgcatgaagaaacgtggtggccgcaacgtggaggggaagcttcctctggagcgatcaaatcgccggaggtatgaggaggacatggactttgaccctgacatggatgaggaggaagaggaggaggatgttgatttcgatcctgaagtggaggacgaggaggaagaagattttgaggatgaggaagatgatgaattggaagcgactaaggtgagggttaagaatatggggcggcgaaagtctactttgaatcagcgacgagggaagatgaagagcagctctaaggtggccagtcggaaggtgggttcagtcaaggcaaggaacgctgcgtctataagacggaggcagaaaaaacgttcaatgcttgatcgttatgaggatgacgacttcattgtggaggacgaggttacggctgattggcaaccaaggaaaaaggctagaattaggaagcagatggaggttgatcctccgacaccagtttttgaggctgagatatggcctactattgattcagacacgacagacttcgaatttgtaacatccgatgaggaagcagccattgctgagcctactagggttattaagaaggggaggaagaaaagggtatttgtgtcagattcatcctcagattctgaattcgttgtatcagataaggaattggggaatttgaaggagtctgagcctccagagtctctgaaagtgctgccttcatcacccaggaagatttctgttacaggtaatggggagcacaaggggaaggagaaaaaggaaccacaggaggctggaagggcaacgtgcgggatttgcctttctgaagaacagagagtgactgtgcagggtgtgctggattgctgttcacactatttttgctttgcatgcatcatgcaatggtctaaggttgagtcaaggtgtccgttgtgtaaacggcggttcacaacaatcacaaagtcgtcaaaggaggatactggtttggaactgacaaattctgtaattagggttgaagaacgtgatcaggtaacctttccttgctgcggttgtcatataatatcaaatccgacagctaaatttgttaacttcatttctgatttatatgggcagtctattcaaaataatattcatgaatatgtttactgtcattctgctgtacacgtttcatttattcttataaatactcttatcctttcattatttttatgtgacttctcactgttactgcgtttgttcatttccatgttagaactagttgccttaggggacaaatgttatttggagaactaattttcggaactatttttcatttaccatttacaaatcataggcaatgttattttttgcattagctttcctggtacttcagctatatacagtttgcaaagccttccccgtcttaatggtctttgcagagaaaagttattcttgctaatctggtggagattttccatcatcatactatgctgtcaatataaagacaaatctttattgctcttacgatcaagtatagaaagctatttgatggatgagatggcataggatatctgaggtccaacttgtggccagatgatggggaggctcttgacaacgccttcttttgttccaaaaatggagggaaagggcaaacttcatgtttggtttatttttgtttgttgatttctaaaatgccagagatctagtgttttatataagagtttgttatgtacagtgcaataatattataatcttggaacatctgaacatgtaacatcctgcacagttggcgttgttggagtgttcaatgtaaaccacattaattccctggtttgattatgttcttggacatcatatgctgtctcttgatttttgcacaggtttatcagcctacggaagaggaaataagacgttgg

SEQ ID NO: 61949 - DNA, 1320 bp, Oryza sativa
  unsure (1)..(1320): unsure at all n locations
ggtgtcntttgatagcgatcttgtacccgatgagaacaaccgagagtaaatttactcccggttgttctcatcaaccgggactaaagatattttcccgctatttccaaattctttttaaacccggttagggttaagaactgggactattgataagcgcactgaatattaatttccattacatatgtgtttctaaaatagaaaataatgcattaaaattatttaaagtcgaaaaattaatgacaattacttcgaaaaattattgttgtctgtagtaaattaagtggacaaaacgtaataaccaaatatatgatttaaaattaatataaattctaataatcatatatacttagcatatgaatgatattaaattgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaattaataaaaatttgaataatcatatataattagcatatgaatgatattaaattaattgttaaaaactctaattaacatatgtaaatgccacatgcataatttaaacttttaaaaattctaattatcgcatataactagcaattacatgatttaaaattgttaaaacctctaataaccgtacgtaattaacatatgccatacaacaattgatttatatggataatcaatacatccaaaatagtttacatcgtgtacacaataattacggcaatatatcggctgtgatggttgaccgcacgtactttctcctcactattgttccctccttgtgatcgctacgtgagtaaggggtgtctttatttgataggagtatgctagggtcaatcgtcaccgtgaaagggggttgcccatccaactgatcgtaatcctcgtcagtcttgtcctcaactccaacgatttttcttttgcctgggagaaccacgtgacgcttcggctcgtcaggccctctgcccttctttcttttgctagacatgtccttcacgtaaaagacttgcgttacatcattggcaaggacaaaaaggtcgtccgagtatccaaccttgttaaggtcaaccgttgtcatcccactgtcatcaatcattatgcctccactagtcaacctaacccattggcatcggaacagagggaccttgagaggaccatagtcaagttcccatatgtcctcgatggcaccgtaatacgtggggtaccgagctcgaattaggtcgatagtgcacggctattctaccggg

SEQ ID NO: 61950 - DNA, 29938 bp, Oryza sativa
ccccgcgccgccgttggccgaacgccggcgcggcgaggtctccagcacgcgcaggttgaggttgacgccgccgtggacttgcgccggctcgctctccattgatagctagaccaaccaacaactcttgatttcttggcctagctagctagctaactagattgtgtgtgagtagtgtcttcttcttcttcttcttcttcttctagagctaattaagctagccaagttaagtacaaatggtgggtgtggccatgtgagccctctatataaagagagagttccttgtcgggttcttacagtatcgcgccacttgtcatcaggctagctgctgcaggatgcttcactgtacaactcatctgattctgacatatatacatcgacagattcagattgattgattgatcacgactaattaaagtgattatactttgtctgcacatgcattgcattgatcatctgtcagctagctagttactccctccgtctcataatataagggattttgagtttttgcttgcaacgtttaaccactcgttttattcaaaaaaatttaaaattattatattattcaaaattcaacgtttgagtaattagctccaccgacgtgtactatattattacttcgtccgctccaaaatactatgacacatttctttaaatatatctgaacgaagaaatattcaaatatatattttaaaaaaacacaaaagagtttatatcttagaacagaaaagtaatgttttacaagacgagctgatattaagaccagctgatcgatgaagaaatcaagagttgaaaaatgaaaatgcatatgcagtgtttaattaggtaaggtgaaaaagatactatgtagataatgcaagatagctagagacgagacatgcggtgggaaagtgcatgaacattttggaagtgaagctgcatgtgagtgacggggatccagatattcagataatcagatgtgggggctagctgtgcctctttcctgagaaaggccatgcatacatgcagctttgctacctatagctaactatacatgtttttaacttatatgctttggattattcgacatatatatctcctagctatatatctagcttacaactgttggcatcatgatcagtagccaaagattgatattgatcaatctctcaggcccaattcagcagcaagtcgtactattgaaagaacggcatggattaatggactcatgtccatgcgtgagaggtataattaagcaaattcccatttcctttttgctcttttcgcagcatggtcacatgatcagatgatctgcaagggcagctactgtagctagcaagagctgtcacatctgaaatatctaccatgcaattatgaaatgcatgcgagaattggatgaaatggccgacacgatttcacatagtgcagctaggttgctactccacatatggtgagtacttcatccgtttcataatgtaactcattctaccattttccacatccatatagatattaatgaatctagatatatatatatgtgtttagattcactaactttcatatggatgtggaaaatgctaaaataatttacattatgaaacggaggaagtatataactaatatatacacatgcatatatatatatatatatatatatatatatatatatatatatatgatctgatcgatcgaattggtgaataatgctgatgcatcatttcatcgtcactagctagtaggttgtgagtttgtgacaactatagctgggagcagctgctgcatgcatgagcactgtcacgcaagcatggtgacacaagcgatgacgtgaaataaccgtgtgcattgcattcatatttattctactttcaagtgtcaactttgctactgatcgatatcgatgcaccggctcgatcgatatccatctctgggcctagctaattacacagtaacacgcatgtataaatgtcaccgacgcatgcaagctagtgatcgattaatggataagcatgattaagcatttatcgcttgtataacaaatcggcaggtccaagctacttcccccgtttcataatgtaagactttctagcattgctcatatttatatggatattaatgaatctagacacatatgaatatttagattcattcatatctttataaatatgggcaatgctagaaaatcttacattgtgaaacggagggagcaggagagatgaacaaaatctaatatatgcatgcatgtgcatcagtcaagggatccgctagctagctttcagtcagtcaatgttgggtttgcagcgtgtcaaaaaaaaagttgggtttgcagtggagatgtagtcagcatctatcattgacctgatcatattgacctgccaaaactagagttcaattccttagctccgatcccaaacgatgctagaatggcaggttatgttgtcccatgattttcacatcgacaatcttggggagcttatagaaagtatccacgtacatatagtgtcaagaaagaaattaatgttttatagaaccattcatatagacagtgcatccacgtacatatataaatgtattatccataaattaaattagttgctgataagttatatggataaacataagtataaacgaaataacggggctaaatatgacattagggctaaaagcagtggcggaactagaaaattgattcgttggtgtcataacgtgtctattggtgtcatagtatactaattatgtttaaatcatagtgttataatatatggataagcagtttggttataggttctgttaaaagtcgtcggtatcgctcgacaccggtcattacactagaatcgcccctggctaaaagatagatgaatatccatttcctggagacgacaagcactcggaaagtgaatgcatgaacgtttggaagtgaagatgcatgtgcatgacagggatccaagatattcagttgtgtcccttcctgagaaaggccacgcatgcatgcagctttgctacctatagctaactatacaggtgttaacttatatgctttctattcgatatgtcgtagctactcttactatatagtactagtgattacatgatcagtagccgctagtcgattgattgatcaatctctcaggccccattcagcagcagtactcgcactatacatactactgtttgaaacaacggcagtgcatatataaaatacatcatgatctgcagggaagcagtcacaattgaaatatctgctaccgtctcaaaacataattaactatcgagtgtactacatataattaaatctggagatggaagtattatacaatgcagcatgtatgaatatggccgacatgcaggatttcacatagtggtggtactcgatatagtagatctacttagtggccactccacatatggagatcactactagcgctagctgaatgtatgagctctgtaacgcaagcatggtattggtgacacaacatagctaacaactcttgtgtatttttcgtgtcaactttaattactactcactcgcagtgaccatatgattcatatgccgcaattctgatgcgaccggttctggccttctgggttaacaaatgcatgcacatatgtcaccgacgcaagtgaaaggataagcataattaagcatgtcactttttaaaaagtttgtaagctgttggtaatcgacacgtcgaagctattaggagagatgaacaactgaagtactatatatgcatcaatcaatggagcttttcagtcggtcaatgttgggtttgcagtggagatgtactcagcagcattggctactgccggcaccatgcttcattgacctgacaaaacttgttccttacctccaactggtagaatgacaggttacatgtatatatcgccccattattttagaacaatcttggggggctcagagcatccatatatatttatatatggcagagaaaaaaatcgcaactaaactagaacaagtgcagattgataagttatagcgatgtctcaggtgataaatggcaaatgcctgttttatttgggttcagtctcagaaatcacagcaatgtatgcatgatttcttgatcaaataattaaacaactaaataggctgcagtcctatatatgaatatgaatatatatataaatatatatatatatatatgtttaaacaatcttactatgattcatacagatctgataaatactacagcccatgtataattcctaccaccacagcctgcaatcaggtactattttctccaatgtaatttaggtgtttcactaactccctacagaacgcatactgttgtatttatggaagtattacattttggcagagacacaagggtggatttgcgaggatggcttgtcaccagacatctctcaagtatctcccttccatctgcaagctctttacatagctttctgtgtttgagttgtccaaagaaccctgaaaattcaaggtaacattcagcaaagtggagatgaaagcaaagctactgttaaactctaaagagctttcatggcacttcacataattactcataatgcctgcttagaaagaggctaggctaggtgataaatactaagggacagagttctggatttgttttgacctcaatcaagaaagtgcaaactttctagaggtagagcaccactgcatcctcccactaagaattaactgaatctaacaggtaccaaaggtaatgatatacccaaacaatacctgttcctgcacaatggtgtgtagtgtgcggtgtacatctcttgccatgccctttgcatcaccacagacataaatataaccaccctgagaaatgatgctccaaatctcgggagcctgggaatattacaaagcaatggtgaaaaagggaaataaaacactacaccttatattaaacaaaaaggatcatttcatgtaccttctctgccattttgtgctgaacatactcctttgaaggaccctcacgagaaaaggctacaatcaattcagacagcgcaccggtctcaacaaaattgttgagctcatcctcatatatgaagtcctgaacagagaaaatactggtgaggggagttatttaagaggctaggaagttttctaattgccaatcaccaataagatactctcctacactcaaactacaatgcagaaaagttttctgaaagacaaggagagctctgacaaagcacatatgtgcataaccacattgtgcaacatcaatggcagatgtgttgatatttttaattactaagatttataagaatacctatgaccaacagatttcgtatattgtaaagttttctaagtacaaactgcatatgaatatgaataaagtaggaatgtatgtcataccatctttcgatttctgcacccaaagaataggacggcatggcctagttccacaccagtctcttttagagctaatctttcctgccagtgccaaatgcataatataatcaattgaattataagagtcaatatttgaggaaagggggaggaaaaacaaacctgtaagaagcccctaaaaggtgcaagaccagttccaggacctatcattataataggcacagtaggatcagtaggcagtttgaagtttgactgcctaacaaaaattggagcccagctacattcttggctctcttccaagggaatcgagttctgcatacacaatcatcagattaaaatgtttactggtcagcacgaccatcacatacttcaaacaaagtttttatgcttgaccaaatgtatgaccattgttttcaaagtgtactccttcgaaaatataaactctcattatatatgaaacaaatcgacaactacagaatatatgtatcaagaacttttcgaagtctttcatattgctgagggaaagatgcactccctccgtttcatattacaagtcactttgacttttttttctagtcaaactaacttctttaggtttaactaagtttatagaaaaaattagcaacatatacaacaccaaattagtttcatcaaatgtaacattgaatatattttgataatatgtttttcttgttggaaatgttgctatattttcttataaaattggtcaaacttaaaaaaagtttgactaagaaaaaagtcaaaacgacttataatatgaaacggatggagttactatataactatagaattttcagggagtgatacaaggttgagttactgaatagaatgagttgtttagtgttattggcaaggccatcacggtaagttcatcatgagaactgttaacctgacactttgtccatacatcaagaaacttgagaaattatgattcacgtggagtttttaaagtgggtaagaaacaggttcacttaaccagttaaagttggacacatgtaatgaagactggatcttgatatataagcatcaaagcgagctatgacggtcatattcaattatctaccaatcatccaaaagaaatgcagaaagcacagtgactataatatagaaacagagtgccctttcactatgatagaacaagggcttaccttcatccaagtagaacaaactcctttatggatccttccagtaggggtttgcccatacactagcgcacatgttacatgaattcttgttggagtcatcctgcagcaatgtgaatggttttaaatagataggtcaatttgctcaggttagaagggtattattcctgaccaaggtacctcggtgaggaagatatcgagtagtatctcggctgcagtcgaggagcaatggctgcaaagaagacaccaagtggaggctttgctgatgggaactctgtcataacttccaagagactccgttgacttgaaactatccattgagaatactccttctgccaaatgaagctcatgtgaagccaaaactaacatccaaaagcataaacttatattaaaaaccaacctttccagcaggagatgctagatgtcttagcctctcagcatctttgggatcagatgcatgggaagccaaagcaattaaagcactctgcatcaacaaattaaaaaatattaacatcaatacaaatatccagaaaaaatgcatatagaatgtaacaagatagatctgcaaaagttcaccttcttaggaaaactcagaaggtcagcatatctggcaagtgcagtccccacagtacagggggacgggaaaggaggtggcaaagaacccccaaaaagtggagtgccatcctcttggtcagcatgaattgagaataaggtatctggtgaataacctaacagattttctacctcctctacagtctctgtgcagttttctgcatatacaccaacatgatctccagtctcatatctgttaagaaaatgggggtcatcagcagtctaaacaccagtaagaaaaccgtgcctgcaattttgtcaaccaactactaaatttggaaagtaacaaattcagatacttacgtaagaccagtccctgaaatatcaaactctaaatgaatgcaggaccggtaagaagccggcgtgtgaagctcccgccgcacagccacatttgctctgcaaggaaagcatgatcagaatttgttcagaccacacccagtgtcccagtgcagtcaaattaaagaaataatctcatacctgcaaggatgctgaatgtcatatacagcatgaccattactgagactaaaggatttgttgatatgcatggcttcctctggcttgaccaatacaactctatattcaggaatagcagctgtgtagggagttggtgctgccgatttatcatcttcaacacggagcaatttatccaattctggccatagaagttccttcctttagttgaacaaccaaagcattagcttttgttttatgtctcaaagtctaaagttgatatcaatgtttaaaaagtgtgcacaaatagaatcagtgtcaaaatgatgcctgagttcaaagttgagacaaagactaagctaattacggtacgtaccatgcattgaagtcatcctcaatgcattgatcatcatctccaagaccaagaggaacaatgcgttttccacctaaaagagatgtggagaaaagttaaccaccaccaaatgatacagaacacgacagacaggaaaatcatgtgaccagaatgttgcaaagatcaacaatatctcactgaattattacatggtaaacctgttgttcagatctatcggagacaagtccgatttgatttagttgcacacttacactacattaatactagctccccttctgagtctaaaacactctacagaatatcggtagacagaaaaggatgaagacaaaaaaggcacagcattaaagtcttaaagcatatgatcctagtagcaaaccaccctgataaaattatgatgctttccagagcacgttactaactacctacataaaaagattagataagttgtatcccttatcctgtactcttctcatacagtataatttctgacaatgtttagtggcatacaattcttaggtgagcatgaacagtacaggcaaagttatgcctttgtaatatagatgaaaaaaatagtgcattgtagttattcgaacgatggttaccttgttcagcgaggagttggtcaaccacctttccaaccttcagtttaaaaagacaatgtaagtatacaaattgggctctatataaaagcacaatatcaatgtagaagcaccagcaaaccttgttaaaatgctcgtactgcctatttccgaggccaaagaccccaaaccgaagattactcaaccattcacctctctcattcccctgcactccagccaaacaaacaggccgtcaacagaaaatacaacgctcacccatgaaagggccatatgaactgtggatttgagagcaaacctctccaaaccatttatagaacctcgccgcattgtcagttggttccccatccccataccttcaacgagaacaagaatgcaactcagatattcattggaatcaaaattcaaccattctagtttctcctgaattaatcaatatcccgtcagaagtatagtaaaaagtggagatggcacctacgttgccacgaagaacaaggcgatgatctccttcttaagcttctgctcatactcctcatcatccgcagcatactcatcctgaaccccagaacgaaacaggcatgaatcaatcaatacatagaatgcaaaagcacatgaaattctgaagcagcgttagtggcaaatcgtggcggcttaccagatcgagcaccttgaagacggccttgtcgtacctcgacttggcctcctccgcaagcgcctgcgaatccgcaaccaattaagacccagggttttgctgcacgagaggtgacagacagagagcgagaaaatctatccaaccttggcgaagccctcggcggtgccggtctgcgtgccgaagaagacggcgaccctctgcctgccgtcgtcggggtcaggctcggcctcctgcttcctcttcgcgggggcgggggcccgcggctgcggctcctgcgccctcacggcgggcgcggagatggaggagcggcggacgagcagcgcgacgccgcagccgacgaggacggcgagggaggtggtgagcaggacgatgaggtggcggttctcggcgagcgagggcggccacccctcctcctccggtcgtccccgccccgtgagcagcgccgccaccaggtccagcgccgacggcctcagcgccccgccgccgccgccgccgccggagtccatagcgcgcgatgggatcgaggcggaggcggaggcggaggcggcggcgcgcgcgtgcggggtggtggccctagtacgtgggagaatttgggcgaaatattttttgggtttttgtggagttgagcgaaacggacggtgatgtgcgatcgatcggtacgtggtgtggtctgtggtggcgcggtgtgagtgtgtgacacgtcccgtcgggttgaggagagcgatgcacgtttcggcgcggccgcgacgtttggtggtgcgagtgcgagtgcgagtgcgagtggctcgtgcgccgcatggtttcactgttttactatagaacgccctcgaagcctctcgccataaccatcgccgtcaacaacaacgtacaacaaccacaaccctgcgaacgccttccagttgctcgtcaccatcgtcttgattctcgagccgtcgagcgtgttcgatcctaccaaattttgatggggggaaaaaactgaacatgttcttaccaatgctattctgttaaattttgctaattctaaaagttttcgctcttcagaactatacaaaattttgataagatttcgaatcaaatatattcaacactacttaaatttgataatatcaaaatgtacctaaatttaatattatcaaatattggtttggttgaaagctcctataaagtaaacaagaccactatctctagattcttgttggcgctgacagtaagtacactaaagcattggtaggccgcgttgctcggtgagaccaatatgattatcacagtcacctcttgttcgggcaaaattccctccacatggagtctttgctttcagcccattgcaacccaaaagtctaacaaatatgagccattgatttatgccttgatcaatgatggaaattgtctcatctctttatgatggaaagaaaaaccctaccttccattgggggagagatagtagcggcgattggggtgaagaagaaactagcaaaacacaagagagggaaaggagaggggagaagatgtgcagtttgttcagcttgggagctcttaccctatcttcatcaagttagcgattagaggctcgaacgtggttggattggcactaaacttggtaagtttgtttctcactttgagcacttcaatctggtcgatttgtataaggatgggttgaatatagcaccggatttgagtggtggtttgtcagctcgagttactgcagttacagcttgcgcaacaattggtagaatgtcagtttgaggggtcaaacagtgtccggttggactgtttttttggatagcttggaagggactcgtataccatcatttctgccaagtttcgtgtaatttgcatctgtggtttgggagaactcacctgagaaccgaagatggcctcttgttagctttgatggttaatgttgatgatgccaagtgtgtaacttaatgttatagctgctgttataatatgcctctagatttttcagagaagactccatgtatatcctaattgattatagttgaagcttggagtggaccgttggttccgtggtttttttatcctcacaccgaggaggtttttccacataaatcattgtgtctttatgtgcatgtgtttattattgttccgctgctgatctgctagtcgaaaccatcctcaaagtttatggcaagataagggtttgattgtgtgaaatatgtttatcagttggtgaattgtaatttgcacattgaagagatgtggttgagctccaacacctcacacattaacacaacccattcgttgttatttgtagcctctcagttaagtaaaagcagatatcttaatttcacatcttgactttatgtttttatttttacgttatttgcaacctctcggttaattaaaagcaaaggccttaattcaacattttaaattagtttttaactttattgttttttctttattatttgactccaccacaatacgagaattcactattgccaaaaggttgggttttttttttcaagttcttgtggtaaccatagatgtgtcgtggttatattcatgccacccagcatgaataatgaactgttccaaaattactttaaatgcatgttgaataaagcatgctcgcaatgcacctgtgttgcaccaacctggccgtactcttttttttttttttagaaaaacatggctgtactcagccgaacaaacttgtgctgtctgagtatattttcgcttggttttcctttgaaaactctgaaataataaactgctaaaaaaatcgaattgcatgtgtatgtccatgctgaataatactcctacatggtagtgattccaatcaaatcaaagagatttaattaagagtcgtgtttaactagaggaggagacctcggccaggtcggtctcgaacgctttgacgaggttcccaaagtattgccgcgtcaccctggtgagcccggcgagcttctccctgtacgccctgtacttgtcgaagtcgacggcggccttgtcgtcggcgccggcggcgaagagctccctcctctccctctcggcgcagccgtgcagccgctccagcgacgcgttggcgtcctcctgcaggtactcgaacagctgccgcttggtgaagtcgcggtccgggtcgaggtagtagccgtaggcgtgcgcccagccgagcacccgccgcccctcgccgacctgctcgtacgcctccgtcacgaagcccatctccgtcgccggcacgcccgccgccgaggccatcgcctccagctccgaccgctccaggctctccatgtcgcggagcgccacgcgcagcgacttgaggttggcgtcccaccgctcgtagtggtagaggtacctgtccagggacgccttggcctgccgccgccgctcgtcgtcggcgttggcgccggccagcgccaccaccgtgccgttgggctggtaccgggagcacgccgcgtggccgtgccatggcttgaggcagatccagcagaactcgtggaggcacggcggccggcatgtcatgtgcatgcacccgaggttcttctcgatcggcagccggcacttggggcagtgctttgtgtgggcgagcagccacgtcgccgtctccgactccgagctgttcttctccacccacttcgccaccgtcttgcacgacaccggccggtgcgcctcctcgccgcaccgccagcacagcccgtgcccgcacgagcagaacacctcgctgctctcctcgccgtcgccgccgcccacgaactccacggcgcggctgcacccgggccccgggcaccacctcatcccggcgctctcctccacgtacgaccggagcgcgaaccagccgaaccgctccctgtcctcgccgtcggccaccgcgtcgaccagctcgcgcacgacggccgccgggcacgacggatccgggcaccggagcgacaggcaccgcgcgccgtcgcccaccgccgcgcggacgtacccgcgccagcaggagacgcagtagaagtgggagcaccccgccgacctcatcccgccggtgtcgaacacgtcgaagcagatggcgcaggtgagccgccgccggttgacccgcgcgggcacctcgccgccgccgccgtccgccggcaggaggccggcggcgtcgcgtatgcggcgctcgtccaggaaccactcctcctggagcaggacggccctccacctgtacagccggaggaggacggcggcggcgcccggcgagagcgagagcacctcgcacaccttggcaatgtcctcctcctgccgcgcgcgtacgtcgtcctcggttagaacaacgtacgtcttctccatcgccggcgcctccgtttcctcgaccacctgcccaccatagtcgtcgccatcgtcatccatgtaatcgccgtcgtcgccataatcctcgtcggagtcgccgaagtagtcgtcgtcgacgtcgctgtagccggactccatgctagtagctgtccgagatggcgacggcgaggacggattaattatcgatcagccagggtttaattaaccctaaccctcacaatttggcctcgcgcgcgagcctttatcggatcgagatcgcctcgtgataataaactgtttcgtttttaaagattgcttgctaaaataaatcggaatcgccttttttaaataaataaattcggaatcggcttcttagctaaattgtacttccggatattgcacgcgtgtttctgtgcggctgttatgggtggccgaagattggaaaggcctaggcccttagcccggcccattactgagaattcgattacggcccctttgttctcatgttattaggacgtcttttatacaagtacatacaaaacataacgagcctagacacctcccggtaaaaaaaaaagcaatattttaaattttctttataatctatgacgtgtgattttttttcatataataatttaagtgattatgaaagcaccttcaaaatccaaatcatcacatgctgtttttatgttttcaaattaactttttaatattattaataatcaacattttaaaagtttaatcaaatcgcatacaaaatgtcaaatactaataactgaagggagcattggtgatacacgcttataattggtagccaatgagcctttattccaatttaaatagagtaatacctagagaatttcgtgctataatctttataattttgaaaacattatttcacttgatcattttattggcagaagttagggtttatccaatcacttcttttttttaattccttctttttcatttatgggacttgttggctgtgtgcacatggccacttgggtataaggagcatattgatccatgtatttttgaaagaaataaaccatagtatttgttaagtgtaccttataaaatatgaattcctaattcgtaaaaaatgttggcccaaccaatggatcaaggtacaaattttcctgatgtaattgagtgatcatcaagtattctagtactacaaaagtgttgtcgttaatttgcacgtgatcctacgagctgtcgtcttgatgaagaggctgaagaggatcaacaggatcgtcggagctctcggccggacctgtagctacggcggctgcggcggcggcggcaacagcaggtcccacctccaacaggccgtcctggaacgtcttgacgaggttacggaagaagatcttgcagacgccggtgagcccggagagcttctgccggtaagccacgaccatgtcgaccatctcgccggccttatcctccatcttcttcttcgactcctcgccgtcgttgtccttgaggatagcgttcaacttgatggttcgttccacctcggcgaggagctcctccctctcgtgctcggcgcagtcgtgcagcttctccagctgccgctcggcctccccctgcgcgcactccaccatggtgcgccgctcctcgtcgccgtcgagccccgtgcccaggtggtagtacccgtacgcgtacgtccaccggagcagccgccggcactcggcgatctgctggtacgcctccgccaggaagcagagctccgtcaccggcatggccaccgcggcggacagcttctcggcgcaggcgtcgaggccggccatgtcgtccaccgcgctctgccgcgccttcccgtgcgccgcccaccgctcgtagaagtgcatgtacctgtccagcgacgccatgccctgctcccgccgccgcttgtcgtcgctggcctcgccgttggccttggccgcgtcgtagacgttgcagttgtagtactcgctgctccggtgatcgctccacgggctgaggcagagccagcagaactcgtgcaggcatggcggccggcacgtcatgtgcatgcacccccggttcttctcgatcggcagccggcacttggggcagtgcttcgtgttcgccagcacccagctcgccgtctcggacttcatggcgttcttctccgaccacgcgtacaccgtctcgcacgacaccggccggtgcgcctcctcgccgcaccggaagcagaacccgtgcccgtgcctgcactccacgtcgtcctgcttctcctcgccgccgccgccgccgacgaactcgatggccagggtgcacccgggccccgggcaccacttgatcctcgtgccctcctccacgtacgaccggagcaagaacgtcgcgtaccgggctctgtccgcgtcgccggccacctcgtcgacgagctcacgcaccacggcggcggagcacgctgggtccgggcaccggaacgacaggcgccgcgtggacgtacccgcgccagcagccgacgcagtagaagtgggagcacccggccgatctcatctcgccggcggggtgctcgtcgaagcagatggcgcagacgagcgggtgggcgttgcgcgacacgggggcgccgccgagcgccacgccggtggcggcgccggctcggtcgccgtcgcagaacagcctgtcctggagctcgacgaggctccacttgtagtgccggaggaggacggcggcgaaccccggcgggatcgcgaagagctcgccgacgttggccgtgtccgcgtcctgccgcgcgcggacttgctcctcggacagattccggtacctcctgtcgatcttggtgaggttgacggcggcggccgccttctttttcttggcctcgtcgtcgtcgtcgtcatctacctcctcttcctccagatcccaactctcgccgtcgtcgtcgacgttgctgtccacctcgtcggtgtaatcgtcgccatcgtcggtatagtagctttcgtagctctgagcgtcgtcctcgccgtcgctcgccatgcctgcgctgcgtgctagcaatctaggtcgacaactgattctcagggtcaaggttgaatttttgtatgcacaattttccgtctattttttccgctaaaaaaattccatctatttccgaccccgagttgggatcagtctcgaactcagatcctgaacggattcgcttcttaacaacaattttaagttctcaataactttagtcaattcaaactgagtacggtttatttttcgttcaacctctctttgaccgatttcgtaaccaagattgatccctgcttcaaaacacaacacagtgctgtaaaaaaagaaacaaaagctacaaatgacttgacatgcatcacaaaaaaaaaaacaaaaaatcagacagcacagcatacaccattaacgtcagaatgtatgattggttggttaatggaagaaacgtccacaaactttattagtacattataaatacctatcacaaaatttattatagattgttattatctgtctcttctgctcccgtgctaagaacaggacaatgctgattgagctttactttactagacataccaagaatgccaatctctaccgtcggaaaacacgatttgtgttccgaacaaagccgcaccggcagacatcaccggcgccggcgccgccaccgccgccgcggcggccattgtgagaccccttgcactgtcccaagcaagcactccacatcatggctctgccattactccttcccttgctgcttgcaccgaagaggatccctgcgacgtgcatcccctgcatctccagcttcaccctgccatccttcttctccagggatgcctccatgaccccgatcatggggtcaccaatggcggcgtacccttgctcgggatccctcacctgaatcaggaccacagagaccatggaatccttcgtcgcctggtgcctccggtcgccgtcgtcgtcgccggcagccgtggacgaggcagagtcagccgtcgaggccatgcgaatctttaggccttgttggaccagtccttccatcttgtccatttccatgaagaggagagcctccaagaagtcgtcgccggagctgagcctcgccgagcggcggatgactttgccgggattcttccggccggcgatgtccttgatcggcatcatctttgacagtaacttgcacaggttctctgcgctcgtctctgtcatcttgtcaagaacctagagatcacaatgccacagattgtcgaacgaaaacaatgtgcagtgcaatggatgatagacttcattggcatccatggatcttgacagcgatcgaggtggctcacctccgacgcggtggcggcgttctcggcgacgacgggctgcgacacctgcagcgccagccgctcccagggcatgcccaccacccgtttgatctcgtgcaggtagccaccgccttccagcctcaccatttcccgcacgccgccgtggccaccgacggtgacgcgcttgttggccgccgtggcgccgatgccgctgcaggcgctgctcacccgatctctggtggccatggcgccgccattggcgctcctgccgtgctcggcgagcctactgccgagcctcctgatctcctcctccaggaactgcaccctccgccggtactgctccgcggatgctctagtggtcgccgccgtcgcgccatcgacgacgttggcgcgcgcaggcggcggccgcggcgcgcggcggtggaaggagaggcaggacgcgagggcggagcagccggtggtcgccacgggcggcgccggctgcttgttgtggccgccgggcatgccaatcttgccgatcgatcggtgtggcggcggtgcggtctccgacccgctcgctcgccggcgccgtgcaatttgacgcgtttgtttatcttgtataggcgccgcgccgcggctagctagtgaggttagttgcgatctatgcgtggggaggccggatcggatcatcggaggcgcgattttggagtttgaattcgaaccccaaactccaaaggtgtttgtcttggccaacttcatcttggagcagcaaatattgcgttgcgacgtgacgacgcggtgcattggatcgtgtgttgtacagccgcggtattcattgcatatcagttatcaccagtacaaatccattggatgtatccagtatccgtgcctgtaagggcctgtttagttaggctgtgtttagttcacaccaaaattaaaagtttagttaaaaataaaatgatgtgacggaaaagttggaattttgtggataggaaagttttgatgtgatggaaaagttaaaagtttaaagaaaaatttgcaactaaatacagccttggtgaaatgaaaatttttgggtgtcacatcggacgtttgaccggatgttggaaggggcttccattgtaggagtaattacttggggcttacgtgtatactaccgtgcagtaccgcactgctgctgatgccttgttgatacaactgtgggaacagtttcaaaagtacgaagagaacaaaaatctctaatattttgtatgtcgaagtttagaggttgcgatcttgtagattttcggtctcatcatttggtttttttccctaacaagtcaaaacggtttattagggaaaaaaataaatttataggtaaaattatatatatatatatatatatatatatatatatatatatatatatatatatatatatatatatatatatatatattgttggtgacttaaaagttaatgctaaaaaagaaattacgttgaaaaaaaatctcaaaatcaatgtcaaaattaagtttgaaaatttaaaatttagctttctatttggctgattaggccatccaataggagcctttcaataatcgttttagtctcatatgttgattttattattttagttcttattgttgtatgagtatttgctctctttgagataattttataataaatggttgtaccttctttgaagcaaaggtccgaacttttatttcattatcttatcttaggccctgtttagttcctaaaacaaaaattttcacgttgtcggcttgtcgcatcgaatgtttaaacacatgcattaaatattaaatgtatgaaaaaactaattacatagattgcgtgttaattgcgagacgaatcttttaagcttaattgtgccatgatttgacaatgtggtgttataataaatatttgctaatgacaaaataattaaacttaataaattcgtctcgcagtttcctagaggaatctgtaatttgttttattattagactacgtttaatactttaaatgtgtgtccgtatattcgatgtgacaactaaaccaaaaattttccacaacaaaaaaaaaggccttaaaataagacaaaaagtacaaatacatttactactagtagtacatagtacacacgatgataggagatgtgaccgtatgagtggggccgtgtttagttcccctccaccagcttcaaactttcaactttccatcacatcaaaaactttcctacgtatataaacttgcaacttttttttcaaacttctaattttcttcaaacttcactctttttccaccaactaaatacagcctgaggtgagcttcctaaaatagggaaaaaagaagataaaaagaaaaggtgtaggacacatgggctttagtgttgcaggactttggtccttgtgggccttgtaatgctgagctcaggctcatccgacacgtgtgcctcgcgggccttgcaatgctgagctctggcccatcacggcgaagacacatgcgccggggagcggcggtggaggggaggattgcccgccgcgccgcccgccgcggccgtcttcctcctccctccatctctccctcggaccctcccaatggcggctcctcggcgcggagtgcagcgagcaggcgcagcagcttttgtgtgtgggcgaccgccgtggggctgcacaaggccgtctcccgcatccctcgagggctccgacgccatcgatgatcgcccgcaccaccaaccccaactccggcgaccggccaccgggccaccaagtggtactgccatactctcctctcctctcccctcccgattgctggtcatcgatgatgagcaccaagctctccgcctttgtgtgtacctgtaccctcgatttttttttttgttggaaggactactctggaaatcccattgttgactgttgaggatactggctcttagcatatgcttctccaagaattgttcatgtttgatgcaaacatatcttgtgtttctgttcatgtaattactggtaacttgatgccttgctaaaaaaagagaactaattaacctgagatagttttaagtaaacgtatggatatgtttctgctcccaacatctatgtccttataggaagctttattgttttctggaacaacactgctttagaatcatttagatgccaatatgccataatcaacagagatgttttggttttgaccacctaattcgcatgaaagatgaaatatcttagggcggggaatctgggaacaatgatgcttttcagggataaatgttcaaatattgatgaaaggcttggttttccattccacgaggtgttgttttcttgtgtcctactattggacacacgtgtcactacttcttgttatgttctgaagccttttcaacaatctgaattccttgaatttgagaataggaacatccaagacaagtgcctgacttcctatcttactttcaaacatgttggcttcgtactttggcagatctgctcttactccagaagcagcatgaatccatttttttcaaataaaaatgtatctgttcttccaatgcccatagcaattggtagcctagtaatggatgaacaccattccagatgaagggcttacaatgtccatgatactatttcattaacaatagttttgtagagcatgccgtctcgtttttatttatctcctgtaatttaacctataacttaattgccgtcatatataatatcatttgccatattattttacatgcatttggcatgaattcatccacgccatgtataatatgttccgttttgaacaatccccttcaccgtgtcatgctgtagtgtttatgtgcatttggtatgaattcttccacaccatgtattaacattcagttttgaacaatccccttcactgtgtcatactgtagagtttggcatagagcattagaggctcaatcatggtggaaatgcagcaggcgtggtgggggagcttggaagatgcaatgggggtatggtgggctagtggctggaacagaacggtacatacacatctcaacttcatcagcactttttgctaaataaaatatgtcgtgaggttatcagcttttcttaaacttgttttcccttgatccggggcctttttgcacggtaggaatagagccaggttctgctaactggcagtacctaatctaaatgcaaaggcaggcaaattctttgcgtattcccgggaaaagaacttgtattgccgcagcacagacaagaattaaagcaagaaatggtattcttctagctagaggccggaatacataaattcatcagggaaagaaacacgtacaagaattgctagcaatagtacattagcactcaagatactaattatcactagacataacagctaatttagagaagagagtataattaagagccaactaatttagtactaggaggtaattatgaacgagggctatgaggaagcaggaagctgaggtcctcgccttcgtcggcggtggttgcgacggtagcggtaggctctccttgtactatctcttggctaggggaataaggccccgactttggctctggctcccgctccggctccggctccggctccggcatctggagcttgtcggccaaggtcttggcgcccttgagcgagagaatgagccagacgaaggagaggaactcgccaccttctccgaggctcttggcatgtaggtatcccctacacatgctggcggagtagaagagcatgcccacccacacacggtacatcacttggcaccgtgttctgcggcccatcttatccatcaactcctctgcgagcctgcatgcgtcatggacgagagggtacttggggggagggggctcatccaccctgatttccctctcttgttctcttaccatttctatgtcgatcgcagcattgacctcagcattgacctcagcttttgccttgtcgatgatcttctttgccaggatgtctcgtccgagcttcttgaggctatgcggctgctgctgctgagactcaatatccttcaagatgagctcaacctcctccattgcctgcgtgaagaggtgctgcctgctgccggtcatgagcatgtcagggcggaggttgagaaggtgggccatgtagtccgatatcgcctccgtgcactcgagaaatttcctgtcaatctcgtcgatggtgttttcagccatcatgcggcgcatgcaaaggtcagtggcgatgtgccagaggatgacacccctatcaaaggacccacgcaggctgccctgtacctctaggccgcataccttgcgcaggttctcattgagcacccagttgcggcgccccggcgcgaagcttcggtagctggtgaagtcgagacccttggcattcgcctccactaggtcggagaagatcaacccggccagcatgtggtacaggttcttgcgttggcaaacgaagaatccctgtgtgtagccgacatgtgcggcacacttgagcaagaccccagcaggctgtgtcctttggagagctgaccggatgaggttattgtattgggggactgtctcgcatagcgctgcgacatccgccatggacatgagcttgaacagcagctgccggatgggctccgcaaggatgtccagcgcggcggtgaggcagaggagcacgtaggtgatcttcacgtcgatggtgttgtggtggcgcttgctgctggcggcgaagagcacgatggcggtgatgtgaaggaacggcgccaacagtatgtggtaggccaggtatgcaggggtcaacaccacgttggctctggtgtagatgagcgcaaacgctctgcgaagccaacgcttggagcccttctctgctctagggcttagggtccccagcaagtctccctccacctcctccttgctgtcatcttctcccatcaaggattggcattgacggcgacgacgttgttcctgcttgaggtcagagtcggcagctagcagcgacatgtcggagagtatcagtaggaccttgtctctatctgtcaagatgtgctgctgactcctcttgacaacgtcagtgcctacccctggaggaggggtctccttctcttttttcagctggcagcagcggtcgagtatgtctctcttgtccttttccagctcggtgaagcagtatctccacttgctgacctccttcctgccttgtaccatggacgacacagctgccagccggttgatgctggctcgtcggagagcccacggcttctcggtgaagctgaacaccccaatgacgaagagcaggacggctgacaccagcagcttcctgtcaccgccattggcgggccatgacttgtagaaggcgtatatggcgaccgtgacctgggacaccagagtcacagtgtgccgcctccacagctcgttgtcctcgatggtgtaggcagacatctcctgctgcccgccaaggtggatgaggaggaccggagcccataggacctccagggcgctgccattgacacaatgctgtttcgcggcggtggtcgtgttggcgtggcggttgaagagggtggcaagcgcgtagatggccagggcgtcgctgctgatgtaggccagccagatgaaggtcctgaaccagtgagggatggtgtacttgcgcatgggggcagccagcagaaggaaccactggatgcccaggctgcacagcaccaggatgcgcagctgccactcgtcccaccactgcacagcggctgacacattcgtcattctatcatgcatctaatatctgtttgttactattttttttgtttgtgcatcgtaggttcccgacaatggacggttagtttagcacacctatatatcagaatgacacttgttgaacacagtttttctgtagcccagctgaagacttgctttgctagtgaagctcactttaattattactgctacacatgtgcgtgtgggagagagctaaagtgagggataagcattacatgataaaagccgaaaaagagaatgaacatagagaaaaatataaatgtacattacaacttttatcgaaaataaaggaaaaatataagatgtacattacaactttagactttatttatttacagtcatgcgctgcccttcgcgcacagctttgtatgatctctgcaatattcctaaatcttcatatgttagctagtgtggagctattgatgatgtctaactctttgctttgtttacgaggtggtccttactatctttgcatttgcatatttgcgtgcatgttagcgaaataaaccatttgttcttcagccacccaaacatcatctgtcttatcaaaccttcaaaataagagggacttttgttcatcttgcaccgaaaccttttcccttgcttgttttcctcttccttcttgtcggtctgttttcctttttcttttctccttctttctcatttcctttttcttttcttgggccacacctcgttgaggataagattttcttgggaacagttctgttgagtgagagcagtgcaaacacaactttggttcatgttctgctagaaggctagtacagtgtaaacacaatcttggttcatgttcataattggagatattactgctgaaggaggtgcccgcaaggaattgcagtcctgcagataagagatgccatttgctagttgcctccttggtaaaagtcttcacttgagtttatttatttgctttcctcttttccttggctggatttcccacaagtctcgttttcttatcagcaaaaccttttgttgacaaaaggtggtgtgattgtttaagtggggtccgaatctttttcttcttaaataaaggagtggaaatggaatagtgaaaggaatagtgtctctgttaagctttccttcatttatgttcctttcttactcgatgctgttgcctaatatatattcccttatttttatattaaaatgtgcatccaggccacacggttcaaattcttttttttagaacttcaattctaaattggtagtattaattggtgtccactagtaattttaagacacacgcgctcagtgggtccatatatatgctccgggaattttaattagccgtgtgtgaagaacatgcatgtgcatatgatgtctgaatgttgttgtgaaccttgtgtaaggtgtgaggattagtcctcttgactttgtttgtttgggctgtgtacatttaagttggatgtagaggttaggtttttaatccattttctaaaaaaatgtgcatatgatgcatgcgagtgtattttctgtaatatatttgtatattattgaatttggaaaaatgagatgacttgaacttcataacaatatatagatgagtgcgttgaaaatagacgcgcatgtaggtttcattagattctcacgtttgtaggcggatgaaaggtccactattcttctgttacttttgggtatgcggtggctaatcaccgagctactccctccgttctttttttactacttgccatataaaatactggcacagtgcatatatttaataattgaatttcctaatattatcttcgtaaaaattactgtattaaagatataactagataaacatatttttcattataactctgtcaatatcatttatcatattttaaatcttaatatgcatatattagtgggttaatgtatagaagtttgactacacattttctatttatgaaacgatgtagtgatgaatgcttttgtgataatgcaacgttcatgaaatatgtcagaaagaataaaatagcataagaaagtaaatagcaacaagactgaacgtgcatgagcatttgcctttttctttcagcatgtgaacttcaatttagtcaggattatcatggcaaaagaaatatcacttcaccctgccaagaaatagataaattatttgttcgccgcaaaattaatatgcgaaacagctaacggtcctagcgcataagttcggagcatatattcttcttctttccttatggcactcattagcaaggtagccaagaaagctctatataaaccatgtgcatcaccttacactgcctttaacctcctttctttccctaggacctacccctcccctaccctcttgagctttctcaaataaaaaaaaaggaacacctgaatttttttggtgattcaaagagaaaaagacaaagatttgatgggtaacatgcttttatcccctgttaatttcttgtgaccattatttttttctgccttggtttttggatttcatacagaaagtgtgttggtctgtgctaatcttttcctccctctgcgacagcatcttcgagctctaccatgatggcaaggcccggcgctgtgaagaatattgaaagctgggacgagtttacaaagcattttgtgaaatcagaggacaagctggtaaacatatatacatatataatccaatccaattcagatttacatgtgatgtgatcgatcgacgcattcatgcatgcatgaaattaatatattgaaatatgaatgatcaatcaggtggtgctggtattcatggcgccgtggtcggagccgtggaagctgatgaggccggcggtggagaagatggcgtcggggctgaagagcgaggaggccgaggtgtgcacgatcagcgtcgaccggttcaacacgctggggcggctgctgcgggtggaggcgctgccgacgttcgtgctggtgaagaggcaccgggcggtggctcgcgtcgtcggcgtcaaccgggacgatcttcacagcagcatcaacaagcacctcgcaccaccctcttcttctccacaacccattaatatttcttagtgctgttgatgattcttggttgattgcatgatataatcgagtaatgccatgcgtcttaattatgagttgtaattgtttatcacatactgtatttgagacatattcaaccttgtttcgagaaaaaaaaatggagatgaaaaaaaaatctattcatacttatagattttctttgaagaatttgtcttgatagggttgacacgcagttagcacgagagaacttccgtagcttgccttctgtacctgtatggctgtatcgatatgtatgcgtgtcttctacgcagctaagatatgaaatatatcatatgaggctgtggagaaattgactaatttatactcctacgagaaaaataattaatgctttcagaattccatttttcagtcttatgttaatgctatgcttgccaatttaagcactttgccatttttattcaagaaaaaatagtggatgctatgccatgtgtacccataaaaattaattaaaatgagaggaattaatgtaaaacaaaatattatatacacataggatagtatattcatctgattcctaatcctaattctcttcgattgattgcctccatctattcctaggagcctattatatggttctattctagggatctccaccactcagctccaaagagattgaaccatagatccgtggaatagaaaatttcagtataacactgttacattctagtgtttttaagtgagaaattaggaatttaggggggtcaccccccaacataatatagcttcgccaatggaggcaataaaaccatagatccatggaattagctagggaataggccaaggtaatacaagagaattagggcttgtttagttcccaagaagttttttccaaaaacaccacatcgaatctttgggcacatgcatggagcagtaaatattaattttttaaaaaactaattgcacagttagggaggggaatcgcgagacgaatcttttaagactaattagtccatgattagccataagtgctacagtaacccacatgtgctaatgacgaattaattagtctcaaaagattcgtctcgcggtttccaggtgagttatgaaattagtttttttattcgtgtctgaaaactctttccaacatccgatcaaacatccgatgtgatacctaaaattttccttttcgcgaactaaacagacccttagaagaattagattcaggaagtagaataacatgagaggaagtacaggggaaagacaaatattccctccgtttcatcatattataagttgtttttgacttattttcctagtataaaaaatatttggttatagaaaaatgtagcacaaaattagttttatcacatgtaacattgaatatattttaataatatatttattttatgtataaaatattgatatatttttctagatgtttggtcgaattttaaaaaattaaaaaaaatcataacgactcgtaatatgaaacatagtattatgaatataaaataaaacagagagtactataaatgaaagtttgttcaacacattatcacaagaacaacagatacaaccgacatgaagggggattggattctctgacttacatatcaatgtcttaaagttagataaaagtaaatcgaaaattaaaaaccgattcccacaagagctagtatatgcaaacacgcaaacaaatgctcaacacttgcagcatgaccggtccccagcagcgcagtaaaacaaggaatgattacaacacatgttaatgacctacgtcaaaagacagcacgtataaggagactcatctgaagtagggttattgtttgattttacttatttaaccagagttcaaacaatcaattaagtgttgagatggttaatctatcccgagcctcatcggttgacctaataagtcaaaacaaaagccaaaatttaaattttctaacttgattttgaagttacattttaagatgttttaaacataatttctttatagcattgggttttaaatcactatgaacaaatatataaaaaatctacctacaaaataaattttattacctaataaactgttttaacttattagaaaacatagtcaacggatgaggctgcccgttttctaaacagaggcagtacatagttgtacaagagacgtatcccgtgtttagactttctctatactatattcattctagtatatatcagtacaaattaggcatacataattaatttgatattgtactgtacatcgacgaaattcaagcaaaaaaacaattgatcttgcaatcaatcgatcagttagctcttctagctaaaaaaaaaaaaatcaaccgtgcggaatcggcgcgccgccgccgccacggcggttcgtgtccggcggcggatcgacgtacccataatccgtctcctgatcaacagcgacgccgacgacgccgcgcactggccgcttcgtctccgtctccggcaccgcggcgtcagcctgcagattcactccaccaccacttgtcgtcgtcgtcgtcgttggcgacagcactactattgatgcaccgagctccaccggcggcggtggcggc

SEQ ID NO: 61951 - DNA, 13171 bp, Oryza sativa
  unsure (1)..(13171): unsure at all n locations
cgatgggctttgtttgactaagaacctncagnctgcangcccgcaggncgactctagaggatccccttttgggtcgtactcttcatgtcttgggctctcgtgtagaatgtgtacccattgatctcatatccctggaatgtcgcgatcgagatgttgtcatagccacacggggaaagtatcaatgtgatgccgtgtaatccatgcatcagacttaccgattattctggtgcgaactagagccaaattctcctcgatgtaaggagctaccaatgaagattgttgcagaaccgcgaaatgggctttacggaataaattgttgtctaccgtcattattgctttccttccgagagttccctttccccgtagtctccctttatggcgtgattcaggtaccctgattaggcgaaggtcttcaataaattctacgcaaaattcgatgacctcctctgttccataccctttggcgatgcttgcctctagacgagaacggttacgaacatactttttcataacgcccatgtacctctcgaaaggaaacatgttgtgtaggtatacaggcccgagaatactgatctctttgacaaggtgacaaagcagatgcgtcattatattgaaaaatgaaggtggaaatatcaactcaaaactgacaagacattgcagcacatcattctgaagggcttctaatctatccggatcgatgaccttctgcgaaattgcgttcatgaatgcacatagctttgttattgttgcccggacattgtctggaaggataccccttattacaattggtagcagttgtgtcatcaacacgtgacagtcatgagactttaggtttgtgaacttcttctccttcgtgcttattattcgcttgatattcgtggagtatctagacagtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccatatacacctaggaaaccaagaaggtttacgcaaaggtcttagtgaggtgcatcacgtcaattgtgtggcggacatccaagaattcccaataggataactcccaaaatatagagttctttttccacatcgccgcgtgaccatcttcgctctctataggctggcttccaggccccttttcgaacattactttaagatctttaaccatatcaaacactgttttcctgctgcgatgtttaggcttcgtacggtggtctgccttatgttcaaagtgcttgcctttcttccgtaccgggtggtttgcagcaaggaatcgacgatgacacatgtacacaaccttcctacagtgcttaagatacgtactttctgtttcatccatacagtgaatgcaagccttgtaccccttgttggactgaccggaaaggttgctaagtgcaggccaatcgttgatggttacgaacaacagcgctagtaggttaaactcctcttgtttgtcctcgtcccacatggggacacctttctttttccacaatagtttaagatcttcgaccagtggtcttaggtacacatcgatgtcgttaccaggttgcttgaagccttgaataataatcggcatcattatgtacttcctcttcatgcatagccaggggggaggttgtagatacacatcgtaacgggccaagtgctatggccgctgctcatctctccaaaacgattcatgccatccgtacttaatccaaaccgtatgtttcgtgcgtcctttccaaagtctttaaattttctgtcgatgtttcgccactgcgaatcatcggcggggtgtctcagcatcccgtcctgttgacgctcttcagcatgccatcgtatcattctagcattccccttgttcctgaacaaacgccttagccgtggtattatagggaaataccacatcaccttagcaggaattctcttctttctcctggatcgtctcgtctaatcttgtatcgtagtgctttgcaaacagggcatgcttctaggttctcgtactcctcaccgcgatataggatacaatcattcggacatgtgtgaatcttctgaacttccagtcctagagggcagactattttcttagcctcgtatgttgtctcgggcaatttgtttccctccggaagaatgttcttgacgagtttcaataaatcgccaaatgccttgtcactaacaccatttttttccttccattgcaagaactccagagtggtatccaactttttgtgccctgctcgcaacctgggtacaacgacgttctgtggtcctctaacatcttgtccaatttatgggctcccttttcactttcgcagtcctccttggcgtcctacaacatctgaacaagatcatccgcaacgtcgttaccatcagtatccctttcctcctcaccggtttgatttccttcaaatccaatgtactgagcaaagtccagaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttatgcctgttagcttcggccactctcaaaaaataatgcacgccgtcaataaactcttttgaccgccggtcagcatacatccattgccgatccatctacatgacatgaaaaaaaatcgtacacaaataattattcttacaataatgacggtcatacaataattataaaataattacaaactctttcaacagtcatacaatagatgacatatcattatgcatacaaaaattataaaatattacaccaaataattcttatttactatttctaaagtttcaaactaatattaatgtgttgtacttcttttaattttcattttagtttgttttctattatttaagattaactttcactatattttccttctcaactattttataaaaccttctttagcaaataatctaaatttctatatattctttcttccccccacacaaattttctctctcatcaacttacaactaaattttggagacataaaagtgtgcaaaacatagctccaaatgtaatatgacaaaaaaaacattggaggatgaagttgctaaccttttaggcacctctgatttatatataatcaccaaaataaattcacaagaaattttggcatgacctcccctcttttttgaagaaattttgaagcttgctcgggcagctggaggaggaagaagacatatatatataggggtgggactttagtcccgggtggtgttatgaatcgaggctaaagattgccgagatctttagtcccggttggtaaccaaccgggactaaagttacgatctttagatcccgggggggggggagggggctgacaaaccctgatagcatttgaaccgcatcttaccaaccgggactaaagaccaaatatgcccgttaccctttttaaccgggactaaagatcatctttagctccggtttttattgcaaccgggactattatggaattcggccgaccgacaaaaaatggtttctccaccagtgtgatctatgccttaatgtggatcttgggtatggcagtcgaagcatctgctcaattcatcaagctggctcccttttttttttgtctgacgataggtactggttctaaaaccggcatctatcacatggctcattaattagtgccgcttgtgtgacgccggttacagaaaccggcacctatgcaggcttacaaactggaagtaatctatgtttctgtagtagctagttctattttcagcccaataaacgtgaactaaagggctctcacagcttccgcccacctaaattggaaacactgatatgtgtttgtgcattgcttacacttctgctcataaaatacactctttttactgattttttaatctggtagcatgaaaacttaccagcatgatcatacatgttcaagcataagaaatcgagaattcagagaacctttcagctcttacaaaattatttaaataagaaaaattagattgtacataactctataaggatataattctggaaatttgctcagaaaccaaaacgtacttataaatatcaaggattaaatttccgcacaaagtgaaatattcaacagatcacactaaacgatatccctacatacactctacacaattatacaacagaaacaattactttttgaaaaaaaaaatccttgtgtcacattatatataagttcatcaatttttttgatgttatacaattaattttctcctttttctatttaatttatcacaaacaaaaacatgatattatcggtgtatttagttttcttaatgagcttacaaaactatactagcaaggtagcatttacatgcaaaatattgtgaaattttgcataataatttgtctgcactttcgttaaaccccatcaaggtagactgatatcgtcgagtatatcgaaatattgtcccaatatccaaattggaatggccttccagccatactggaattgacaagcttaattaatctgtagagttaattaaatccagaagatacaccccatgttgctgtagtaacctatatgaaagaaaacaaaaaaaattgagcaaatgcctataattaagccgtaggctataatcggtttgccacacatactgattataagccgtacatgttattataatctgtaggtgaaacttttatttatatgtctttattgatttaaaagctaatactaaaagcaagctctataaaaaaaattaaaaccaacttcaaaatttaatttgaaaattcaaaatttgcagacacttataagctatgtaaggcaaaatattgtaggaaaaaagagcgggattgtgggaaccatacatatgaaatctactggcttggctttttcttgataatatgctctcacgcatgatgtcgtcatttatacacttgtgcttgtttaccagagaactacaaatagtgggtgacaattaagtatacgataaccaactaaagatagcataataggctttgatgatctattgcataaattgtccccatctttcttatatggataacaaaatagaccgttattctcgcctttaatgggcattgacaccattgttgaatttggctgtgggaaaacccactagttttccgttctttttcggacatgtaatgcaatacgcattacgtacccattagtcatatttatttgacgttggtagctagtattaaatttacaaatataagcacatgcgatacagttacacggcatgggcagtcgatgcaaactagctgagtgaatatgtacgtgcacttcaacaattcaactggaagtggctaagagaggatggaaaaagtctgaaatattctctcgaacatttctttttatagaaataactgtttcacagaatatgggtactgcattgcgtggctcatgactcatcagagatatggaccaaaatgacatagacaaattggtcctctcgaatggggcccataacatcaaacacggaggtgcagctagcgggcccacattgatgcgggacagtgccgaccaggtggcgtctctctcgagtcttgacctagctatttcatcgcaaacgtcaccaccgactgaaaccagatcaaacctacgcgcccctatagttgtttttttattgacagccagtatacataattgaatgttttaaattaaaaagagcctatatcttgttctaactcactattatacctgttcatcttgctaggttcaagcccttgaagagtttctttcttcagaatcggcagcctttattttattccatcgaccatcgagggccttcctgatttctcgaggataagatagcatggtacttacatataaccgatcattgtccaacccccaaaatgtgatgactgatgacttgatatttgttaataatttggtgtttagcagacaatctgattactttctaatcacaagtctataattggtcccacagttggtctatgagtccgtacatccatggcgcatatgcattcctttggaatttatattttataatttgtagtattacagttgatttacattttctcgaaggcatacaataattcagatatacgtttgtatgttttcattcacgttagaccatgtcgtattactacctccgtcctaaaatatagctatttctagcacagtgtcttgtcctaaaatgaagctatttctccacctacctcctcctctcaaccaatcacaaccattattctttgtctattttctcttttcaaccaatcacatactttctctaatcattctcacatactttcttaatacccgtataacctaaaaaataactatattttgagatggaggaagtatctatttaagatctgttgcaatgcacggacacctgagtagaagaaacacaagctttaaaactaatgtatgttggacttagatagcttntcaacagactctagcagntacatctgccatatctaaatgcaaagggatatgtgtcattaacaggtcagaagcatgcatggttaatattcctgaaatcatcaaatctttaatttttctaaacgccaaactgcgcacccctgaaagctctattgttcagctggagttgcttattgcgattcatagtccactcatcatcatagggaatgttacgtaggacctcaaacatcattgacttgatgtgttcaacacatagtacatggaaaaattaacatgcgatgtgtcgcctctatactcgatctaaatctgaccaccttcaacacattcatgaacgaagtgatactttctgttgatgtgtttgctccggccatgaaatatcggattcctctttcttcctcactccgaacatgatcttgggtatcggttcatctttgccggttcatggttcctttatgaaccgatagtgacgaagctccatcaccgccgattcacaattgttatgcagtgagagtagctcgatctatctatatatagagccaaattattaattatgcaaacgaactaaagatagctgaatagagtacaatactccctctatactcgtaaaggaagtcgttttggacagcgacacggtctccaaaacacaactttaacttcttgtttctataaaaaaatttattgaaaaatgatatatgtatacttttatgaaagtatttttcaagacaaatctattcatataatttttacattttcaaactcaacaacttgagagttatttatgatttatatttctaaggtttgacttaaacattgtccaaaacgacttcctttacgagtacggagggagtatatcgcatgagagttaactgtatcactaccgtggatatgcaaataaccacaggctagaccgtcgttcttgcgtttaatgggcattgacaccattattgtctaagagtttggggcataggaaaacccgctaattccactctttccgagacatgccatgcaataatcaccatgtgctccaagctaagtacgcgcaggagctcggcttatatatacatcagcaaattcatgcagtatgcattatgcagtgacaaccaatcagcttggctgcatcacttcaaaatattggttcggacatctaataaagttgtaaacaagataaatttgttcggaaaaaaaatgtaagctgccactaatgatatatttgttcgggctagtactagtatttcatatatgggccagaaagtcagacggacaggtgcgggcccagttgtcagacagaagtgcaggcccagttgatccgcggtgtgttggactccagtaggagcagccgacctagggctacgcggctgtagctatctatctcatcgggggatgcgtgcaacgccgccaccgacagacacaccgcgtgttctggacgctgcccttggagaggagatggagcccgcaaatccgccgattccgccgccgccgccgccgccaccgcctaccaggaagcctaccaggaagaggggaaggggggcgacgaagggcgacgacccggtcccggatgaagcagcaccaccatgcaagccgtcgctgcctctggccacggggagcagaagggggcgcagccatgtacctccgccactcggagttggaggagacggcggcgaggagggcgtcgacttcgtcagccacctccctgacgccgttcttggcatcatcatctcgctcctcccgagcaaggacggcggtaagaccagaaccctctccaaacggtggcgccctgtctagcgcaccacgccgctcaacctcgaagccagcgatctcgcccccggcgccaacggggcggcgctagccgtcctcctcacccatatactcctcgctcatgcggggcccgtacgccgcttttgcatccccgcgcagcagatccacgagcgccccgccatggtcgaaggctggctgacatcgccaaggttcaacaacctcgaggagctcgagttcacggaagacctctgctatatgagacaactccttccgctgccgccatccattttccgcttctccaacaccctccgcgtcgctgccttcagccaatgccgcgtccctgattgcaccgacctgatgctccagttcccccatctcaagctgctctcattacggcaggtgaaaatctccgaaacctccctccatagcatcatcgccggctgccctgcccttgaaaggtttgctgctcagaaatagctacggattccgatgcctccggatcaactcccctaccattagaggcgtcgccttccattctccctactgtgggagtcacggcgatggagaggtgggttatcacttagaaaatgttatcatcgaatttgctccatgtcttgaaaagttgctccatattgaacgctcgatgggacttggagttcgtgtatccgtgattatggcacccaaactggagacattgggcatcctagacaacgttaacgatgtctattcccgactcaatttcggcacagtggttttcaaggtataatatatgtatatgtagttgtggcttccattatccctataaccccctagcaatttattgggattaattacaagctgcattttacattaatttctatgtgcgtatattgttaataatatgtggtgttagagtatagctatgtacgtccagtccattgtcttagagttctctctagatgatattaggctgatttagacaacatcattgagcatataatcattcgttcttcatgtcactgttctaaagactatggcatactaactagattatcgcttaagtttacaggatagcaagctcttgcacactatgattttgtttggttgtgtgcatcctcagtagatgtagcggctggatataatttttttacttgattagatatccattatctactcccgccatcccaaaatacgtttagacatcacctatagtactacaaatctgcagaaaccctacctagatttgaagttttaagttggtgtctaatcgtagtagtaggtagctatatttttagactgggggagtagaaaatatgatcgacatgtcctaatgttatgttccgtacttaataaagggattcgaggttgttaacttcacaaggccagtgtcgagtgtaaaggttttagctctcatcatggataatctcagcttggacagggttatcaagttaatgatatgctttccatgcttggagaaactgtacatcagggtaaaatacttttcttttcaagtactgtgttgccatacttcttttgttagtttacataatcagaaggtatttaatctattattccccaatttttttttcaggggatcaaatatggggaaactaattactggcgccgcaaatatgggaaaactatcaaaagccttaacatatgtctcaagactattgtgctggatgattatcgtggctcgaagccgcaagttcagttcgccagattcttcatatggaatgcggctaagcttgagaatatgatatttatgagtggacctaacaacgacaacacatatgttattgcagaacagcctaagctgctggagtttgagaaaagggcttcaaaaactgctcactttcattttagatccaagaaatgttattatgattgggtgcatatcaaggatgtccatgatttgtctctttcagatccttttgaatgtacctgttgagactgatgggtgaaattcttgtaccttttcaatattcgagctaggcaagaggactttgcggaggtgctctgttcgaatttaagactgatggatgttgtcactgagctgaagaactatattgatcatgttgaagatttatcttaattactgtacctttggatgtttatgaagaaaaggattgatgtattgggctgttgtttctcagataccattgcatgtgtgttgttccattttttgctgtaacagtactggttaataaaattgttgtagcagtcatattttttgattttttttctatcctcaatatttttttacacactagaaaagtgcctgtgcttttcaacgggtaaactaaatcatggcacattttatgtgcagtattcgagcgttatgagttgtgaaattgacacatatcactggtggagaaaccctttgtagtcccggttcgtaacccccctttagtcccggtttccaaaccgggagtaccaatccgggactaaagatcgctatctttagtcccgggtgaaataaccgggagtaaagatcgctatcttagccacgtggccggctgagccatcttaccaaccgggactaaagatcgagctgacctttttttttttttgcatgcccctgttgctgcatggtttatatatatatatatatatatatatatataaaccatgcatatatatgtttcaatacatatatatgcatacatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattataatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccaccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtatacttatatacaaggacctaattaattaaaggagacgtatagtaagaaatctaactgaacgatatacttacaaaatccagtaactcataatagagacgtcgagggcgtccagctggtatagttcgtagattcccctgaaattgatccagagaatgtcatctccttgcaagaagtcagtgtccttgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccagtgtcagtaataaattgttctatcgtcatttctttaccggtcaccaacggctcgatctcctggtttggttgctctccaagctgagggactggtttggactttccagaagatgctttcttcagcgttcgctcatagtctgatagcttgatggcctccttgacagatgcagacatacccctgaagaagttcctgacactagggtctataggaatcttcttttctggacttcgaggcttgaattgtctcttgacttttgatgcaacgtaagcgtcaagctcctcttgcgtgcaatcgtaccccgggtccttgttcttggcggcgtcaactttcgcctttttcgttgcccttgtgtgggcagacggtgtagttggagggcccttgactttgaaggtgccgaaagaggagcttgcgggggagtaggtgtaggagcacgaggaggagtcggtccaggatcctgaggaggagtagatgctggagcctgaggtgaagacggtgctggggaagcatgaggagaacccggtgcaggatcctaacagtanatgncgnagcgntgnagagtgttatcaagtnntcaataggtntcactgtgcgcca

SEQ ID NO: 61952 - DNA, 2678 bp, Oryza sativa
aggagatggtgcatgagacgccgcttgttgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggataatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaactttgattgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccaaatttgggacaaagctctcatgatctccgcgtgcccttgttctgcgccagtacaccgtactgataggcacgttatcccgcacaacccaaccgctgtgtcgtacgtagttcttggctgcttccgccggggcactaggttgtctgacttcgtccacttccgttatgatgtgccgaccctctagcttctttgcggcacctcattgcccgcgtgccctcttctgtccagcggagggttgacttccactagcctcctcctcctggttcccctccacatccctctccacgttcccctcctggttcccctccgcatccttcttcacgttcccttcctcgttcaagtactggtttggatcctcattcccctcttcttcgttccagtactggctgcttccctccgcgattgtatcgtacaatatctgttcctcatcgcgatcagccatctgttcatacaagaaatagttgctaagtctataggtcatttttgctttaacaatcttatatgctaacaatcatatatgctaagtctaactgtcgtatattagaaccctacacaatcttatatgctaagtctaattacaaatctaataatcttatattaaaactataataatcttatactaaaactcaaatagtattgtattaaaactgtaatagtcaactatgctaagtctaagtgtcgtgtattaggaccctagacaataattatatactaagtctaattacaaatctaataatcttatattaaaactcaaataatcttgtattagaactctaataatcttatattaaaactcaaatagtcatatatgctaagtctaactgtcgtatattagaaccctacacaatcttatgtgctaagtctaattacaaatctaataatcttatattaaaaatataataatcttatattaaaactcaaataatattgtattaaaactctaattatgttgctaagtctaagtgtcgtatattaaatctaatagtcttaattgcattaaaaatctaacaatcatatatttacatcacttgcctgcgcgaattccttcgagggctagcgaccactccggcttgagggacgacgacgacaacgacttttctgcaacatacaaaaagatgtattaggataaacgcaaagtaacatatattgtatttcacgttcgcattctcgttaagttcacgtttcgttcatgatcgttcacgttcgcgttgtcattaagttcacgtttcattcacctacgttcgttcgttcccgtgagttcatgttaacgtacgttaagtaatgttcgcgttcttgttaagttcacttttcattcacgcacgttcgtgcgtttatgtatgttcacatacaacgttaagttcacgttcacattaggttcacg

SEQ ID NO: 61953 - DNA, 1723 bp, Oryza sativa
tggattttactttgggacaatgaacaagtatctgtagtttcgaagtagtaggttatcaccttcctcaaagtaacggatcatatgtaccgtatgtccagaggaagcacaaaatgcgtagaggtgacttgtcttgtcaaacatccttggtgtgaagcctcttgctgtgaaagttctgtattcccaagttcccaactagtccatatctactgggaattgaatctctttcttgcagagctggaactttgtgcactagttccaacaaaattagattcttgcaaatatggaaatattgtattgtaggagtagttccaacaaagttcgatgaaatttctcgccctttgaacaagtctgtcggtcagtgcttttcatgtccgttggtgaagagccccgttgtttcgcttattcatatgtttaatccattgttttgcttattcatatttttaatcccaaattgcttattaataaataaaaatcatatgttagtaaaacttttatatatatgtctctttagtaattcaaaagcaaatgttgtaaaataaactacgatgagaaaaacaaaaaaagttaaatttaaaattaagttataaaatttaaattttgttctataatcatagatgacatatcgggttaaaacgaggtaagtgtggggaactcgtgaaaatcaaatataattcatgaaaaaaattattagaaatatatgtagatatgaaatacattctgacctctcaagttcagacttaactttattagagtaaaaaagataaatttcgaacgcatagtaacatggcactattcacttgaaatttgctatctttgtctcttttgaataaagttgagtttggacttgaaatttgatgagaacatatttcatatatatatatattataataacatatttttataactttataaaaattttaggtataattttcatgagcttttaacccttaactcccttaactcgttttcacgagatatttccccaataatcataatcatgagcgaaataattaggccagaattcgggctggacctcgcaagttgccagacacgcaagcatacgaagtggcccaataaagcaaccagactcgagtcagaggcatccgctccgctccccgcaacgaacacccccgctcctcctcctctccagctcggtcggttgcaggtgggaaaggggaagagagactcgccagctcgaagtccaaaccctcaacccccgcgccgcgccgccccgccccgcccatggccgcctcctcctcgcgctcccccgcctccacctcgcgccgcggaggcggcgcgcggcagtccccgttcttccgggacctcgcctccccgatcccgtcccaccgcgcggcctcccgcttcgcctcctcggcggcggggcccaccgccgccacgacgccgccgccgccgccgctcttcaccctcgacgaccgcgccgccgccgtggacttctcccccgacgccgcggcctccgaactcctcctccccgtcgcctcctccccctccccgcgctccgccgcggccgccgccagccgctccccgtcatgggaccgctcccgcggcagggcctccgcccccggatcccccatggatggggtcgtggagccgccccggaaggaggtgcttgctttgccgcctccaccgagccctggtacccggcgcctccgcctccggccgccgaggcacagtcgcctgttactccggcacctgtgtcgactgg

SEQ ID NO: 61954 - DNA, 70157 bp, Oryza sativa
  unsure (1)..(70157): unsure at all n locations
gcactacctccacagacggcgccgacgccaacagtaccgcctcctggattggtgagccgcttccgtccacgggagctatccatgccatcggcgcagttaaacacgacgaacgccacgatcgctacggtcgccacgaagaccagcgcaatgccgacaacactcctgctcatgtcgggcggggagccgccgccgcctccgccggagaagcctcggccaaggccggcgtccacggcgagcctaaccattgtgatatatcgatcgatcgagctgccgcttgttggctgtgatatatcgatcgagcccccggctgcttgttggcgagatcgttcgggtggtaattatagggttggagagagcgagatacctggctacactagcttattttctgtgacacggtgcatcgcatctggccggttgcaatgtcttccatagagtggtgagagctactccctccgtctcacaatattcccactatatgcataatataccttttatacactagatgtgatgcattcgaccctgtccagattcgttgtcataagatgcgtcacatataggacagaatgacttacattgtagaacggagagagtacgaaatcgctgtgttgcacctgtagcatgtaggtgcgccgcaggcagggttaaacctttcggtttagccgatttgatcggactcaccggaatgccaaaattttagaaatttccaaaattttgaataaaatttagttgaacttgaataaatatcaccaaaattcacggaaaaaattaaaaaaaaataaaaatttcaaccaaaataatatagtatcggaggggtctgaaatgaccgcggaaatttcgttccggaatttccaaccctatgtgctctctctctctctccataaaaaaccaaattctattaatgtatctagataatgtgtctagatttatctttaggatttagtttttttatggttcagaatggatacactacgttatcttcttcttcttctttttcgacaacaatatatgcgttacgtgtattagagataggttgatcgatcggttttcatatatatctaaaccaatcgaaggatgactgattcgatcgttgtccatgtagaattaactaaggcaattgttcccacggcggctagttttatatcagcttaaatgcttaatcatgtgtagtgcgcgtccttgactgtacgccaagtcgccaacgtcatgaccactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttagttctcgtgcgctacccccttttattattgccgaaatcatgtttcgacagttggcgcgccaggtaggggttgcgtcgagtttcttatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcgtactgatttttaatcccagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgctgctgctgttgggcgtctacgacttcaccgccggcctgcctccgttgccgccgattggtgcctccgcctacacggccggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacaactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggctgcctttgggccgattcctagcacccgggggctcgttggatggaccgagtaacgcaaggtgctaagtattattcggaataaatcaaaagcatagagataagataaattcattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttacctcttacgctccaggaatggatcagtcagaacatcaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctattatgccgccgttgttgggcgcctacgtcttcaccgaccggcttgccttcgtcgccgccgaccgatgtcctcgcctgcacggctggcctttatgccgccgttgttggacgtctacgtcttcaccgaccggcttgccttcgtcgccgccgaccgatgtcctcgcctgcacggctggcctttatgccgccgttgttgggcgtctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcatctcgtctgctgctgactagtgccctcgcctctacatctggtttatacagctaccactactgatggacatcatcgtcttccgccgccgactcgtgttatgccgccgccgaccggtgcttttatcttcacaactgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctctgctgttgctaatggatgattatgttttcgctgacttattatttcaccttcacggttgacctactatgcaaatgctgatgagcgtctttgtcattatcattggttgctacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatgttctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggactaaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacgaagatgattgaagcactcggccttggagtaatctagttcgagagaaggttatctttccgactgtgaaggtctcaggggctactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacacacggcggattcaaatccccaaacaggagtagggtattacctctcattgagagggcctccctagtattttaatatatgacgccgttgactttttgataaacgtttgactttccgtcttatttaaaaaaattatgtaattataatttattttattgtgatttgatttatcatcaaatgttctttaagcatgacataagtatttttatatttgcataaaaattttgaataagacgcgttatcaaacgttgattaaaaagtcaacggcgtcatacattaaaatacggagggaatacttcctccatttcacagtgtaacttattatagtatttctcatatttatattaatattaatgaaattagatatatattgtgaaacgggggagtagctcgatatctagtgaaattatgcttcgttggccgatcgggacaaagtacatccaaaacatgatatgcacttaatttgttaaatatatactattaattatacactgtgttcatagaaattggcttgaccacagtgttaattaaccggccatcgccggcggcgagacgtctggatcattacggccaaaagcacggagccacgcacacccatccgctgatgattcgccaggacggagtcgttaggcggttaggcccagccgcccagccggctgtgtttaggccatgtttagttccacccaaaatcctaaccttctgttacgtcacatcacatcgaaaactttcctacacatataaactatcaactttttctctaaactactaactttctcacagcttcataacttctccaccatctaaacacacccttaattagttcacataaaaaattgaaagtttggttgaaattgaaatgatgtgatggaaaagttggtagtttagaaaaaaactttgaagtaaacacggtgcaaattaaaatgctcgatcatatcgccgcttgattctcaccacttgcttgtacgccaatccatgattgacaacgttgctgtttaacattgaccttgtctcggtcacttttgaaaattaacctgacaaagtacctttacccaataaataatttgcaactctgttcttacattgtccacgtactccctccgtcccataagggattttgtagcgcccgttccgtcgtggcgcctagcggaaaaattatctcctaaaaatcctaattgcgaaatttgtttcttcgcttgtcgtctagtgtccgtgccgtctcaagatctcaaatccccgatctatcgtcgagttcaattccgaatccaaatccttccaaatcaaattcctccgcaaaagtctagtttgcctcccccagggtcgatgggccgaatctcgctcggcccatctctccctccctccccggctctctctctctctctctctctctcgctccccctccgctccgcgccgcccgcgcgccgcgcgcgtgcgcgtgagccgctcgcgccgagcgccccctttcccctcgctctccttctccccatccctggcaagctccccgcccgcgaagccggctcccgcgcgccgttgttcgcgcgcgcgcccacgtggttccccgcccgcgccgagtcgagccctcgctgctgctccccgcgcgtcgttcgcgcgcgcgcccgcgtggtcctcacccgcgtcgcgtctgcgccgcccggccccgctgccctgccgcgcttgctgccgcgtagccgctcggccccgcagccagtgcgcgtgcccgagccacgccactccatccgccgcgcctcccgttgcgacccgcgcgcgcgtgccgtggtggccgaccgcccggtcgcctccgccgtcagcccatgcacgcacctgtcgcccgtgtcgtcgcgccgctccaaaccgccccgccgtcatcgccgtcgtcatcgcctcggccccgtcactcccgcgcaagccgccaagggacggaggcagagcctccctcctccctctgccgcgacgccccgctccctcctccttttcccgaagaggcaaggggacaagcccctttctccccctccttttcccccttttcctcccgccggcgtcatcctccctccctcctgtcgccgttttggccgctagccggagcgccagctcgcgccttgaccgccaaagtcggtttccaaaccgacattgccgccccctataaacccgagctccctccctttttcctttcctctcccattcgcctccgcgccattgccgccgcctcccgtgctctgttcgccgtcgccgttcgtcgttgcgcgtgtcggaagagccggcacgagcaaggacgcggaaggggactctgggcgcaccctcttcttcctcttcctcggcccgaggccggagagatcactcccgcgccgtcggcctctcgtcactgcgcccctcctcatctcggtagtgcctctctccgttctccctcctcgctccatcttccccccttagttttcggtggtagcatgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccgacgctagcatcggattcccatggccgcgtggatgctctcaccgccgggaatcgacccctcgtgacctcgtcgccgtttccctcttccctccccgccagttgccgccgccgcgattcgccgccgtcaagctccctccggcgaatccgagccgttggctcgtctcccctcgtcacgtgcaaccacccggtgtgctcgcttttgcctgtatcgccgtgggttgctccgtcgctcgccgctgtcgaccgccgtccgttccggccggcgtcgtcgtctacctcccgccggcccgcgtggcagccacgtaggcgccacgtcggcgccagcacagccaaggccgggtcgagtcgaccccggtcagtcccttcccgtgcgcgcgttccaccgcgagccgtgaggctgcgcgtgggcccgccgcatccgcgtccaccgcgaaccgcgcgcgtgcaccgcgtccctcccccaccctagcgccgcgccgcgtgctccctccgcacggtgagccgagccgctgacaagcgggtcccacccgggactgcgcgtggtgagcccggtccaccggccctctctctcctcccctcccgcgcgcgcgcttgggccatcttgggccggccggcccatttagctcggccggaccgccccatctctctcgggccgcgccctagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgttcgactccgttcaacttccaaaattcctcaaatctcgagatctatctaatggcacgcttagaggtcattaatagggctttattttcgccgtttgttgagttgtcccgtttcgcgtgtagtctcggagcccgaagacccgcagtgcgaggattgcgaggatcaagctccagatctcgagcaaggcaagccacctttgaacatcttgagcctatatttgaaatttaattatgttgcttgaaaaatattatgcattgataggatcgcactttttctgtcgtcccgtctgcaaggcagattggcggacccacctagtttgttgcatttgatccttcctttgttaattgttataccttgtccccttgtaaccatctagttgcgtctcgatattcgtgcaccctgtgcgagtatcgacggacgccttcaaacttaaaaatctgaataacaacttgggtaaaacttgggttttacaaaagatttggaaaacccgacacctgggtcggtgcttgcgaactaaatgaatttccaaaaccgcgggccggggaacgtaccgggtgtacggtttcccgctctcgcacttaaggaccgatttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggataggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgtcgtttgagaagcactcacctagttgtttttagaaaagagttcaaataaaatcaattgcaaaaacaacagcctttcttcgaagcctgcattaaacacttatttcccatggcttgctgagtactcccgtactcacccttgctctatataaatatccccccctcagttgctgaagaagatgaagcggattctgttgatgaggagttcttccaggagcaagccggctacgatgagttttagggtttcggcctagttcctaagtcacgcctgtgttgattggtccaagtcctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcgattaacaggttaatttagagcgtcacgggctagttccggtcggtactagttcggggcgtgacagattttaagtttttgattgcaaaatttgaccactcgtcttattcaaattttttttacaaatataaaagacgaaaagttgtgtttaaagtattatagataataaagtaagtcacaaaaaaataaataataattttaaaaatttttgaataaaatgagtagtcaaacgttgcagacaaaaatatcttttttaattaaggctgtgtttagttcatgaaaaaaaattaaaagtttggagaaaaagttaaaagtttatgtgtgtaggaaaattttggatgtgatatgatggaaagttgaaaattgagggtaaactaaacacggcctaacagtaaaaaatgcatccaataattaaactgatcatatatacataaatacaactgagacaagaagtaatactcaactggacaacctcaaggagctctgattttttcacaatctatctcatattataatgtacataatggcaacatattagtagcaagcaacacgtacagtggccgagttaactcccgtgacgtcagaacccaccaccaccacccccgccgccgccgccgccgccgcagccgccaccgctgaatccgctgcttgccccatggtcaccggagtagtggtgcccgccgccgccgccatggtctccgccatggtggtgccagcctcctccaccatggtctccgccatgcccgtggtgatggtggtgcccgccgccgccgtggtccccgccatgcccgtggccatggtggtggtgtccgccgccattgtctccgccatgtccgtggccatggtggtgatgcccgccgtgagcatccgagctagcagcgaaaatgcacaaatcacaacaagagagatggaattaagcactgatagcacacgtgttaactcgttcttacctaggctggtcgccgccgccgccatcaccgccatcgccgccgccgtccggcccgtcgccaccaccatcgcctccgtcgccgccgccaccatccccgtcttccctgcggcggcggcgcttatctttcttccttcttgggctgtctttaggcccgtcggcacagccgaacaccgcgatcgccacgacggctaaggccgcggcaaagccgaagccgatgaggatccaaccggcagcaggagcagtagggacggcgccgaagccattgcccgcagtaacagctaacgccctcaccattgttaccgagcaagaagtgtctagctagctagcactgtgttcttgcagcagcagcagcaagcgagaatggaagatggataagtagcacacaagcttaaagtgcttctgttaattaggtgcaggaaaaattaagcacgcatcttatgaagtctcgacgcgttgtttctaaaaggatagcgaatggattttccaaactttgctgagaaattgtgttcgatcagtagtgccccagaggatatcgtcaaaaaagtgtgaaatgagctaaggtcaagccttcaatgttgacgaagagtttgcgatgataaaaacggaaagtccgcagctagacgacttctaattcagagtgtgtttagttcacattaaaattgaaagtttggttgaaattggaacgatgtgatgaaaaaattgaaaatttgtgtatgtaagaaagtttcgatgtgatggaaaagttggaagtttgttaaaaaaaattggatcggtctgaggctgcatacgcgttcagaagttgcacagaaactggctcatcttgacccatgggcacagttatcgccgccggcggcgagctatccgtgtgattacgccgaaactcacccgccaccgaccacgcccacagatgataattcaccgaggagattggacggtgagtcatcgcgatgaggcccaggccaaatgacccagggggatccacggcctggcaagtttttcctcgatatatgggccgaaataggcccactctatcggcctactccatcacataaagcccaccaaatgagacggcgatatgtttgaaaaaaattgcaccgaatgtctctcaacttgtcatcgagttaaaaaatcgttccccaaccgcaaagccagatatatgatatccttcaactttcaaaaccatttactttagatccttaggtggttttgaccccggtttgtccgacgtggcggctgagttagcgtaaggatccacgtgggtcccacatattagggtgaccacgtcaccacccaatctttttttcccctcttctctcctatcctcctctctctctctctctctccgacctctctgcgtaggttggccgtcgggtggggaggaggttggcggggctaggcgggagaggagggcgtcgacgacagtggtgacagcgacgatgctggagaagagaggaggccggcggggtgaggagggagagaaggtccggcggcggtggcaacgatgcaggagcaggccattgcgccgggtggggaaccggctggccgatctcctctccgtcgcccttccccgcgcgcatcggtgacttcgctaccgccaccgtatcatccctcggccctcctctccaccgcgctcctcccttgccagctgccgaccgcggtgggtagggagccggccagtcgatctcctctccgctgctcctttcccgttggccgtgccgaccctcttccccgtcgccggccctccaatccgccgctccgcctgtgccaccgtgcatcaccgcctcaccccgacgacgacgtgtgaccacagcaatggcgccgcacggcacgtagagggggaggaggagggcaggcagacgaccgccgcataataaagaaaaagaatgaaatgaatatcaggccagtccaacaatatttttataatgagtgtctaggttgattatttttctatattatggtatttataagggtagaatggtcatttgattattgttcttgcatgtgaggatgaaatggcatacccacgtgacgttttttttttgtttaaaggactaatgttatgctagatgataaattttaaacatttgtttgtgtgtttcttatcttggtcttatcacttttataatgtttgggtgtgtttaattctatttgaactacactttttgttcgagtgttagattgtaataattggttgtaactctgttgagtaaagaccgggatgttaactattctattattaaaaaaaattattgaaacgtcaagcactaaactaatcctgaaacttcatggattggctattcaccctaacaaaaataaatgagctgccgcacacaaagtacagactaatggtcatgtcgtgatgtatgccacctatatatcccaagttttaagtgagcgtgcaggtcagaagaaaatattagatatgggagaaaccctaaataatctaatgtattatgttgtattgacactgtaatgataggtatatatagagagagtacatatgaggtagatacaagttagaatatacttatctttaggactcccttttatcagtacaattcgtatttaaactctttatctccacctgtacacaactatagctactacggccacggcaatggcgccgcacggcacgcagagaaggagaaggagggtaggcagacaaccgatccgtgcaacggtagccatcggcggcgccacccgtcgcatcggctatcctgtccactgcgctcctcccctgccagccgccaaccacgctggccctcctccctgccgcgtcgaggacgccgccgccatcaacgcctagggggaaaatgagagaggaagggagagaagagggaaaaaagagagagggtggtgatgtggtcaccctgacatgtagagtctacttgggtcccacgctgattcagccgttatgtcagataaaaccggagtcaaaaccacctaaggacctaaagtgaatggttttataagctgagggatgtcatatccctggttttgtggttggggacgattttgtaactcgatgacaagttgagggaccttcggtgtactctaatgataggtatatatagagaaagtgcatatgaatatatgatgtagatacaagttagaatatacttatctttaggactcccttttatcagtacaattcgtatttaaactctttatctccacctgtacacaactatagctactaacacccacctccgccgccgcagccaccgccgccgccacaaccgccaccgcccccatggtcaccggagaagtggtgcccaccgccgccatggtctccaccatggtggtgccagcctccaccatgatctccgccgtgctcgtggtgcccgccgccgtcaccaccaccatcgcccccgtctggaccgtcgtcaccgccgccgtcatcgtcccggcggcggcggcgcttgtccttcttcctttttggtttctgtttaggtcgatcggcacagccgaacacggcgatcgccacgacggctacggccgcggcgaagccgaaggcgacgaggacccagccggcggctggagcagtagtaggcacggcggcgaagccattgcccgcagtaacagctaacgctctcaccattgctacgtgagcaggaataatcggctaataaccttttcttcttgcagctgcagataattaacgtactctcaccattgttaagtacagcacaagctcttgtgttacgtgcagaattggagagagagagacattgtaagattcaacgcggttttctgagtcgtagagaggaattggaggagttgtacagactcttccttgaggaaatgtcgtaagcgtgtgaaatgagatcatatcagcctgaattgctgacgagtttgctactatatataaacagtggaatagtcaataagtacatctggcagctatacgacttttcattcaaccccccagatcagatcatcaaatgtctgttcacagaagttgcacagaaactgggtcgagctcatcttgaccggcggcgagctttctgtgccattacggcgaaacgcaccggcgccaccgaccacgccaacagatgattcaccgaggaggctagtcccagaacggcgaggccgtgccatgcggcccagcccaaataacccatggcaatcacgtccgcaactgaaggaatctgtaatagcaggtgatccattaaatctgagccacacagcctgatcgaacggctgatagagatcctgggggttgggagttttagactccgaccccctcgaacacccaaaatcaccgctctgtccaatttaccagccgctgacagttcgcgaggagcagctgatcaattaatctgagccgtacagttcgatcgagcggctggtagagacccatgggggttcggagttttgaaccccgcgcgacccccattcgcagccggaaatccaccactgcgcgtctgcgcctcatcgtagctctgccgagatcttggctgcgtcttctcccttctcctgcctcatcgagctccatatggccgcactccatccgtccagcgcctgcaattctgaatttcagatttagaaaccgtgcttcacatcgctctgcaaaggagacttaattcctgaagccgattaagaaaccgatgattcagaaagagaagaagacacagcaatgcttgggagtttcaccattgtttttcagacgaaccgaacgagatgaaaatgaagtatcatcttgttgcttgctgatctttttacagcgagatgatacgtggagtttcagtaaaatattcctggtctgtccctgatagtcagataagagcttaacaaccaaatctttaatatgaagatgctccttgggtatttgcatgctagctgtttgcagcacgcaggagaggaggaccagcgtagcaagactatgcgctattgcatccatcgtctacggcataacaattgtctggacattgctgctggatacctctttgtacctcttaaactgtaaaatttctttggaagacttagcgcgaaagtctattctgatcactagatacaaacaaattaacttgaaaaaaaaatatgttggcgtacaacaattgcatgctcgtaggagcttagcgccgtaaataatcattgtttttcaactagaaattacgtaaaagagatactgtaagctgcttaagccaagatgaaaatggaagaggcgaatttgatcgtgagtcaattaaactgtactgttattactcactatcactgccatagtagtgccatgcataatgaataatccataccacgaatcttgtcttgatcaactggatccgtcaattaacctccgtctactctccacctcctcctccgtctgcgcctccaccgccgtctgcgccgcccccgcaaccgtctgcgccgccaccatcgccaccgtcatcgccgccgccgccgccaccgccgccatcaccacctccatccccgccggcgccccagcaacaacaacaggtggacctccgggatctgttcttgcggtcggcgtatccacaaaggagaatgaccacaatcgctagcacgaacacgacaatgcctgcagccgaagcagcagcagcattggacgtcgcgttgggcacgagaagatgttgctcgctagccatttgtatgatctcttcgatcttcttcgtctaattggttgatgattagggataaaattaaattaagctgcaagctagctcgatcgagtggtaattatatagagaggccttccggcgcattaattatgttttctccgactttgcactctagactggtgctagcgtgtagcgccttgcagatgtgtgctggatcgatcgatcactggagacgacgtctacgactttgccaatcgatcccaatggaaaattggaatgcattggtaggatagaacatgggccagtgtggatgctgctgaccttgacttaatttaatcaagctcagcctgtatttgtatactgtctacgttgaccatgagaggggcagagatcagcttcacatgtatacgcccgacggcctgacattgtttcagcccaactttaacgggccggacgttccttgccttttcagcccaactatacgggccgcatggcccatatgagaatatactggactattatgcgtacgtcgccttcctgcggcccagttttagtggtttgatgattaagatccggaataagttcactttgtaaccctgaaaaagtaatcgaaatctaatccgtgaccctaaaccacaaaaccggatatctagacccccaactcttaaaatcggtgcaatttgactccctcaacagttttgaagggtggttttgctaacgtgacgcctacgtgacaatattgactcggtcttctttgcacatggcattgacgtggcacttaggtggcattagaaataaaaaaatatgtgtgggacccatttatcattcaccaaaaatatgggtgggacccactgacatgtgggcccacataaatcatcctctcttcatcctccccccccccccccccccccggcgcgtcttctctctatctctcttcatcgcttaatttagctgtagctccgcttgttgatccgtagctggcggatctgcttcctctatcctccccatcggaattgttcgtaccgtcgcggaggcgctgttgcattctactgataccaagattacaactacagcaagatcggatgagagagctagctgctgcctaattagtttcgagatcaatgagagttgctagctggacagggtggttacgtacgtaattatatatagggttagatcgtacgtggtgtgtacgtgcagaactgaagagtatgttataatgtcaaattccatttgctatcacagagagtataaattttatccgtcaggtttgtgcttcgcgcttacggaaccagccggccgtaattaaagtactgttagcttctctctttttttttctttacacgaaactttatcatgtactagagaatagatagattcactgtacaatgctgcaaaagtatacagtaatactccgtattttaattagatcgctggagacgatttcgcaattcacggattgatccaagtcgacggatggggaaaatgtcaggaaagtggttcgcgctttgcttgtcacaccatttcggcccaaccaggcaaccacgcgcgtgggccgtgccaccaggggagcgaacgtacgggccggcccgcgcgtggccgctgggctgacgaagcgcatcgatataggaaagatcgagttcctccctttaatagcaaaaccgggtataacgtatctcttatcatttaaaatcagtgtattgaaagcagttttggcttacgtggtactaaagttttcatctaaaaatgttcagattggagaccacatagccttgcaaaaacattataaagcaagaaattgtgtactacttctacttgattaggacttttgcctctactgaccaaggtttttgtttcttcgcgaggaggcgcagtagaataactggagaagcatcacaaatctgtatatacagcttgctcttttttgttcttttgcaaaatcttgatttacattatctacacttagatcatggttaaagctggactactggagttgagaacaaaggtaatcttgtcatggatatttatattttgcattagaacagaggcaatcttaccatttgggtgaaaaaaaagtgaatatacattttctaaatttatatttatatacatgtttgtggggggaattatgaaaatatacatgtttataaatgcagacgtgaaaatattacgcggcataatattgaacagattgaatccggttttaacaattgaggaattctctatatttgattttgcggttgaagaatacgaattaaaatgtgtctatatatgaggcatgtaaaatgaactttttttctggaaacaaatactgtcgttggacaaaacaaaggttgccgcacgtggatggcaatcacgtccacaccgcaagagccgtgggaaatcgtttcaaatgaagagctgtcatagatagacaatcatctgtgagactgtgatggctcttgatcctaatatatctcttacggtagatttaagcacccgtcacagatataattatttgtaacaactctctaagagagccatcattgataactctttttttttcatttttgttacatcaaataagttgatcatgcataatatccaaagacaaacccgttatgaaatgatcttacctcatcattttttatgcagtttgcaggcataaatggcatcctctactatactcctgaaatacttgagcaagttggtgttggaggttttttctcgaagtttgatcttaattagttcttctacatctatacttttaagtgccatcgcaaccttagtgatgattccttgtattggtgttgctgtgccgttcgtagatacgaaaggaagaaatttagtattctaatatttataattactttctccgtttcacaatgtaagttattctagcatttcccatctagacattcattaacatcaatatgaatgtgggaaatgctaaaatgacttacattgtgaaacggagagagtactacttattgtcattatttaattaaaaagttaaagaaagtacaaaatggtaatttttctccctcgcttcatgcatgcaggcatattctccttggcacgatacccattctgctattatccctagctattatgcttgttgctaatattatgaatatgagcactgatttacatgctatcacctcagcattatgcgtaatcgtttatcaatgtgtttttgttatgggatttggccctattccaaatattttgtgtgctgaaattttccgtatagtccctcctcattcacaagatccatggatacccccggagcaccctcttcaatttttttcaccatgaatgataaactaaaggtccctaaatagttggaggttgaagaaactgtataattgagcccccccccccccccaaaaaaaaaaattctgttcatggatccgaccatgatgcttggtaatatgtagcctagcattttggatttgtgataccatcgtcacatacacttttcctgtgttgatgaatgcgattggtcttgcgggtgtttttgggatctttgctactgtttgtgcactagctaactatttgtatatttcaaggtgccagaaactaaaggtatatacctcttgaggttctgtcggagtgttttgcttctaccaacatctcatccaaagatgattcgaaagaagataagtaatactccctccgtatttaatgtatgacgccgttgacttttcgaccaacgtttaaccattcgttttattcaaaatttgtgtgcaaatatgaaaatatttatgtcatgcttaaagaatatttggtgacgaatcaagtcataataaaataatgataattagataaattttttaaataagacgaatggtcaaacgttggacaaaaagtcaacggcgtcatacattaaaatatgaaggtaataatgaattggttggctccatgtaggacggattttattgcaatgccatatattgatgtattttttgctatattattatgtattaaatttgtgaaactgtcatatgttttgtgtggtggcatctgtacatgtatctgtacttgcctgtacatatatgtacctgtgttgtctactatgttctaatctactttacatacaaccctttgcatgctgtccaaattattggtatacatctgaattacattatttatacccagttagtacagttttttttcctgttttgccatgtgttaactaattcaatcatatggtaacctttcgtatcgtgcattagaaactactccatccgtttaaaaaaacgaatctaggattgaattattttactacaacgaatctggacatatatttgtctagattcatattattaggatatgtcaaatccaattctagattcgttttttatgggacgacaagaataattaactatttgtcactcttacgagtggtgctaaattatttgccactggacccacatatcatagacacatgagggtccacatgttatatacagcgagtggtaaatagttaaatgtcccagactctactactaattagcatgcatctagagagcattggcagcctgagtcgagcagctcactgactttgcttccaccatgtaccgagagctgaacacgcaaaatcacataaaccacatacaggcatggtttagtttccaactttttcttcaaacttttaactttttcattatatcaaaactttctacacacacaaacttctaactttttcgtcacatcgttccaattttaacgtgaactagacacagccataatcagggtgcaattgataatgcttatgttagctgtgaacactttttttttaacgcaaactggtctcaaagctatttttagataatggaataaatatcccggcctttactcattaaagctatagctaattattacaaggaatcgcataaacaacgagtgaagttcaaataaaattaaatacacccaacgataaaaaaacaaaaccaagaaaaggagcacacatttattcaagtctatttttgaatttccatccatggttcgcaaatatttacataaccgtcgtctccaaattacggcatgcaacctttataaactctccatcatcttcacacttttgcaactttgcccaaaaccggagccaatatgttgccttgaatattacctgcatatatgagatagatggtgatttgtcagaaactatatcattcctactcaaccacagagcctaacaaatggcagatgctccaacaagtatgagtttactcatcttcttgtgaacccctaaaagccaaccatcaaacatattagatatggaactagagaggtttaaaccaataaaaaactgtactactctccaaacaaattttgcaaaatgacagtcaagaaaagatgttatacggtttgcaatttgccatggcttggagccttggagctgactgacgaacggttgacatgtcacgctcaaagcctctccccccataattgtcccatccgatgcgaacacactcacacaaacagggagagccgcttgctgcattcattggcgtgcggacagatcgccgcccagcaatcagcggcaggccaccaaatagacagccacaacacctatcaacttatgggagaattcagccgtggaagaagccggcagcagcagcagtagtagtaggtcgatttggtttgaagagccaaacaatgcccacgagatatggctatgctgatgagctgctgaggcagtgatgtgtagactgtagatcctatttaatatagtttaagattgtaaaaacagttggttagtagtcattttctgaaaaatctgatttctattttttttccattttgtaactatagctattaaaatccaaaaaaaaactagactaatttaaaagaatttttaattttgatagaagttgtagaagctcccaaacagtcgaagtagctatggtgataatactctcttctcccattttaagtggtagttgtaaatttctgtgtttaactttaatcggctatcttatttaatttttttttatgattagtatttttgttgttgctagataataaaacatagtagtactttatatataacttatttcttaattttttttataaaatttttaaataaaataaatgatcaaatgaattatgaaaactcgtgactgcatttaaattaggacgcgcgaacaaagcattggcgtttgcttccgttggcggctgggacccaactgtcccgcgccgggagcacacgcgtataaaggacggtaggagtggaggcctcgccgggctcgcagttcgcatcgcgctgttccctcctcggctcctcgcgcaggagcactggcacggacagtgacatcgtcttcccttcacctcctcgtccttccctctcgtggcatcgcatcgcatcgtgtcctctgcgactgcgagagtgcgtgtgtgcagcgcgcgctcgtcgagacagacagcagcagcagttgctctttaatgccggtgccttgctgaacagagcaaggtctctccaatggccttgaggcattcaatgcgcccgtaatccatctcttgaacggccgtgtgtgtgttcttggcgtgttggtgtgcgtggattgggtgggtgaggaggatgaactatctcaggagccggagcctcaagcggctcctgtctctcggtcgccggagcaacaattccgatgagtccaatgacgagtgcgtcttcgtcgtcgaccagccgccgccgtcgaacaagcctacttggaggtgcttctcgtatgaggaggtcaacaaggccaccaatggcttccaccgaggtacagtagatatatattcttgttggtttctttggggatttggcattgagaacatggcgccatgacagacaatatggtggggagaggcgggtacggcgaggtgtaccgcggcgtgctggaggacgggagcgccgtcgcggtgaagcggctgtcgccggcggcggcggcggacgagaagaaggagaaggacttcttgacggagctcggcacggtggggcatgtccggcaccccaacgtcacggcgctgctcggctgctgcgtcgaccggggactccacctcatcttcgagttctccgcccgcggctccgtctccgccaacctccacgacgagaggctgccggtgatgccgtggcggcggcgccacgggatcgccgtcggcaccgcgagggggctccggtacctccacaagggttgcgcgcgccggatcatacaccgcgacatcaaggcgtccaacgtcctcctcaccgccgactacgagccccaggttcttcctcctcctctacctctcctctgctcgctatctgttcgtccggttgctcaccgagaaagaattgaattcgcctcagatttcggacttcggcctcgcccggtggctgccgtcggagtggacgcaccacgccatcgcgcccatcgagggcaccttcgggtgagcacacatacgttctccatggaccatggccatggcagtaaaaacagggagacgagacgacgctgagccgacgacattgatgtgcaggtgcttggcgccggagtacttcacgcacggcatcgtggacgagaagacggacgtgttcgccttcggcgtcttcctcctcgagctcatctccgggaggaagccggtggacggctcccacaagagcctcctcgcctgggtacgtacgtagcacattcatacgccatcgccgccgtcgcgtcgcgcatcgcacaacacgcgcacggcggcgcgcttgtggcggccaggtgttcggccagggacattgacattggtgccgtggcgcgtgcatatgcaggcgaagccgtacctgaacgactgcgtggcgcaggggctcgtggacccgcgcctcggcgacggcggctacgacggcgcgcagctcaggcggctcatgttcgtcgcgtcgctctgcgtccggcccgccgcggcgtggcggcctaccatgacacaggtaagaagaaaaggaaaaagaaagcaaacatttttttttctgcaactgcacttgctgttccatctaggagtagactaaattgacaacaatttagaatccataaataaatgtgagagaaaaagcatccggattgaactgtccatgttaacaagtacagtaaaattgacactgaacaataattgaatttcattattttcctaccaaggtactccactctagtactagtactacaagaaatggaccattcatcattgtgaagggtttctttgctgacatcagctccgaaatggcatggtagcttgggattagttggcgacctaatcgttctagagtgtgcaaaacacttagcttaggaatgttagagtaggtctgactctgatctgacagtctgtgtagcattgcaatgcatgggccaccaaacaaaatctctcaacatcacccaaagaggacaagagctaggaaagctttaattcctttgtggtgtggtgtgctaattgggttgctgcttgacccagcaactcaaataaatatggcattgcaatttgcaaccactgcaatcttcttcagtagattgttaattacataggggaaacttgatggtttcttatggtggcagagtctagttgattttcgttggagtttgcgtatccacatacacattggttgtcaatcttgttcaggtaggttgttaattatatagaggaaacttgataatttcttttggagcatagtctggttgattttcgttggagtttgcatatccacatacacattcgctataaacggtttgtatatggcattatggtaggttcaacagctctatcaaaccatacaacgacatgaaaaatctcaacagaaatcaggagaaccggtatacaggaataattgttaacggctggtggataaattgatgaggggatctagtctaagggacatcattgtattatatggattatcaagcaagttctctaataacactggtctaaaagaagttcactaatagtactcaagtcatactctgtagatgacctcattacttttttcatggctggtgctaggtagctatctcactcaagtataattctcctatctgaagttatattttatacagcataatctgtatatgcttggtctaatcagacatccgggtgccctaatgcaatggcaatgtatgatgctaatgtgattgtcctactgctactagtctaatccatatcatccacttgcctcctatggttgttaaatactgccacattgtgttgtgtcagttgtgacagccactcctttggtttttattttatcttgctagcatctagcaagccagttggcgagtaacattgcaccaaacttgattgcgtataccttgtcttggtctgtcatagtgtggtgagatcccatttttaatgtgaaactaattgaatctctttcagtaggattccacagtgtgtgggatgataatgtttgtttatgtactacaatacagaaacagaggtatcagttatgtatgaggatatcatacatgaaagaataagttgaacctaaggaaggtagcttgaacacatcaatgcatatcatcaatattgacttctttgttttttccccccaaacagaccctaaagcttgatttactcttcaccttttcgtttcgtttttactacgtaaggcccacatattgttgtgttccaatacttgaaagtttcaataattcttgggtattttccaaaaggtacacactataaaataatttcaaaaactcaagcaacaaaaccgaatttttagacagtaaataaaagatggtaagtatcttgtagttctcaagttcttagtattcaaagtgcaattttactttttccagaccaaaggatagtctgatgaagcaaggggaaaaagaactctaaatattgttttttagatggaaaatataacagcattatcatttcaaagaatgtataacttcttttatggacatattgtattcgcaatctttcgtaatagatggtatttacaagtcaccaacagttgcaaccagaattactcttttagtttagaccttcaagacttaaagcaaacaaggggaaagcttacccattcttactagaccaagtagttgcacaaagccacagagtaatcttacaattttacttgacttgagaagaagacaagagtttggcctcatctaaaatgtggccggtttcttgattttagaagggacattggatgctctgtagcctcctaccttctccattatccttttcttccccccattgattcacgagaagcccagagccaggtgaagtgggggacacaggacagctcaagaacataaatcttgggacaaacgtacaaaacatgccaccccaatgtgcacatagaaaacttggtcacctctaatcaagatttaatcatgcactactttattagtattgcattgcaccatactaccattggcacacaagctacctactgtgaacagttactttggttttaacttccaaatgccttggaaggtggacatatacatacattcagacattagtgtcaataccatgttttcagaaatcacaactaaatttagcactttcagcaaataggttagcaagcagggttatgcagtttgttaacaagctattgcttacaactgaccgacgatatctagttgaatttgttatgagaacaatcttgattttctgagcaacaaacttgatttttcaatgcattgcgtttggctttcttgtttctctaattgcaaaattcagtgcattttgtcatcgtgtatctggtatcttgtcaaaaaaaaaaatccaactactgggaacatccctggaaagtttagaatcatttatccagtagttactagtaccaacaaccggtcaattgtagagcgtactgcagctcaactgtgtttcgtactgccacttaataaatttgcaactgtgttgtacttaactgactcggttcacatggggaaatggcaggtcctggagttattggagtccggcgagatatctcaagatcaatggctgatgcccgaggaggaggaggaagacgagttttgggatttcgacgatctcgacgacttcgaggacgacgacgacgacgatgatgacaactatgataacgacgatgaatcggattctccctcgatatcgtcgtcagcgtgcagcatccacgccaatgattagccccaaaatatttgagtctgtcagtcttgacagagtgccccaattggttttggtttttaggggatactatgatcgatgggattatattagtgtacataaaccacctagacaatagtaaattcagaaaagaaaaaaaaactgttcaggcccatggttttgatcatcatttcatgtctccattagcaagaatctccttgttaaaacccatactactaactccatcagctgatctgttcatctgacagtgatggttcagacggtttctgtcaaaccgtgctagatgaacagactgacacaagtttgtcatgatgccatgcccttggcttagctttctcccaaccaactggaactgttgttggtttacagtttcctgtggatggattggattggattggagacgagctgattagggacatgatagtcctttcagttaattgtttagctagcaaccagcacatgccaggcaccggcaggtgggcttcggtttggaatccgttggttagctcgatcaggtctcaagtgcagttgggcgaccctgcttagctgctgctgctttatttgttcgtccttcctgttcagctagatgtcgatcgatcaatgaagtaaccaagaagtcattgagcaaagttcagattggatcatgcagttctgtcaacgcaagaagtcagtcacgtttcattggactcactaaaaatggctaaaaatcaaaataaaaatatggaatgttagtctgaatgtctggagctcaaattggaaaaggagttgaagaattgaactgtatcatctactgccgattaagctgaatcactgtgcttggcagagatcaacagtatacgcattgacattcatggacctgaagaaatgtcgccgatccatcgatcgatcgatctaccagtggccgtatttgtacgtgaccaccaccggtccatgcaagatgcaccacaatgatagatgcaaacctctgaccaccactcatcgacatatggttggttcgttgtcatctcctgcttgccagatctacaaattgctgctacaactcgtcctagtttggaactgtagctacgagcctacgaggatggacgagatgcttggtgcccattggctcactcactcacacaggtccaagctagctactagagctgtagttaagctcaatggcccaatgtcattagtgctactgacagtgtgagctgcaacatctgtaattagcaggaccagcttatcccaaacagtagcaatgcagtgtcatacagtattgattcctgtgagcactgtgtaccattcatagggcttgtggtacacttgtgctagctagtatgcactgacaaatcctgatgatttccatgcgagttgaacccagcacatggagctttttgttcaggttaccgattgatcgagcagctaagacctcgagcattatgagatcgataagcatagcaatcgatcccgtgatcatacatgcagatgatgcagtggcgtgcgtgacactataggtacgttgttgctgaagccgaacatgcgatgctgcgtgcccgtggcgcaatgatccaaaagattacaggcttgcacgatcgaccaactgtttttcatgcaagatgttcagagagacagatagtgatatgtgtgttgttgtgtagatgcatgggcctcggctagaaatgctatttcataccgctacctcgtagctaccacggagagctatcgatcgaatgctagtttgtagtaggggtttgagaaatgatttgtcaattgcaatttggtaggggacaggtgccagatcagtgatggttgttgatcagtagtgtccgtcagaaaagatatgtgggtttcgatcttcagtttttttaatgaattaacgactaatagaacttttctacgagactacaaattaaatatgttcttatagttcttctggataccaaagcaaacaatattatcagggatagggaagaaattagcacgttctgttcgtttttttatctgaacctgaatgcatggcgacgaactgaacaattaagctcaaagtgaccgaccgatcatgttaactgttaagcagtcaaggtccagtgctgataaaccacatgagagagagagattctcagatcccatgtcaacacatccattcacagcagatcgaagctagattctttgcaagcgtgctgctcgtcaagcatgcagcgaatcaggggagagattaaacaagttgggtgcagataaccttcactgcagaacgacaaaaaggcccggattgaccatacaatgtaccatatcaagttatgcgattctgtcggtaattagcatgcatcaaagattcttcagataagccaattcgggttaatcaatccgaccgatggtcggtatatacaaacattgctcctcactactaggtgcagtccaggaattgctgtaaacacatgggcacttaacacacccagcgaagcagaatgcataaaaccaagtgttgttgtttttttattttgaaaaaggccaacggcccggcttatattgaaagcccaggggtataaccaagtgttgtaactgagaaaatgcacattttctcaacaatgcaggttattaagtcttttgtttcatggtcacattttaccacgccacattttattagacgtgtattagtttactatcacaattgtgcattgctacactttttcaacaacatattctgcatgtcataggcttaattttttttgtcaacttttgtcacgctttgtggctaccaatttattcattattttctttttgtctatcaaaatttgctaaaccttagttgtagtaaagtgtggctgacaacctaatacatcgtaagatgctagccaaaaagttcaaagatgcaaatgataaagatgaagtactgaactgggctaaacacaagttcagataaggcccgatttgtggtacttaccaagtgggccaactacacaagaaattgggccgtcctccccggcccaatcgacccaataggtaggtactgcttccatgtattgggggaagcagagagatccccgaaatcaaacccctcctcttctcttccccttcctcctgcgttctagggttttgcctcccagcggcgactcggcgagcgagaccaccggcaagctcgtcggcgatggagcccacctcgtcggcggcgatggcgaggcagacgtgggagctggagaacaacatcccggcggcggcctccgacccggacgccctggacgcgatctaccgctacgacgaggcggcgcaggcgcgggtgcagcaggagaagccctgggcgaacgacccccaccccttccgccgcgccaagatctccgccctcgcgctcctcaagatggtcgtccacgcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccaccatcaacaagcaggtcaggccccccaatccttccctcctcgctgtttattttggacctcatgatctgaccacgctttagtgttgctccaatctaggtcgttatctgctttccctgcctgaaattgtatagctaggaacactaaatcataataataattagtagtgccacggcgccgtctgctcaaaagttgtgcgggaggaagtatttgtggttaaatattgttagtgccacggtgctgtctgctcaaatgttgtacgcgagaaagtatttgtggtaaaattttgcagtgctgctaatttggtgttcattgtgtcacccttagattggttcgcaccatgctattgatcataatgtttctgaggtctcagtttttgctaacacattgatgactgatttggtatgtttgttgtgatatttgatcctagggataaaaactacagggtataatatttggaagttttagttgatattttagcactttgaactggtggtatttactgtttgtgcacatactgcattgtataatctgtttcatagcatttgttgtaggatttggtagtccccatactgtgtatcacagccatcttcttctaggatttagtcatcttagaattgttttgtgtccatctgatcatacataatctttggggtggctgaaatgctaagggggatcttgattttttttccttattctatactttcatgttctattcaaaattcattacctcgtgatcattgagctccgaaaatgagaataaatcgatgcaatttgctatataaagttacctaacatgcatatattcatttggataggctggaaggttggagaatgtggttggctggtatcactcacaccctggttatggatgctggttatcaggcattgatgtgtctactcagatgcttaatcagcaatttcaagagccattcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacaggtaactaacttatacgtctatttttttcctcccttgcccaacaaatgatctaattctgttctaattgtgttttgtgcagtactatgctctggatataacttatttcaaatcatccctggattctcatctccttgatctactttggaataagtactgggtcaatacgttatcttcatcacctctcctgggcaacagggattatgttgctggccagatatttgatttaggtaagaaatttcttttatgaatatttacccaaaaagaagtacacatctatttttgttttaccatgagaccagataaagttataaaccaatttgtgctatgcagctgataaactagagcaagctgagggtcaactggcacacagtcgatatggcatgcttatgccatcgcaacgaaagaaagaggtcatattctttaccatctgctgttcttcgtcactttcaataatttgtggtggtattgtatgcttgcaacttgcaacctatgagataaatgccaactatatttgaaaaattccatctgctgttctttgtcactttcaataatttgtggtggtattgtatgcttgcaacttgcaacctatgagataaatgccaactagatttgaaaaattgaacataaagacatttagttatgtaaatattgaattagtgacatcatgcatgggtcagtttgttatgtgctagggctttctctcatgagaaatttgggaggaagctatagctgtcatacttccattaggaccattacttctgttatatttggagtactgcaattgtgttgctctgtacttgtgttgataggagatttcaagctgagtacgcagattgatgatagtaaagtaaaatacaagatattaatatgaaagccatctgagtgagactgggaaagtatgatccagattatgttctgttcagagttgcaacttgcaacaaatgggttaaatctatattcgggataatagactaggattgaactagtcaaacagttctctttcttgcaaatatataaatcaatttgttctttgttattgtatatatttgtattatgtgtcctcaacattgtgatgtttgacccatatgtctataacacacatatttttggatttcttaagaattattgcctattctgctctctccaacctattttgtgcaaattacttaattagtgttatagtgtgtcaattgtttatggctatctttgagatctaaatgaaacttcctcttttttgttcctttttatgttttactcagcaagaggagtctccactggctaaggtaactcgggatagctcaaaaattactgctgaacaggtccatggtctcatgtcacaggtaatccataagcaagcctgactgttgacgaggtttgattctcctggtatatatatttgcttgcattatgctaacttttgcaacatgatgtttcaaggtcattaaggatatcctcttcaactctgtgcacccgtcaaacaaggcaagcacaagcgcaccagattcatccgggcctgagcctatggttgaagcatgagtgttctacagaattccttcattagttagccttttgttgatgctggattcacatacactgggtgcctagttgtttcatgactaaaagctgtgtccagcataactacccgattcaaaatgcgttagctgcgttttatcgtcaaatcataactgatatgtaattatgagttgccttctgaatctttcggctgccattgtgaaggtgcgtggtctacgttaagataaccaattaccttggcccaacttaccatgttctctcaacaatgaatggtcccaacgtcgctaggcacagtgtatgttgatttggatgatctttctggtatttatcctccgattttggtttctatatttccagttcatttcactgtgtcaggtgctacgggtacagccgtacagcattgttgctttcaattaacgtcagaatttgtcttatgattattgtagggcctcgttaacttggtcggtcaaataattcgttcccacttcgaagaagaaaccaaagaccttatcaattaaggacaagtatattactttcaactcacgacttcgtgggatcttccactttgacatgaatatcttcaagtggagaaatataaacatttcattttgacacgttagcagcagtacccagagatgctactttactttgtttaacaatatagtaaaatatagtaatacgttttaaataaaaagagttacatattatgatagtttgtttaatgataaattctagtaacatcaatatgggtgggtctagtcgtcaaacgtttgcattccacgaacgtttaataggtttcgtcgttattcgttctaatgactcgtttaagctcgtatatggtagttagagaccaaccaatcacttttccctactatcaaatcgattttatttcttgaaaaaaaaatccggtgatgcttagattttttatttgtactgaaatttatacatgcaaaatataattcataatatgaagttccattaaaaaagctataaaaatgactataaagaaaaaaaaaagtaatttgaaaaaaacagaatgcaaaaacaaaaaaatgatacatatcgcttcgggagaatcaacgtaaaaaaataacgggaaattgaaaagattcacgtaaaaaggagaaaaaaggaaattaagaacagaaaaacgtagcgacacaacctctcacgcatcgccacgtatcttcgatcctccccagcctgacccgttcacgaggatgagcggaagcgaacgttcgctcattagtcatccttcatcaattttacataattaatcttttttaattttttttactattaatagtcaaagttgaaaatgtttgacttccaaaaaaaaagaaaatgcttatattttgggacggagggagtaatcattagacacaaaggaaattattttaaaaaagttaaacgtaatattaaaaatccttcgaaactcactctaagaaatttcaaaagaatttaagagactcatcccttctttccaaaggaacacatgaattctttccatatagtaatctaatcattcaatattcccccaaaatttggtactttcaaagaagctctacatgcataaaatttggtacttttaaagaagctctacatgcatagccttactggtggctatagccttgaacgatcaatacggtgctatgtatcatcaacatacaataagacctaacatagcattattgtgagttttagacgggttccactgaagtgtattagcttgcccaatatgtatatggctagaggggtattacggtagaccatgaacctcataggattagctactgggagagagagagagtaccaccatcatggaaaagaagaattttatagcctttaagaaaatatcctaaggtagtttacactataaaatatggtgcctctgttagcttttcaaggatggaaaaattgcccatttccgaataagtataatgtgcatggcctaacaagaaaaacaattcaagtcttcaacacggcagacgcaattgatgcccccaacgtcgccaacgagactcacgactgctgcatttgctgctagctcatgagtggcgtagagatgatgttctatcgtgtccaacgagatgagcttatgaacaaccgtgctcatgctcggccgcctgctaggctcaccgtccacgcacgaaaccgccagctccagcaacccggctgcctgcacatggttgaagtcaccgcgcagccgcgcgtccacgagctcctccagccacgccggcagctcgccgtcgtcgcacttcagcttctccttgagccacacggccagtcgctggacattccatgccccgtcggccgtcgccgcagccgctacccagtcgcacaccctctgccccctgaccagctcgaggagcacgacgccgaagctgtacacgtcggctttgccgttgatcgagcgaccaactgtccagcactctggcgtaatgtagcccctggtcccctgcacccgcgacagcgccatgtggctgccggcgtcgcggctcagcagcttgacgaggccgaagtccgtcaccttgggctcgaagtcgccgtcgagcaggatgttctccggcttcacgtcgcagtgcacgatccactccaggcactcgtggtggaggtacgccagcgccttcgcgacgcccacggcgatcttgtacctcgaccgccatggtaacaccaccacaccggagctctcgccgtcgtcgcagaagagggccttgtcgagcgagccgttctcgacgaactcggagacgaggaggcggtgcgggtgctccgagcagaagccccatatcctgacgaggttcatgtggttgatccgcccgatgacgctcagctccgaccggaacacctcgtcggcctgcgtcatctcgtccagccgcttcacggcgatgctccggccatcctcaagaacacccttgtacacggatcccgtcccgcccttagcaatctcgtctctgaatccgcacgtcgcgtctgatagctcgtcgtaggtgaacctccggaaatggctaaacaccaagctgtacccttcatcaccgacccgtcctgccgccacggagtcagctcgaaagacaaacaggtaacccacgacgacaaaaatggcctccacgacgaacacaaccgcgaggaagctgtagaagtagatgaagtttatcgtgttgcgcctgccatgaaggtacgagctgctgaccgtagcgtcccgttcgtccatggtgcaggtgtggccatcgaagtgcagcaaggacgggttcaggttcttggcacccgtagggaacttgaggtagatggtttggtacggaatgctcataacccggccgttccagagagagatcttggggtagcactcaccggtgccctgccggtaaccgaacgcctcgcagcggcagtcgacgaggcagagacgccggcacgtgtcaaacgagatcccggcggtgtagttgaggtcgaagccccagtagtcggtgtgccgcatctcggcgaacgcgacgtcctcgccgcacctgacgtcgaacgtgcgccggcatcccttgctccagtcgctcgcgtcgtgaggcacatagccgtcggggcaggagcacgtcgggccttggctgtacgtgcatatgccgtagcggccgcacaaaccgtgcacgtcgcactgcctctggaccgcgacccacgtgacgtgccagcgcccggcggcggcgtcgaggctgtagaggcggaggttgccgtcgtagtcgagcgtgagccgcctcatgacgcctccgtcgcccatgtcggaggcgttgaactgcagctggtcgctcgccgtgaagacgccgcggcggtcgaagctgccgtggcggctgctgttgaacgccgtccggttgttgtcccaccacttcttgaaggggtccggccagtagttgctgctgatctccggtccgtcgtacatcaggttgaggatgttgctgctgtcgaagtagaacttgtagtagccggagtacggggagcccctcgcctcggcggacacgagctgcctgtaccgcgtcacgggctgctccggcaggagcgtgtccgtgggccagtcgaagctctgccacagccggttgccggcggcgtcggagacgacgaggttgccggtgtcgaggagctgggcgcggtcggccggcgtgccgctggtgttggtgctccacacgacgcggccgtcgtagtcctgcagcaccagcgagccgtccttgcggagctcggcgcgcgagccgacgccgttcacgggggtgtcgcggttggccgtccacgcgacggtggcgtcggcggacgcggtgaaccagacggcgagcgtgtaggcgttggtcgccaccttgtagaagccgcacgagaagttgccgctcggcgacacgaggacgctgtcggcggcgtcctccacggcgatggagccgccgcgccacagaacgctgcggcgatcgccctcgcccgccgaaagagcaacgcaacacagggaggtgagtacgatcaagtgcaagccatggactcgattcatcgtgtatcctaaccccacagggctggaggcgtgagttccaacttccaacttaaaaactggtttaaaaggggaaagaatgtggctagcctgctgacagtgacatttcccaattgagatagtgtgtaccgtcatttatttaaccattaatcttcactgtcactgccggcaagtgaacatgcttcttggtactcccactggatggaggtagctccttggtacttgaccggtggattagtgcagttagagcaagtataataatgagctataagcttactatgagtttaggtggaggagagatagtgaaaaattaagggtgttggctttcatgcaagagctaacttatcacaaattccaagacaaatacattaaatgtataagtgagggatagctagagagaagagaaaacaattatagccaaccttataactaatccattatatatgttgactttaagatatgctaataataagaagtgagctatactattatttttgctcttagcagcctcagcctgcagccagaacagtctggcagtcaagcaccccggtgaaagtagttgtactcaaaagagctaaacatcgttagtactacagactaattgacagcccaaaggccgccggcaacgcagatgggcaattacttgatgctgtggggaatgactttcacatattggtatatcttaccattttttttattttttattactttaagacagcacgtacaaaagcgacaaaaatccatctgcgatgctgtaccaaactactgaaatgggcttgcaaatgtgctattataagggaggggcatatttaccgttagcaagaagccactactattcacggtttgcaatgtgtaaaactttaggccttgtttagttggtgaaatttttttgtttggttgtcgtatcggatacacgaacatacattttaagtattaaatattgtctaacaacaaaataaattacagattccaccaggaaactgtgagatgaatttattaagcctaattaatccgtctttagcaaatgtttactgtagcaacacattattaaatcatggcgcaattaggcttaaaagatttatctcgcaatttacacgtaatatgtgtaattggttctttttgcctatatttaatactccatgtatctttccaaatattcgatgtgacagcgtgaaaatttttgtttgtaagaggtcctgtttagttcccaaaacatcatttttcacctttcacatcgaatgtttggacacatgcatagagtattaaatgtagacgaaagaaaaccaattgcacaaattgcgtgtaaattgtgagacgaatcttttaaacctaattgcgccatgatttgacaatatggtgctacagtaaacatttgctaataatggattaattagtattaataaattcgtcttgcagttttctagcagaataatttgttttgttattagactatgtttaatacttcaaatatgtgtccgtatatccgatgtgacacattgagcaaatttttttttgccaactaaacaaggccttaactctcaaatattttaaaaatatcttgattggacacgagaaataaatgcattgataaatttttcagttacgatattgtgtgaaaagtcaacacatgtcataaatgaaagtataaaataattatttaaaaatgtaaactgcactgtggatccttgctgtgcggttatgtcacgacaattttcattttatctcttcacacctgaacttgactacgctaagcggcatatattctgtttttgtatccatttctcaaatctcaataacatgcaggttagtgagaatgcatttatgcggccatgcgggtgaagggaacatacaggaaatatcttactactgatgttcaatttttgtctgatgtacttgtagaatcatgtgatgattaattttagtgatgaataattttcaaaggtattaagtcaaaagaacaattgtcaaaggtgaatgtttattgaaaatatgttgaatagtgtttccggattatgaatggtgttgttggctctgagaggttggtcagaccggtggtgttggtgcggtttgatcgggtagcctgatggtcagactggcaaatttcgggaaggagtcggttttgggttgtgtacatataagaagaggaatcaaatttggattggaaatcaagtttgagataattggagtgtggagttatatggggttgttgtttccctggtttccctatatgattagaaattctagttctatttggattcatggctaggggaagccatatttcaggtataaataacagaggggttgaggttagaaagatattgactttttaggataaaaagttagggtttgtttagcaactttaattctaattcgtgagttaagagatgagtgctttatatgcactttgtaaacatattgatgtaattataaagttaatataatttcaaaagttttattggtttgtgtttttctggatcccggtggtctaatcggagtacattgcgtggttagatcggtggtggctgcagcggcaagagcatcggcattaagtaggaaggcggtctgaccggaggccagacactgatctaatcggcgggtagacgacggtctgaccggtagtgtaatggtggtttgaccagcgatgatctaattcgaccggtacgtcttgttcagagtctccatcaagtatttgagggaaatcttttacttgtgcaaaaagatttgtttttcaatgtccctaccattcactccctggtaggcatagatgttgttattcactttcgagtatgaataaatcatggccacagttagcctgaatatttgagcattttggttcatgcatcttatttgttgactgttggataacgtactctcttatatcacttaatttctctaacttttcctattgaatttagatagccaaagtaacaccggaaaacaaaaagaaatagtgactacaaaaactatgtttggcaaaattcaaatgaattagggggcatatgtatatttcaaatgaagagtcgtgtcaaacaaatataggaggctttccctgctttaaatggttttcgagctattttcatgaaaactgacaaaaccgctcaagagaagtttttgatcagtgaacggttttgtaaaccctgactgcaacccatctgattaggaacatagttcagcttttcattctctacattagaaggaaataactcataattctattatatacacctacatttatatgaaaagcatataattttaataagtggaaataagtcaaccctaaagagatgtagtttgactaccactatgggtgtatatactgtgtattttctgtagccataaaaccatatcatcctagaactaaatgttgcaacttgcaatagacttatccaaatctttgctcaattcctatccattggaatcaacttatctatatatttactcaatttctacctgcggaatcaacttatctagatcattggcgttgacaattacaactcacactgaaaggattactgattggtaattgtgtaattgttggcaccatagttgggaatcggagagagggaaaaagggttggcaccagtcctctatttttttttctcaatgtaccgagaagaaagggggcttagcaggaataataagatgaatgattgcgatctgtagcccatgtaagaataagaacgaaattttgcaaagacaaatgaaaatcaatgaaagtactaaagggaatggtgaaaaggaaacgcaaaatcaagtgaattacaataaggaaaagataattaaattacaataaggaaacgataattaaaaaatcacttattaattttattcgtcacgcgacgtcaaggcgcatatatattcccactatcctccacgcacgttatagggaaatggagacagaaacacgacgtgtcactatgcaattttagatgcgccaagaaaaaaaagaagatcaaattttggtgacacagccttacaatttcaagatatgcctttgtataggatggcattgacttttcacattacaataataccctagttgaataatgtattaatgcatttttctcatgtctaataagatatttttaacatcatggtagttactcagaaagcgaagcttgccgcactgtaaattaatcgtcaatattaatactttgtttgtactccatccattctataatataagacacaacccatccattccataatataagacacaaccacttttcttagatgttccataatacggagtataaggcatacatgcaagcatgaaattaactatgacatcttctccattaaattattacttttttaaatcctccactctcatgctatctaatcttattggatgcatgcattatatttattaggatgatccaaactacaagatgataataattatttcttagtttttgggttaagggtggttgtaccttatattttggaatggggtgagtaataaataatagccctccaggagtctggtacaccgtacaacaccaaacgataagaaagtgatttcatctcctcgttacgtgcatgtcacctaaatggtcatcaaattttttttaaaaaaaatagcaagatagattaatatgaaatataccactccacaaacattcaagttgaaattcaacatctacaagttgaaacaaaaagaaacaaatatgtaagcgaatgtacgataaccattttaatttgttccttttttgcaacttgtggaaatcgaatttggttttgcatgtttgttgagtgatatatttcatattaatctatgttgtcaattttttttcatattttttaatgactatttagatgacatgcaaataatgagacgatatcccctcgagggatgaaaattcatttcccggcacgatgtttatttctgtggagtaatgactttcacgcttggtttggggtgtggctgctaagaaaattggcatatatgatatattcaatgcaggtgcttccattttgttttcttgtttatgctgggagttgagaaaatcttagtccataatcaactggtcaagtgccgaggaattgcctgggtctcattgactctgttaacttgttccattggcggctgtaataagcctgggacagtgagaattagtaaaagaaatgactgtttaatttgcagctaaacagtatctcaatttcgaaatgtcattgtcaacaaccatgttattttccctttaaatcgttcggagctcacgcatctaaatcctaaaccacctgggttccatgatgagtcgtcgaatccatggcatgtgcttactcgtcctagccaccttcctctcttgcattgctctctcggcgggtgatcaccggagcgttctgtggcgcggcggctccatcgccgtggaggacgccgccgaaaacgtcctcgtgtcgccgagcggcaacttctcgtgcggcttctacaaggtggcgaccaacgcctacacgttcgccgtctggttcaccgcgtccgccgacgccaccgtcgcgtggacggccaaccgcgactcccccgtgaacggcgtcggctcgcgcgccgagctccgcagggacggctcgctggtgctgcaggactacgacggccgcgtcgtgtggagcaccaacaccagcggcacgccggccgaccgcgcccagctcctcgacaccggcaacctcgtcgtcgccgacgccgccgggaaccggctgtggcagagcttcgactggcccacggacacgctccttgccgggcagcccgtcacgcggtacaagcagctggtgtcggcgtcggcgaggggcttgccgtactccggctactacaagttctacttcgacagcagcaacatcctcaacctgatgtacgacgggccggagatcagcagcaactactggccgtcgccgttcaacaagtggtgggacaacaaccggacggcgtacaacagcagccggtacggcagcttcgacaggcgcggcgtcttcacggcgagcgaccagctgcagttcaacgcctccgacatgggcgacgagggcgtcatgcggcggctcacgctcgactacgacggcaacctccgcctctacagcctcgacgccgccgccgggcgctggcacgtcacgtgggtcgccgtcgggaggcagtgctacgtgcacgggctgtgcggcagcaacggcatctgctcgttccgtcccgggccgacgtgctcctgccccgtcggctacgtgcccaacgacgcgagcgactggagcaagggctgccggcgctcgcccgacgtccggtgcggcggcgacgacgtcgtcgacttcgtggagatgccgcacaccgacttctggggcttcgacgtcaactacaccgccggcgtcacgttcgacgcgtgccggcggctctgcctcgacgactgcaactgcaaggcgttcgggtacaggccgggcaccggcaggtgctaccccaagatcgctctctggaacggccggattccgatcaagcccgaccaaaccatctacctcaaagtcgctaggagtgtcaagaaccagatgatcaaccagtcgtcgtcatttctgcacttcgatggacacgcctgcaccgtggacgaacgggacgctagcgtcggcagctcgtacctgcatggcaggagcaacgagataaacttcatctacttctacagcttcctcgcggtcgtgttcgtcgtggaggccattttcgtcgtcgtgggttacctgtttgtcttccgagctgacccggtggcggcaggacgggtccgtgacgacgggtacagcttggtgttcagccatttccggaggttcacctacgacgagctgtcagacgcgacgtgcgggttcagagacgagattgccaagggcgggacgggatccgtgtacaagggcgttcttgaggatggccggagcatcgccgtgaagcggctgggagagctgacgcaagccgacgaggtgttccggtcggagctgagcgtcatcgggcggatcaaccacatgaacctcgtcaggatatggggcttctgctcggagcacccgcaccgcctcctcgtctccgagttcgtcgagaacggctcgctcgacaaggccctcttctgcgacgacggcgagagctccggtgtggtggtgttaccatggcggtcgaggtacaagatcgccgtgggcgtcgcgaaggcgcttgcgtacctccaccacgagtgcctggagtggatcgtgcactgcgacgtgaagccggagaacatcctgctcgacggcgacttcgagcccaaggtgacggacttcggcctcgtcaagctgctgagccgcgacgccggcagccacatggcgctgtcgcgggtgcaggggaccagaggctacattgcgccggagtgctggacggtgggccgcccgatcaccggcaaggccgacgtgtacagcttcggcgtcgtgctcctcgagctgctcagggggcagagggtgtgcgactgggtggcggcggcggacggggcctgggatctccagcggctggccgcgtggctcaaggagaagctgaagcgcgacgacgacgaggaggaggtgtcaacgtggctggaggagctcgtggatgcacggctgcgcggtgatttcaaccatgtgcaggcggccgcgatgctggagctggcagtttgttgcgtggacggtgaaccaaacaggaggccgagcatgaacgccgttgcgcagaagctcctctcgctgcatgatactcgctagagcatcagtgcatcatcatcagccatctgcaccatgcatgagcccagcatgcatcgatcacctttcctggaaggctggaaccccaatgcatgggactgtgtgtgtcataccaaaatgaaaaaaaaaaaacggatttgctataattgtggccacagattttctgtccaatcgcagtcgattttttggccttaggatggcatgtagattcgtgcttatgtgttgtatccgcgcgcgttttacggctcttccacagcttttgcctcgtcaattgactccgtgtgtgttgtttgatgagggacatgctgatttgaccgatggatgagatacgtgtagtaagttacaccataattacatcatatttacactacaattacatatgtaattttaaaacttacatatgtaattttggtatttacatagtaagtacactattttttggtgaatacaatgtaaataaatgctgactattttttgagggaaaaatatggcaccataaatatagctactccccaaaaaaaattgcttagttagactgttcagggtgtgaaactgtgagtgtagtagtgtacattgtcccacaatttatttatttatcaatattcactaattattctcaaaataaattaaaaatattggtgtacttctttatacgacctagtggatggttaagcggataaaatatataaaagcaagtcctacttttgtggattaacggatacggagtatgcaacaatcaggctgatggagtgtttcgtggggaaataggataatgtactgatgtggaagcacatggccccatttcgctgaagggaattcaatttttaaaatactgtatgcatctgcttgtgtgttatatatgtaaagagaggaaacgaagaacggaaaaataatatagagtaagaattttttttttcatttttagtggtctaatagaggctgagggacgaaagcgactataaagccctcaaaatcaatctaaaaagtaaaattggttgtatcttataattcgcgcgccttccacggaaattattggattaattccaaacggatgcaacttgatggcagaaatattggcactaagttgacattagcacactaaaaccaatcgtcgacggttccatttcttttctccaacgaattagcggtgttaactattatatgattgcgattgcgatgcatccagctggctggaataatgcaatgcaaaaattgacaaaacaattatgacaggatctaatcagaattactccctccgtcccacgataacttcatttttggatttttatgtccaacgtttaaattaaccgttcatcccatatgaaaaatttatgaaatttattttgaaaacatagtgacgcataaagtattattcatgttttatcatctaataacaataaaaatattaatcatataaaacttttaaataagacaaagagtcaagcgttgtatccaaaatctgaaaaatggagtcttcgtgggacagagagagtagtaatctaaagcacatttgtttaatacgcaacctagtttagtactaggtcgcactatcttcaggttgatctactagtacatggatgatcgatgctaaaaaaacgactttggttaatcgtgtttgtcaacacgaagaattgatgcacatatgtccaattagatggccacaacgtccaacttaacgagtcactttcgagtatgaattactccctccgtttcaaaatgtttgacaccgttgactttttagcacatgtttgaccgttcgtcttattcaaaaaattttatgaaatatgtaaaattatatgcctacataaaaatatatttaacaatgaatcaaatgataagaaaagaattaataattacttaaattttttgaataagacgaatggtcaaacatgtgctaaaaagtcaacggcgtcaaacatttcgaaacggagggagtaatcattgccccatgcggctgagcatgcacatttgagcatgttggtcagctcctcggctcatgaataatccacgcttatattatatgatttgtacggactgctggatacctgcgtatagtgttcacagtttagtggactgggttttgccgagttcatgtaatacatgaaaactagctagaaagtatcaggatggtgaatataatgcctgcatttgatgaaatccgaatctactcgcgtcaaaaaaaaaatccgaatctactctagctagctaggaggtgacacacacacacacatatatatatatatatatacatacatacactccttcaaaaagagggtagtaggttaataaaaatgactaatgatatgttaatgataattttctttaattaaaatctcattacaacgcacagacaatatgctagtcttacaatttactgaagggaagagctagccctgtcaaagtaagcagtgacgaccgagttagatgaaacatgaaaccctcccgttcaacccatttgaatagtaccagagtttgttggagttcaattaacttaattacttaagtcataatcaccttcagataatgtaatgcagaaatttgatttaactgacttcgttgtgaatggatgaatcacctcacgaacccctttcaacgtcgagtcaacaactttccgtacttcattcggaagagaatattttgtaaaatcctactttgcataagtttagacaaatcctataatataaagatatggctaaaaaatgcagtaccctctagggtttttagaaattttcacatcaataaaaaaaagagaaaatgatgggttcaaacttaatgatatagaccgaaagctcaattaatttaacagttgtatacatcaaatttaattctactttaactgtttagctccgtataaaattatgcggataatctcctagtgattgtgtgttaacaaagcacgctcaccatggaacgtgttgcgtatatatgtgtagcggtgtgcagtgtacatataatgtggaaataaaaccgctaggattctaggaagtttgatcgaaatatcgtgcagattgtaacgctttacttaattagttacgtacggcagctaggtcgccgtcgtccaccggagcacgccaaaccacgacgaaatacacaccaatggatcgtactagagcatgccaaactgcccattgccaagtcggattcagattaagtgacatagggtaaacatgtcacgagatgacatagcgtagatttcggtcctccaaaataaatccaatggctgagattcgtccacgtcattacgagttttcgaatttctttgaccaccgcctcggagcccttcttcaacaactatatgtgactttcttttcccccgagtttcgaacccctcgagttgaaccatgtagatctcctcctcctcgttgttgttgcggagaaagaccgtattcacgtctagttaaaatagatgcaagtcccctcggccgctactatatcgagaatcattcggatggttttgagcttgactgcttttacctgaaaccatgcggcactcaattgccgcacacgcaacgcagcgcaattcactcagccgacccacccttgtgggcaaacatgttgtgccgcgcgacgcgataacgatatttttcgccggcccggccgcctccacggtgtgagacgtgaaggcgatacggccgttacggccgttcgcgcgtaaaaatgccgactgagatgtggcggctcccggctcgggacggcgcatgcgcagcatcgaccaccatccgcgacggcccgccgccccgcgagagcgaacaaccacgggttgcgcggcccacgctataaggctacgtacaaggccgcgtgcagggcttggggttgggggatggaattttgggccttttggtggaatgaggggccgatacgttgcgttggggaagcccatcctatctgagagagttggagtttacacccattgggtcttaggcctgcctattagatcagcccaaatacgcccatttcaactcgtattcgatagctagagagacttcctttcccttaaaaaaaaaagtgagttcctttaagatttgagcacttttttttagaacaaagatttgagcactgaatcaataattaagtagtactactccctcaatggcggaggtaggtgtattagctggccggctcgctcccagcacgcaatgcaactctcctcgaccactgtcatgtcatctcatctaggccctatttgtaggccctatttggttctatgggctaatgtttagccctaacattttagcctcaaattagccctcaaggatccaaacaggtggactaattttgtatggggaccatcaagggatgctaatggggttaattttgcgtggggaccatcaaaatttgatatcctgaagtgccaggaagcaagctactgtatcacgctctagtactgaagccgaatataaagccttggctaatgcaactgctgaggtaatgtgggttcgtaaattgctagaagagattggtttgttgcatccaggaccttctcaattatggtgtgataatattaaagctacctatttgtcagcaaatcctgtgtttcatgctagaacaaaacacatagaagtggattaccattttgtcagagaacaggtggtgcagaaaatgttggaatttcggtttgttccgtcacaagatcaaattgctgatggatttacaaagcctcttcctgtgagacaattacaattgttctgtaacaatctcaatcttggagagttgagattgagggggagtgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacagctaatggggttaattttgtgtggggaccataaaaaagcagctctctctctctcctctctttctactctctctccaccttttaaccttgaattagcacatggatccaaacataccaccttagcctaatgtttagcctaccaattcatgactaaacattagctctcaaaattagccctgggctaatcttccaaacagggccctagtacgccggatcgccgactaacgaacaggttgccgtcccttgtttaaataaacaaacaaatatttcttccccgttttaaaatataagaaaccgaatgtgatttactataataaacaggttgccgttccttgtttaaataaataaactgtgatattttttaatattataaatctaaaccgatcagacctaagatcggatgggatattttctagtagtataccgattcttaatagtaggaaatggcttatccgttttcggtttagtccctccttcccagtaccaaatgcggcctctgctgtgcatcggtgcatgtgccttatcgagttcttcggaaacttctgtgtgttgcgagttactacttgtttcaaaatagcactattttagaaagagaaagtaaagtctaacacattcacggctaagccggcaaaattctcaattcatgttaaggacctctcaatgattgagataatttgaagaggcatttcatttggcttctacctcttatatgattcaggcagcaatccccgaaaagtaatatgattcaggcagcacacaacgatttagacaatacgcattccaaatcatatttatatattttcacgatgtaatcatgcattacaaataatcgtgcgaataaacaaataagagcaaatagttagagaagctgacagcctgcctaaccactatagtaaccaaatacgaacacgagcagataagcaacaactcgtcacgcgtcaaccgccgcagccgccgccgcagccaccgcccccgcacccgccgccgccgcacccgcctccgccggagtcaacggccgaggcgatgatggcgccggtggcgagccccgcggcggcgccgacggcgagcccggctcctgggccgaacccgctgcggccaggcctcccggcgttcgccgccgggtacgcgtaccccgcggggggcggctgcgccgggtagccgtacgcgccggcgggaggcggcggcgggtacccctggccgtagtagtagacgtcgttcctgttcttccgccgctgcctcttggccccgtccgcgcagccgaacgcggcgacggctgccacggccaccgttgcggcgacggccaagatcaccaccgcggccgggctgagggaggcggcggcgcctcttccaacgccggcgtgaagggcatggagagccactcccgctctcaccatggcttgcgcgcccgataagagaagagatggagcgaatgaatatgaatgcgtgtttaaaagagagatgagggtccacggatttggcatgattggctccttttggtcaaagtctaccatatttgattattgaggagtactactactgtatttttttttaggagagtagtatactataactaatatcctcagatatgtacgcgaatatttagtattcaaataagtaaaacgactcgtacaacttgagaacatcgtgccctccagcatctctcaacgtcaggaaatttctgagcctgactggatgtggatgaatgtctctcccatgcaattgcagctaagcccaagcggttgataattactacctcctatagatgacgccgttaactttttctcacatgtttgaccattcgtcttattcaaaaattttatataaatgtataagatataaatgacacttaaagtactatgagtgataaaacaactcataacaaaataaattacaattacgtaaagtttttaaataagacgaatggttaaacatgtgagaaaaggtcaatgtcatcatttattaaaaaacggagggagtatatataaggaacgcgttagggagggagctcaggaggatatgcgaatagataacaaaagtcaatagcttcaagcagttgttgggatggagtcatggagattaattttctcggaccacttccagttgctcatagctaggttcgttcgttgactttgtgaaatttttaccttcttcctgtgcactctgagaggcagggtttaactttccaatttcaaagtaaaaactgctcctcggttttgccaaaatccgatcgaaaatcggtaaaaaccgatgactttcaattaacaccatacgaaaactgactaataccaatccttttcacaaaagtcgaccggttttcgcgaaattccagcggtattgcgaatcctgctagtgagaggcaatggagccgccattgcagacgaagatggagcaggcaagcaagatacgagggaaaacaaaaagattattctctccatacttttcgagcaccaaattccaccctacttactcccaattctgcacacatcaaccatgttactctccatgctttggcataatatgctcccggccggtcatctttccatgttgcatcgacgtcatactcactcgaacgatgtcgacactggctcttggagaaaggaacgacatatcacatatgtctatgatattctatcccttcatcaaaccaacaggtatacaagattatcactagctagcactgcaccatggctagagcccaatttcgctctcagctagcttggattgtctgatggcgacggaagatatttttttgccatgctcaagagatctagtcggccgatgatcaaaacgatgaaagccaccaaggcacaaaactcgatcatcatggctgtcaaaatatgcctgacgcactcgctggcatatgcatctcatccaggattagatagttgtttcagatatgattgcacaatatcctttaaatccagtcgatatgttatagcgattctgaatgacctctaccgtacttgttgtgcatgcactgaaagaactgaaactaaaatatgcaagcatgaaaaaatcgcaatcatgaaaggatcaagcatcaagtcacacaaatctgaaactgaaactaatttcgaagcgagagagattgagggagagaaaagagaagctggagaagccataataccacttgcaggtgggtctcaaaagggtttttatttttatttttgtatatagggccacatagatgccatgtcagcattaattgaccccattaactcgccacgtgagataaaaccgttattcaaactgctcaggaactggttttgatggttagaggatgctctgtagggatgcaaatgaacctccacctatagttgaaggaagtgaagtggacttttcccattcgaaatcagtgttgggccagttattgggttttaaagcaggccttagaaattgtttcggacgaaaaaaggctacccgattcggtcaaccttaaaaaactgcaactccggttctctatggcatatgctttccaaagatcgacaaagcccatcacaattcgcacgagaaacataagaagtcagctgaaaagcatcagttgagttggaccagtccagcagagataatatagtataacgaatctgaataatagtagttttttcctactaatatattgacgtgcaatccttttacgcgttcgaaaaaaaaagaataatagtagtttatgttttatcctaattctagattgtatttttttttgggaacggatggtgtaaacctgaagattcaacggattcacagaggatgttccaatcacagctttttagtctcgacgttcgagcagacgccgcctgaagcatccgtaggcgatttggtgattggcgagagctccgactttcgccaaagattcagcgtttgttattgttagtcaagaacggctgcgcggtgcgcgcgtacgtgtgcttttcctgatccactaattctcaggccatagctgcagacagtcagacatcctctgatcctctccatccagagaggcaaaacggggcctcttatcattttggatcctccatgagatgagctcaatgatttagctgcgaaaaacagctcgtcgacatgcagtaagaatgaagaacatcaagctcaaggaagttatctagattctactagacaagtaagccttttttttttctctgtgcccagttgatctcttcttcatttggttttcatagttcagttgtgttgtgatcttcttctgtgttcctcagctgcaaaccaagttctactggttgttcttctccttttcagtggaatcagaccaagccttttacgtgttcttgaaaaacatcgttctgagtcttgtagacaccataaacaaacacagttgacatgtgttcctgtcatgcaggccacaagtgattcttttgagttctgagatgattttgttcatgcatgaagtcctttctgaagtttattatggtgaactaaatatattttctgtaatccttaaatttaagcacgtggtgtagttccatctgttggcacatttgtaaacttaattcgtatttttttttgtcttcacgccggccgccgggcggctaaatccgtacaaagaataatcgcccacactcacccacacacacacccaaaagaaaaaaaaaaggctccaaaacaaagcagagttgttagttgttcctttcttttctatgaggaaatcaaaagcaaactaactgtgctcagctcagattaattctgaattaatcaaactaatggtggaactggtgaaatgtgaatagtacaaactatcaatgttaccttacaatcaagatatattactgctaattaaaatgtgcaatgatatctctgatttttatgcttgtctgatctatgcaatgacgtactagtacgcaaactccagagtaaagacaagctcaattagagaacgaatgtgagcatgtctactgctgttgccataagtaagtaccaagattaattagtactatcaccatggcaaaataaaagaccaagattttgcttatctaactgttcgtctcacctcactggtttcttcagtatcgtcagtctcggcaaccgcggctgcagtagtgatgctcgctctgatcaagcgatgccgccgctacaggaggaagatgaagaagaagatgctagctaggatcgcccacgaggcgaccgaacagcaccgcgagatggaagcccgcgacgcggcggacagcgtgatgatcgagatcggccccgtggagaagttcctcaacgagatcctcagcgagaagccgatgcgcttcacctccgagcagctggcggcgtgcaccgggaactactcgtcggagctcggctccggcgggttcggcgtggtctacaggggggagctgcccaaaggcctgcaggtcgccgtgaaggtgctcaaggtgtccatgaacaagaaggtccaggaggcgttcatggcggagatcggcaccatcgggaggacgtaccacgtccacctcgtcaggctctacggcttctgcttcgacgccgacaccaaggcgctggtctacgagttcttggagaacggctcgctggagaagtacctctacggcggcggcggcgaggacagggggaagaagctggagtggcggacgctgcacgacatcgccgtcggcacggcgaaggggatcaggtacctccacgaggagtgccagcagcggatcgtgcactacgacatcaagccggcgaatatcctcctcaccgccgacttcaccccgaaggttgccgacttcgggctggcgaggctgggcgagcgggagaacacgcacatgtcgctgacgggcgggcgcggcacgcccgggtacgcggcgccggagctgtggatggcgctaccggcgacggagaagtgcgacgtgtacagcttcgggatggtgctgttcgaggtgctggggcggcggcggaactacgacctcgccgcgcaggcggagagccaggagtggttccccaagtgggtgtgggacaggtacgagcagggggacatggagtgcgtcgtgtccgccgccggcatcggggaagaggacagggcgaaggcggagatgatgtgcaaggtggcgctgtggtgcgtgcagttccagccgtcggcgcggccgaagatgagcagcgtggtgcggatgctggagggggagatggccatcgtcccgccggtgaaccccttccactacgtcatgagcggcggcagcggcagctcgacgctgacgagcagcagcacgaacctgagcagcgggggcaccactacaggaagcagcgaggtggcggtcagccttcctgccaaaaagtccacggacgtcatggttgaatagtctaagtccaagtgaaaatgttgacccttctccctttgtacaacggtaccagcgagacaaagatttcgtacatattttatcgtcataatgttgttgcaattatatttgttaataatgtaattattttttacctctgtttatgagtttactagtaccggattttgaatcactttctaaaaaagaataaaagaaatgtgtgaattttcgtaggaaaaagtctttgcctccctcaaggtaataattctttccctctctatatatttatcgataaattttctccaaaatatttatcagatataagtatagtaaattatgattaattacattataacttgtatgtaattacaatgtacacggtaagttgtgtgttaaaatccctcgttaccatgctatatttttgtaaaatagagattgtgggaccaaatcccctcatgtgcgcacactatgatttttgtcttcctcgcttgcataagacttaaaacagatctaacagtttaaaaatatatgaaagttacacataagatatactgtatttacatgtaagttagtacaatataattacactatgatcacactgtatttacatatgttaaatttcagagagaaaaattgtcaacaaatatatagcaaaatcgatcctcctctacctctgatcctcccaatgacagtcagggcccacatgtctaacccatcttcctcgctacagagtacagactgcagagtcgaattgagtcacaccgaaacgtttaaaaccaaaattagcggaacaaatacggcactataacagtctaacacactaaaatgttgtagacatgcacttatacacatcagtaggtgtacgtctttgaacacaacagccttgctgacaactcacacccgtgctgtgcaaacgtggaagaatcagaaaacgggaattcgtttccgacacgtctacctgccggtacgagccgacgaaccatccgattccgtggtggcggtagtggtggtcggcgacgagccggcggcgctgtacggcgcgaggtgggcgaacgggttgcgcggcgcggcgatgtggtcctccccttccagcatccgcacgacgttgcccatggacggcctgtcctccggcctgtactgcacgcaccacagtgccaccatgcacaccctctccgccttctccctctccctcccgccgcccgccgccgccgccgtcgcgcgcgccagcacggcctccgtctcgccggcctcgaaccggtgccacacccaccgcgggtaccactcctggctgccgtgcccgtgcgcgccggccccggcgccgagctccaggttccgccgcctcccgagcatctcgaacagcagcatcccgtagctgtacacgtcgcacttgtgcgtcacggggagcggcatccacagctccggcgccgcgtaccccggggtgccgcgcgcgccggtgatggtcaggtgggtgtcctccctgtcgcacagcttggcgagcccgaagtcggacaccttgggcgccatcccggcgccgaggagcacgttctccggcttgatgtcgtagtggatgatccgctgcgcgcactcctcgtgcaggtaccgcaccgccttcgccgtcccgacggcgatctcgtggagcttctcgaacccgatcctctccgccgccggcgacggcgacgagtcgaacaggtagcggtccagcgagcccttctccatgtactcgtacacgagcgccttcacgtcggcgtcgaagcagaagccgtagaggcggacgaggttgatgtggtacgtcctcccgatggtgccgacctccgccatgaactgctcctcggcgcgcttcccgagcgtgctgttcagcaccttgacggccaccggcgcgccgctcgggaacacgccgcggtacaccacgccgaacccgccggagccgaccttgtgggcgtagctcttggtgaaggcgcgcagctgccgcgcgctgaaccgcacgggccgctcgttctggaggccctcgatgaagtggctcatgctgcccatctcgacgacgtccgcgtccgcgccgccgattccgccccggctgctgctgctgccgccgccgttggcgatgggcgtgtgatggtcacgactgctactataccacattttgatggcgatcttggcgcacttgtaaatcgcaactatggtcacgactgctactataccagtcgtgatcaccccaactgcgatatgttaatcaaaattttgttactacaagcgacatagatgtagataataggcgatgcatatgagtacatcgatcatacttactgagtgctaaagcaagacttccattggcgatggccatgctgatgaactaccaggaggggttagctacagtgtgcaaggagtgttggctacttggcttatgaagtgtcttcctgccttgtgagttgtgaggatatttttattggttcattttgtttgcagctagctgatttgactgtttctgtgtgccactgtcaactgtgctagtgtgagagaaaacaatgtttctgcactcttcatgcttacgcgatgaacacaaagatttgataaattcaataaactaaaattagaagaaggaatactatgtatcctgtttgattggtgttgactaaactagttccccttcctttctcaccaagtaaactattttaatgattttttaaaagaaccgtataaataccatgaggcttcattttttttaaacacagtacaaacgcagacacttatagaaaaaattacaaagttgtaaccctaggagtaggagcagagccggttctatgcaagaaaaaatagtgagaccatacagtattaccatgtacatatagtcgtgatcacaccaactgcgagatgttaatcaaaattttgttactatgagcgatatagatgtagataataggcgatgcatatgagtacatcgatcatacttactgattgctaaagcaagacttccattggtgagggccatgctgatgaactactaggagtggttaactgcagtgtgcaaggagtgttggcttattaaggcttctggggagataggggagattgagtctcgttttccgtgcgcatgtttttcaaactactaaacgatgtattttttgcaaaaaatttatataagaaagttattttaaaaaatcatattaatccatttttgaaatttaaaatagttaatactcaattaatcatgagctaatggctcaccccgttttgcgtgccttcctaccttgtgagttgtgaggatatttttattggtcattttgtttgcagctagctgatttgactgtttctgtgtgccagtgtcaactgtgcgagtgtgagagaaaacaatgtttctgcactcttcacgcttacgcgatgaacacaaaagaatttgataaagtcaataaactaaaattagaaggggaatactatgtatcttgtttgattggtgttgactaaactacagcttccccctacaactgattatgcttccattttccccttcctttctcaccaagtaaactattttaatgatttttaaacaatggtttgttaaaaccataccaccctatatttacaaaatttgagatatgccatccatatcttaattacatgtaggacctacatgagtcaatgacatgtgggtcagggtgacatatcataaattttgcaaaatttgtatggcatggtttaaattgtccctttaaacaaactgtataagatgtcatgaggtttcatttttttaacatggtacaaacgtagacgttcatagaaaataaccacaaaattgtaaccctaggagcagggccagtcctaaatttttggaggcccaatgtgaaaaaatatagaagccctacaatattagtgtgtgtgtatatagatgtacgaggacaaaattaactttattttattatatggaagtcccgtgagttcacatacgctcgaagtgaccgagatcaacagaacattcatacaccccaactgcgagatgttaatcaaaattacaaaaaaaaattaaagagttaatacaactgtgagcaccatagataagctaattatcgatgaacatataagttgtactccctcctttttttaatagatgacgccgttaactttttctcacatgtttgactattcgtcttattcaaaaaatttacgtaattataatttattttgttatgagttgttttatcactcatagtactttaagtgtgatttatatcttatacatttgcataaaatttttgaataagatgaatggtcaaacatgtgagaaaaagtcaacggcattatctattaaaaaacggaggtagtatggattatacttactgatcgctaaaacaagaattcctggtgacctggtctgaccgccatattgatcagttaggactggatagcttcagtgcaaagagggatggattattggcttgctgtgcctgtgacgtttttttagttcatttaatctgctttcatgcttgtcatttttggacatttatttatcacgtttgtcaacttttacatatatagttcttccaagtgtgcaacgaatggttcattcggagagaaaacaaatagtttctgcacccttcacactcggacgataaataaggggctgcttggttggcggcttggaatgccacgccacggcgtggctcgccacaggagtgtggcggacgtttcgtccgcctcagaaaacactgtagcgtggcgaaaatactgtagctatggcattcaatggctgggatccaaacacacccttaagaatatgagcaagtcaatggaactgaaacttaagagaggaacttagcttggtacgatgatagcgtccgctgcgatgcatggaacagcgtgtattggttctaaaaaaaaaaaagaacagcgtgtatttgtatgtcgacttccattttcctcttcttccctctcagaataaacagttttattgcttcttacatcaccggcaatggcgttgatcaactgaaaagtttaccatgtcaatcagaattcgccctccttgtgaattgaaaattttcaacttgtgtcacaagtggttctgttacatgaacagacagataccgtcataccaagttaccaactcgtatagtgacattttgatgggccgcattcaaagcctcaaccttttgtggggccaagagcccattaatatgctagcaatttctctaggaaacatgtttatttacagtacctgtagtacaagatgacacgttgagtactccctccgttttaaaatgtttgacaccgttgactttttattacgtgtttgaccattcgtcttattcaaaaaatttaagtaattatttattcttttcatatcatttgattcattgttaaatatactttcatgtacacatatagtcttacatatttcacaaattattttgaataagacgaacggtcaaacatgtgctgaaaagtcaacggtgtcaaacattttgaaacggagtaatatttgagtgtctgcactccattaacgttcccgttcaaacatgacatcatacatgcacttgctgtcataaacttgatagactcagccgcttcctttggattgactgataaaattttcaactcctattacttgctgatcctgctggtgttctgtaaaataatattgcactgcgtgttctgcgtacacacgtactctaaagtttgaacgacgtgtaacggcatatgcatatgttaatgatcctaagcagtacgcgtaagcattttttacttggtagtttagagtatgtgccaagtttctgtaaattctccctgcgataccgacccnnnnnnnnnnnnnnnnnnnnnnnnnnnnnnnnacaggtcaaacgaactgcgaaattgttccgtgaacttaactgataattcaagtttcaagtttcaagccaagaaatgaagtacacctctcttgctctaggtaagcatcattcatgtgatcgtctcgtgtgcttgacttggttttttttctcgttttaatttcgtttaatttctaatggaaattttgtgcacacatgtagctgggattatcatcggtggcattgccgccatcctggtcttgaagttcatcatgagatgcgtggaggccaagcacgccgaacgcgcgaggcggcgggaggaggaggcagtgccagtgtcgccgccggcgagcggcacgtacagcagcgtggacgtccgcgtcgagatggggtcggtggaccgcttcctggacgacatcctccgggagaagccggcgcggttcacgccggagaacctccgcgagttcacgggggactacgcggagcggctcggcgccggcggcttcggcgtggtgtaccgcggcaggttccccggcggcgtgcaggtggccgtcaagatcctgcaccgcacgctggaccgccgcgccgaggagcagttcatggcggaggtcgccaccgcggggcgcacctaccacatcaacctcgtccgcctctacggcttctgcttcgacgccaccaccaaggcgctcgtctacgagtacctcgagaacggctcgctcgaccgcgtcctgttcgacgccgccgcggcggccgccctcgagttcgacacgctgcacggcatcgtcgtcggcacggcgcgcggggtgaggtacctgcacgaggagtgccagcaccggatcatccactacgacatcaagccggggaacgtgctgctcgccggcgactacgcgcccaaggtggccgacttcgggctcgccaagctctgcagccgcgacaacacccacctgacgatgaccggcgcgcggggcacgccggggtacgcggcgccggagctgtggctgccgctgccggtgacgcacaagtgcgacgtgtacagcttcggcatgctggtgttcgagatcctcgggcggcggcgcaacctcgacacccagcgcccggcggagagccaggagtggtaccccaggtgggcgtggcagaggttcgaccagggccggttcggcgaggtcatggcggcgtcggggatccggagcaaggacggcgagaaggcggagaggatgtgcaaggtggcgctctggtgcatacagtaccagccggaggcgaggccgtcgatgagcagcgtcgtcaggatgctcgaaggggaggagcagatcgcgcggcccgtcaacccgttcgcgtacatggcgaccatggacgcgatctccagctccagctccggcggcggcggcgtcagcaccgccacctccgcctccgcctccggcgactcggcgcaatcgactcgacatgacatctgccattgacatatgcttgggacaaacgtgcatgtgtacccattttcgtgtagtacatttggatgagctgcttggaactttgaatagtatgtaaactgataggcctcggttagaatttaatatgcttgaaaaattgcagtttaaggaaatttcattcaaaaatttaaaaattttaaatcgcacgtacattttaccatggcgagatccctctgcttttgaactctcaaaatcaaacatcaggtcagctggtggcctggtaatgtaactcgattattattgggccattcggcccagcattaaaatgatgtgaagaacagcccagcccagcacacagaatgcgtcttcgtcgatgggtggcgtacctaacatcgacggcggataaagcgtaatcgacggcgtaaggcggcgggaggggaacattttccagccgccactctccccccgagagaagacattccttcacccacctacccaaacacgccgccggccctgacccaatgcgtgcgggcccaggcctatccactggatcaacgggcccacatttcatcggctacctcacgttgtacatctggaatctggagcttattaccaaaaaacctcgtgtacccaacacgtcagaattgtgacccatacgagtcacagacaactgggccccaatgcctatccggacccaccgcacagatacagttaaatcatcttctgttgatgaaagattagcagcggaaagtcgcatcgaaactgaggcggcgattggattgtatgtgtcactgcaggtgggcccgtgcacgcgaagtacaagggggtgtcccgcttgtcataggatgctgcacacgcacgctcccgcataaagcggtggacttagcagttacagtagttattcccccttcccaaaaatcgcctcagattttctggttcgaaatcctctaccccctcccatggcgtccctcttcagggctcgccgccggcgatcgccggaggacgacggcgagggggaggacggatccgcgtccgggcgggtcacccgccgccgcctgtcgccggaggagggcgcgctgtcgctggccgaggcgtcggcgtcggtggccgcggcgggggcgggggcggagagtagccccgggtggctctccagcatcgtgtccggagcgaggagggtgatctcctcggtgttgttctcctctcccgaggaggccgcctcaggggaggaggaggaggacgacgacgaggaaggtactccttgagcgccgtggagtagccacgctgttcctcatttcagatttctgtttgtcactctctccttgcttgcttcactgaactgtttcgtctacttgaccgcccgagttgtgccgctgcggttacttgcgctgttgggtgctaattacgtcttcgctgcaaagctagggtttcggcttgcttgctctaattagagtagaagtagtggaattttgataattcggggtcagtagcagagagagagtgtgcgctgacggttttttcccttagtagactgtggttgggtaagaattttgcggttttgccacattaggtggaattggggataagcttggtttgactccaattacacagtcctagtgttgtggaattagaatttgaagtttacaatgtggagtgctccggctgctgtattcatcaatcgatgcttcagcagcatcacacttccatttggtatgcttgcgaagataccatcattgattcatcaacacaaaattaaaggcatgtatttggttagctgccaccatcctaaggtttataatgtcctgaaaattatgatacgaggtgcagagggcttaatttagatctggcatggttgttttcagaatcaacctcatttgggaaccacagttacttgcatgaacatcgagttaggatgacatggtgcatattattggaattcagaaaataattgagccatcttttgtcacatatgctagatatttccagaatgtagaatagttgagctatttgttattgacctgttagttctattgtggtttgagaaggtgctcgatctttagctttgtaatggtggacagcacttttaattgaccttagaccattttagagggatgcactgcagactaatcagtgttttgtacttttgcatatgaaggaacagtgtttccaattctgttgagccattttacctttcgtaaactgttcgctcacacaactacattgtgctgcccacattcagatgaactatttttgggatggtttatgagtgcgttcatttgtaatacctgtgcagatgaaacagaagacaatcatggagcaatagtttcatacaatgagtcaaagcttgccattgaggaaatggttatgaaggagacattctcaaggtaactgtaatgctattgttctttacatgtgtgcttagatgtatatttttttccctggacaactgctaacgattaaatttaacagtaaagaaatctagtttatttctcatttacaaaacagttctgataatacaagcataggtgcatatggcctaagttggagctactcttcttttgattttttgtactatgaattctatagggtactatgaattaaaagggtaaaactattcaaatttgagttggagaaggaatcaaagtcatgatattattgcaactggataagatagacactctgtagcagtaggatgaggaaaattgcacttcaaagtactaagcatgcaattctgcctgtggtgtgtgctgccgagatactgagaattttatgttgaatagatccatacatattctacgttttcttaaacagagtaaatttcacagaactgcaattattttgtcagaactatcactttgctacaactttaactgctatatcacaaaaccgcaatcataccaaacaactttatcacaaagcagcaacacccttatgtgtgtatgacatgtgggcctgacttaccagcatgaatattgcatgggtgtgacaggtgggccaaaaacttgtcggacaaataaagttgcagctttctgataaaatcctttattatagttgcagttctctgaaatgcctagctaaaggtgcacatggttgcatgagtattgcatgttacagtaaactgataattttggcaaaatagttgtagttatctgaaatttactctaaataaaatccttataacctattactttccttctcaattattcatgtttatttttatagggatgaatgtgataaaatggtaaagctcatacagtcacgagttacagatgctgcacttcctgaagcacctgagtatggaacgccgaaagaaattccaaccaggaatactgttgttggaaatgatttcacgggagcttggcgttccttgagtcgccacagaaatggcactgaaccagttccattctctagtattggatctggtagcttttctcctggttctcctctccatgcatcgcccgagctattaagcgcagcagttatggaagcaaagaaatggttagaagagaaaaggcagggattaggttcaaagcctgaagaccatg

SEQ ID NO: 61955 - DNA, 1576 bp, Oryza sativa
  unsure (1)..(1576): unsure at all n locations
ggcgacgggaaacgccggaatttccgacggccacgaaattagggcacgatcaaggcggcgaaaacgccggaagaaaggggataccgggtgggccccaccagtcagcgagggtggcggacggccccccccatcagcggcgcgcctggaaagtagaccaaatggcccgggggggagaggagagagaggaaaagaaatggtccgaaccggcccaagagggggaggggggaaaaagactttttagagcttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggagactttcacacggattttaattattctaggcataatttcgaggatgtattttagagttgttttcggacgcgacaaacctacccccttaaacggaatctcgaccccgagattcggaagaactggcgaagagatcgggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggccaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcaccgagcaatgatacggaaaggacccacgaaccgaggtgcgagctttccctttgtctgaaacctgtgtacacccgcaggggcgtgacccgaagatacacaaagtcatccactgcgaattccaggtcacggcgtcggttgtctgcataaattttctgccgagactgggccacctttagattatcccgaatggttctgactttagctttagcttctctcaagatatcagtcccgaacacttggcttttcccaacttggtcccacaatagcaatgtcccgcatttcattcataccacgcttcataggtgccattngtttgctggcttggagctggtattgaagaaactcggatatggggactttattccagtttttccgaattttagcacttgcccgaagatatntttaggatttgattagacgctcggcttgtcatatgctgtgggtgaacctggtgctgaaattaaatcgggaccaccttttttgtagtttttcacaagggaagggaatggttccccattaaaacaatattttgggaccgccgggactcccaacctcccaaaaaaccgcgtgtttgtcctccaaggggcttcaagaaaaacggctcctggttttccccacacaccctttaagttccccttgtgttgaaaccggagaaacccccactttccctcctcttgcttggagaggaaaaccgcggttggtgtttttttccctgcacataaagggcgaccttttttct

SEQ ID NO: 61956 - DNA, 607 bp, Oryza sativa
attaatttcggccgtttggcggaaacaaactgatttgacgagatgactagagtaaaccaaattcggctgtaatatgaccgaattgatcgattccccagggagtgctcaaaaatcgtattggcaacttttttgataagtcgataagtacgatcgcagcatctaaacgtcttgcagtgatatggagtcgccaaccacctcgatctagccaaatggccgaatcaagatgggttttgtagaaaaacggctaaaccggctagcggagccgatttagagatcaaaatcagcctctaggccaatttagatcgatatgaggataactacgcgtctcgtgggcaaaacggaaggacaaacctacaaagaggtgtcgcactctcgcagcggcagcggacgatttacaacacaaatcgacaaagatagactaaaactagggtaaagtagaaaacatggtaaaggaacgattcaagtagattatattcggggctttacaatgaaccgtccttatctcttaaataggggttggtcttgccctctacaggcccttctccacgtccaactcgggatagaaaccaaaggaaacacgaaacatagccttccctagcaaggaaac

SEQ ID NO: 61957 - DNA, 621 bp, Oryza sativa
aaaagggcattcgccgcgaaatccgccgaattgcggaagaagcattgcggtggcgaggtggtgagcacagcgaaccagtgcgtgcggcgggggcaagaagaagaagtggagcgagtggtggtggtggtggcggtggcaactcacccttctggacctggaagaactggagcgccaccccgagcgcgtcgccgtacttggagtcgatggccccgggcgggccgggcaccggcagcggcttgagcttgcgcccgctccccccgccgaccttcttcttcatgatggccaccaccgccgccgtcgccaccagcgacgccaccagcgccacgatcagccacccgcagcaccccttcgtcttggaccccatcgcattcgcctcctgcaacccaccggagacgacgacgcctccgcggcgctgctcggctcggcgtctcgctcgctcgccgcctcctcttctactgcaggggatgggctcgcgtgggctttcggctgggttggtggtggtggcgctcgtcgcgtactcgcgtgtggtgcggccgcgggggggttggtgcacggtcggggtaggggtgaggtggaagtctgggagtcgctgtcgggtggggcctaggcgtggtgggccac
